United States Patent 8,781,750 (CELL-TYPE-SPECIFIC PATTERNS OF GENE EXPRESSION) - sequence listing, part 35

SEQ ID NO: 37346 - DNA, 365906 bp, Homo sapiens
tgccccgcgcgctctgctacgggcccgctgggcttccgcgccttctagcttccggagcccactttgatcggggccataatacctattgagatcccctcttctgtcttgtaccttcgccactggcatcggatttgcagaagcgtgcgtgggatcagaggaccgccctccccacaacaaccggcccctgcatcttagcagccgttggaagccccagctcttttaccgccaagttcatccttgggagacagaagacgcgtgatctcctctccgctgctcttggggtctccttgcagccctggccaggcggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcagcgggcgactgcgagggaggaccgtgtcccatccgttaagcgaagttagcactggttctccagcgcaaaccagcccaaccaggtcttaccactgcggcgacccggcggtgcccggctgccccctccggcccttcctgctgaacccctgcgtccccatccacctttctggcagtttctgcgccccttcacgtggcagcagttcccctgccttcccctcttcgcgctccgttgctcgcagacgtccccgcctccctgtctttgcgagtctctaatgaagaagtaaatgcagacccggtgttgacggcccacgcgctcctgatgaggcgcttccagagttcagcgaagtggagcatggaggccgttctctttgtgaacgccgaggccgccgccccgcgccagtccggccgccctaggcacgttccgctctcgcggttgcgtgtgggccgggagtaagcgaagggcgcggggctaggccggcaggggccagcgcgtctggattcgtcccgcggcctctttgcccccggggtgtaagggtttcgggccgtggagaggaggcgctctgacccgcacgtctccacccgcgcagcccattgcacttcaagtcgcccttcttatccaacccatttctctcgcccttagttttaaggcccaagttgagccaccttttgctttgcaaatggctcttctacccccagcctcactaggttacccttactcctttctcacctctccgagctggccaaatcggggctctactaggggtgccttgtcaggattcgatccacatttgtgtagggtggtgggtggagattcgtgttatatcgaatagcccaacaattttaggaacaactgaatggtactctgcttagcatggagaagtgggttgagtagaaaggaagagaagccacgcagaattctgttttagcacttgtcatttcatgctattcagaacagtttaaagtttaagcacgaacatgtcttactcaacaaaaagggaatgcacttgggtgggtgggggtgaggggggagcgtagcaattgaatttcaggtccttgaaaaaatatacatccttatgagggatgaacaaaaagtttccagaaaatagtttactgggtgctgacttgtaaaattctatcattgaaacagtttgaatacagatttcaaacatgatgttgtagagtcaaaggtgatatagagcttacttctatgaagagcattcaaaccgcagcaaagcctggttttacttgaagtgattggaaccagggcaagtttagatcttgacctgaaatgccagaaaaggagatcgtgactcctgaaggaaaagtgctgcagaaatctgaacaaaaatgtcagggcctgaatactatttccattcttgcccctgttagtagttttcactttacaatcacagcggggttccctgagctgcaaatgaagaattaagttttaatacaaacagaattgttggaaggtaaatgcctatgaatgcaagtctttgaagtgcagttgttttgatggcactaatttttttctgtgccttaggaagtttcgccaccatgctacctaaggacagtgttctgaatttttataaaatttcttcctgaatagcatgagaaaattgggcatttaacctcctgaagggaactttttttttggggggggtgcctaacaattatagtaaaatagcagaatacctgtgaaattaatatacaatccttacagaaacaaaaatggaaaggactctcccatacacaaaacaaacgaaaacttttttgtgataatgtaaccacttcattttcttgtcatatgccagcaagaatgaaccttgtaaatgtgttgagtcatgttaaaaatatccttttaaaggttatcctcttctccttcctacatactttgtatactactttagtaattgaattaacttttagttctgatttactctaaactttacttgaagcaggtaaacatagaaataaaatggaactttcactttctggtttttctcttagggatttaaatggaaataacatcacaagaattacgaagacagattttgctggtcttagacatctaagagttctgtaagtgcatcctctgtatttttaaataattttttaaggttgcatattttgaatcattactggcctcagtttttatgactattctgatgacagtaacataaaacatttaaaaggtcatgctttccttttttctgtgtttatcattgtactacaacatttaataaaaattggggcttttattttaaggttggaagcatgccatagaaccaataatccagaaatgacctcagatctttgttataccataccctaagcgctttatgcatataaaaatgttgaataattgttttcacaaaatgaataagtaataagaaacatttgatacttttaggatttgaaattaactaaaatatttaagtggatctgtattttattattgataacaaaaggattcttatttttttgcgaaaatctaatatcaagcattaaaatcaaccattcaaattttcagcagagtttataatgatacattagtcatattttgagtttttatattttgtgtctttgtagcttctataaaattgttgcaatatgattacttctttaattagtgggttaaattagctgtgagtaaaccaccacttgcgagtcaatgtaatgttaaattgttctcacccacaggattgtaaatattgacatcccagtagccatacagttttgaccattgtgcattcagtgttctaagttttaagagacacattttggtcattacaaattattccagttgctgatgtgtatccatgtcagaattgaagtatgtatatgatgaattactgtattttgattctttggttaagttgaaaaccagtgtatcaaagaaagctatcaaagcttcagtgtcaaggattactcttcagatatactattagtttaagggtcagagttttgaccagtaaatctcatgagaaactgcatttgtattaagttttgtgatgcagacactgctatttcccttccatgagttcactcagatatattattattaaatttgatattggatctcaaatcagagcacaatttaactttataaagggaaagagtttacaagttttcagttgctgaattgaaatttattcagatggtgagtggtaacattaagaagcatgttatattttgcatttcagtcagcttatggagaataagattagcaccattgaaagaggagcattccaggatcttaaagaactagagagactgtaagtattttcaattccaaagttatgacaacataactgtgttttttaaaaatacttaaatttcaagcatcatgtcttcaatttcatgtcttagggtttgaaattttgcagaaaaaggaggatgaatgagtggttttcaggttaatttatgacaaatagagttcctgaataaaaagttctaacttgtaattaagctcaaaaatacagttactttcctgagacatgtatttccttgataatcattgctttggtacttaaagatgtacaagcatttcttattcttcatttgatttgttttatttgctcatgtaggaagaaaggtggtacttttatttgcgttaatggtgcattagggaagagagaagttttgctaattgttattttcattttcatggtggtgctttgtgtgttatcagtgacatttgatgaaatattttatattttactaataaagatttacttttttatatttagcgtggtgaacattgttattgttaataattacttttcagttttattttatttggccctagctttaaaaatatttattctggaaaaataatctaaacattatgaaagtaagaactgtgttatcaaattgtggtcattcaaagttggttttcttcccaagaagattaaatgtagacttcagattttaagatacgttttttacatattacttgaggactttaaaaatgtttacagtatatatctgcaaaagacaaaacctctgtctgaaataattaagataaattacagaccttgtaattgaagtacgaattgtatgtcttacatgccttgattattcaggtttgatatgtttgcattttgaaggcaaagaaaagctctagtaaaagaaacaacaattattttaataagttttcatgcctgccttaatagtcactttaagtaaaaataatttttttcaaaaaataataaaatctaatgttcattttaagcttaacacatattcaggttcactgggcaaaagggcagaagttaattccctgtaattgtccataagtagaaaaatggtttgtccccttccaagatatttataaatatatagactatatttttatcacctcaagtaaaacacagaaatgtctactttattttactattggtctttctctatgttaaatattacaatacaaggactataattgtggaattcaaaataaatttaaaatcactactttcaactaattttagagggaaattaaaattggtaaacatttggttgcattcataacaaagcttataagttcatagcctatctctaaatatataaaaaatactctgaaagtatttattctttgatctccttgatagactatgtgattagctaattcctagtaagtaacttgcaaagatattttaatctttaagaaagcatcaatataattcaaatgtttggtaaaatgaatagataatttaaattatcatttaaactttatgttttcaagaataacttttagtcaccacaggaaagtatcttgagtttagttgttaacttccaaaccattgaaggagttttgatggctttttatgcagtctctattttggttatattgttgttttaaatattttcagggacactagaactaaacaaactttctcattctttttcaagtcacttcagagtgttgtctgaactttcatcttgaataaattaacttttcctaaaacttattaaccagatgctatatgctctgaaatttgattagagttgtaagtaggtactattttttgacttttacttcctctgggaatgtcacttcatctcagaacaattttctattctactaagactaagtcagatgtttcagagtgggaggaggatttgtaattctgaatgaaaactaatatatatgcaggacttctttaaatcaccccagctgttggccaagagcaaatatttcatatttgtgaggaaaagctgagaaaattccttttgtttacaactgccaaatccatctgatggaagcacattgttatctgacagccaattcatttccttggactctggaattcaaaaccatttcttaggaacattgtggatacacttttcaaatatttattttttaaaaatacattaaatggcaaggcaggtttgctaaggaatgcattcaagttattgtgaaacaaactattttaaattttgttcattgtattgatttaaaaaataaaaactacaaaaaccccaaaactacccagagagttccataatcaaactgctatggcctgtggtatatatctttattttagtcagtgtcattaacaccaaaaaattgcttgctttttcaaaagctgcaagagacaatgtgagagacaagaagaaatcaataaattagctttttattatgtattgtgtaaatttatatggtttttaagaatttagttgtgaaatttaaaattggaactcaattatgaaaaaagtataaaattaggtttatgttgtaaatcccatttatatactgaatagtgatttaatttttattccttgtatgaagaacaaaataaaataaaaacattaattttattcttgtgtaatttatggttttaagttattttcattttaaaatgataaaataattctaaattacattttgtgaatatttcatagttatacatttttctttttcttttattttatgttgatggacttttaacttgatctatagaaaaatctgaaaacagaagataaagatctgtaccttttaaaaattcagctttttaatctgcaagaaacagtcatgttgttgatttgaatttaattgtagcatggaatggcaaagtcattatttgcaaatcaaaacattatagctataaaagatagttttccctttcaaagagtggatgaaatacaacattttcagataaactgtcaaggagttaatagtaaaatacctcctcctttctttcctcctcctctccctcacctccttctttttttcttccattttcttttctttcttccttacctctctaactagctccttccctcccctctcctccattctcttacaacatgagataacacatcattgtcagaatgtggttgtgcatcactgtaaaaggaggaagttgtaatcacgtctgcataccacgagcacacattattttctgttttgacagtttgtttctgcactctcagacctaacatgtgcagagtcacatttcctaggatgctctgtattgctagtggtacctgtttatctgggatgaaaatgaagccttcagtatgtgccttatatagactgtattagcaggtctcctgttgtttaatcaaaaaaattttcaaatgaaatgtactctacctagatgaccagttaattcaatggaaattcggataaaaaagtcacaaataagctgcagtaagaatcaggacacttaggaagtatatttcttttatatacctcaaggaagatacctgtgtatatctgcaataaattctccatgcaaaattattaatttgagttttttttggatgctgcataatgtcctagagggttaaaaaaataacactgggacccagcaatgctgtgggcttgtgtaaaattctcttgttcacacactgtttatgggattagatactacagtcattcacttctattttatggtcttttagggggacccagatcatgtcagggttccactagtgaaaacaatcttcttttgaaatttccttgataatacaaatgcaaaagtatgagaaagtttttgaaattttttagggttgttataggatgttttattatttactccaagactgaaaagtgaaatgcatatatgcctaggttatgttggtaagaatcagtagcatactgtgaaaagtcttggatattaggctttgtgtgaacaccgcaaccatcttgtaaccttaaaataagaaaattgtggaaataacaaaggcaggcatgtggagtgttcatcttttcccaccaatacttggtaaatgtgtgcttttaagacaaatattgctttaacttctcctagtgttagtataattgggtttgaaatgacatttttcccactagctttgtcatttgatactcatttatgcttgaaaatgagctctgaaaatattattatgataaagccatgtaaggaatcttgaacagtcaagctgttaacttagacatttaaagtttccagcaagttgatataaagaacatattctttttaaattagaaaagtctaagtccctttacagtggagcctacatttgactaaacactacattctaatgagatggtatgtaaaagacaaatttattttttttaaggtgatgctgaattagttctccctgcatacacatatcactcctaagcatgggacagacagtgtgagtgaggctgaggaagtatgatgttggtagggtttttgttgtaggtctttacacatgagttcaagtagagaatatgttgtggaacaggtctgaaagaaagcatcatttatcctgtgttcatcaaggatctggatatattctctgtttatcaaggattagtctcttctgactaatccgacaagtttataggcaacacataacacataccttttcttaacagaatgacagtctaacggtgctaatcttcttggaaaagaattcaagcccatctcaaaagaattgttttctggtatctttccacacaagtttaaaatcatggcagtcattttcttggaaagtctctttaaaggacacatcaaactctaacagaggctgagtatgcacatagcataaaatataagtgttccaaaagatataatagccattatatgccaatgatgttcacctattcgtaagcaatgtggtcaattttaaattaggtttactgacgctggtcatagaaagctttaatccctgtgcgctgttacaagtttagcagaacattgaatccatctgagagaatttctcatgcaacagtttttatgggccttgaagtttaatggtggtgagaaggcccgtttgctctttgtcgaccattttataaattctgaagcagtgagggtgtttatttttcccacatctgttttgggtcctcttttgtgacagtgtttgctggatgccgtgtcctttatacctcccctgaaatgagtagtttagtttgcactgttacaatgtatttgtggaagcagccagtgtcaaatattttacatttaattccctctctcatttcttttggatacctttctgcttgaattgtgtcttctagactgaatttcacaacttgacatggaaagagagacatttctgcatggacttcatatatattgccattatgttttttcaaaccaagtgttatctgctggactggaaagcatattgatgaaaatgctttcagaacgaaagcttgataatagggctgtgatttgatctcatcaatattgctttacgataatatttacagaaaattatttgtgtgtcctctctgcaatgtccatacactctgaatacagatggacagttctggagcattggctctttgctgcagtttgaggttctagagtaaaagcacagagtgtggattatctagaaatccctgttcttcgacatcttattttatctactgatgcttggtgtctcatggaataccaggcaaatacacatcaattgtactgttgattgtggtttctaaccagatacaagctcccctttctccttttaaaatcagaaacgctagaaaagagtgatatcagaaaatctttggttttaattccactgagggatcttgatcaccttgcttcatctttcaaaacttcaatttcctcatctttaaaacagggataatcattatatctcatagtggcaataagtaagataatgtgcatagcttcacaaaatgctgggcacacagcacttaaataactattattctgcatttcaacatacctctcatatttctcaatagctgagtttaggaattattttatcttagctgctaaagtgtatatatgatccatttgactttttacgaccatatttacatttttaaaaaatgttcttcctaacgtagtatatggtcaactgaagagatgtgaagaaaagcttaacaacccttcaatggttatttcagagtgtttctcatagtctctctgagtctatagagaaataccgggaagtaaggggataaaagagggagcaatattttgctaataagtattgacatccctagcaaggaatacaagggattaagttatcattgatatcactgctgaagatgtaaactttattttatttacataatacaaaataaattttaaaatctgtgctttaaaagtgttaaaataaaaacatttttataagagaagtcaaaatttacctgagaaggtggcaaaagaggaggctaaatagttttatgcttgatcattcatgtaggagaaataggaggttagaaatggtaggctttgaggcagcatttatcaaacatttattacagacctagcacgctgctaaaaacaccttatatttacatgtaaatatgacatgtaaatatggagcacaaaattttactggctttggtaaaactgttttcatattacgttttgaattagatggaaggttgtgaacattaattgaattgaggtgaaagtcgcaaaaagtaagagactatgacctctgctaaaggacaagagtcatagacacagctggcagataataattcaaaacaatgtttgtcaatacgttcaggctgcccttcaaattgaggttgttaagaatcagtgtttcagaggccagtggtgttttgtgcaatgcagaaagatcattctctcttctgaaagtcaaactcaaaaatagctggtagcacagagcaaacagttactggaatcctttctcatctttgccctgggagaaagtatctcagagacatacattacacacctttctgaaactgtgaattgccatctagagaattatcaagcatttctgggatgttgtgggcagattccattgaggggtgatgacacatgacttatatatcactatatctctgtcattcctttgataccattgagtgtctgtgctctcaacaatgataattgactcacctggtctgtttaacaaagctaatttatgttggctcccataaataatcctctgtgatatctttaattcactacatgctgtttcctgttctggaaccatcagatttaacttcaactcatttacgttagagatcttattctgacacgatcatcttcaagctgttaagcaaatttctgtcacaattagaagctaggctactttttctctagctctgtttagtaattgttatataccttaatagtctttaaaataagtttaaattttaaataaatgctctttattttaaggatttaatttctggtgattgcacaggcggctatcctttaaaatttttctttaatattttgaaagttttgctttttctgttaatgtttgtataaccatttaaccttagtatggatggaagagagaatagaaaaagtggagccaaatgtgtattgatactgctttaaagacaataaaagggaaacgtatactgttttgttgtatccatattaccacattacttacgttatctgtcctttttgtgcaataccaccttgtcttatcctaaaaacagaaacgtatctggtgggtttagacatataaagatcactcataataactttcatgaaataattataaagtactgcaattcagagaagaattcttcgtatatattttcagttttttttttctgaaatttaaaatacctagttttcaacaggtgtttaaaaccatgagctgaacgtagagctagcttttttaaaaaataaaactttgttgtatttacaattgcttagttcatagatatttaagaaatggatcaaataaatctatgttttgcctcagggaatacaggtgaaaaggaaagcttccgcattatattattctgaattattgtttaggaatgtttagactatattttttccagaggagtgattcagagggtatgttttagtgtcataccacctttattcaggccctagctttatgtctttgaactctgcacttctctccagaacagcagtgagaattgtacttactcatggggatgtggtgaggagtgaatgagataacttgtataaacctctcaatagtgaccatcacctagtaagcttattacttacacagtgaattagaacacatgttagctattagttacacagtgaattaggaaccactgggaataagaaagggataataattaagaaaaaaaaaaaccacttcttgtatccagtctgaaaaatctgctttctcacaatatatgaaactatactgatgtagactcgttaacaagaaagctggtagcagctgttactcacttatatctctgaatttgtttaaacacattgaattctttccagcttctaggtgatgccgagaatcacatcatcaaggatgttgatggaatggaaaggaggaaactattgtctggggcatgtgaaagcaggtttgacagccagagaatggcatcaaacccaaggcaggtgcctcagggaggatgccagaggaatgttggcttaatataaaatgtaaatgctagggccttgctgaaatatatcaaaatactaagagaacaatctgttctcattcagcatttcctaagaacctactaagggccagagattagggaatgttgactgagagcaggctgctctctttggcttttcatatggttcagaacttactaagtgccagggaagaagggagggaatacaaagatttagtctttatgcttgaagagctcacagtctagtgggaaagagaccagtacatgaataaatattacacagtgtaagggactcttgcttatcaaatgctgtggggacacagccaagagaagcactaactttttgtaggagaatcaggggaaggttcacagaggatgtaagaaagcaccatttggagaaaaggagaagcacttcataaagagaactgcctctgcagggcccaggggcttgccgagaatgcttgctctggctagagaataacaaatgaggctggtaaatctcgtggtttggattacatcatgagagctcatttctgatgttttagaaattggaattggctctttggacaatggaggtccttccaagagtggttgcattcctagaaaaaaatctcattaccactgttgcaaatatgtgtaatatatttttagagggaaatacaacaaagtaacaatctgcatttcattgaaattgtataatgctagactctggaagtacactgtcttcagaatcatacctaacagagaacaaataaatgaaagcttttgatttgactttaaattttaccttgttatgtgcttcatttaaaaaattagcgtgtaagtgggaagtaaattcactcctttaccactaattttactatttgcctctacttgtcttggcatacttttttttattagtatgcattttattaaggcctgagaatgtttctgtagatgatcaacttctttctgagttcacataaagttatggtgccatcattgcttcatggcattttttagaatggaaagaagttctgaagtttacctggtctcgcttctcacttacaggattttaaaaaattatatcattttccaaaaaaaattcatagcctctgcttgaatacattttgagataagcagttgagagtttccatttcttaatagctaattcttagaaaggtcttctgtataatcaaatttcttaggagttacaatcaaggggcccatttctgccctctggagactaaataagtataattctgcatctacccgatgacccttgcaatatgtcaagattgatatgccctcttttcctgtcccttttactatttatctttaaaacttaagaaatacctctggtttcctcagtgtgacattaccttctggaactatatccagaaactatactatataatatgcctctactcctctcgagctaggcagcttgtaagtcatttgagtgcaaaatgttacatcagctctttatcgttttatttagatttgggaaaagcagagaaatagacagttattttaaattaaatgttaaattgtacactgaaaacagatgggattgggatatgactacatcacagatagtatttacccactctttctttaataggtgtgcataccaagcatcagggcttaaattgagttacagttgcaatcacactcttttctaaaacatttaaaacattccaatttacttagacattttaaaacattactgaaactgatttgacacaactgttagttataatgctgagccttaaattcagttaagggttggaagctgtgggttgaggtttgaactctgggttggtattctcctgattttgcctatgggacaaatcatgctgacaatttctcacaccttttttttttttcctcccaactaaatgaaaagctaagaaagttgaaatttccatctccccacaattccttggctgaacttttaggccaattgggactgtgtatggattattttagacaccattcactgtggtatttctgctggatattgaagtcacctaccttaggcgcctaagactgaatcacaaaaatcctttatcattgtgtgtattctggttgactgatgttgcacaggatttcagtttaaagtttagaccccagtaatcatcatcttagtaagcacaatggaaaactgctgtaaagagtcatgtaacaaaaggtgtaaccaacttttgatttgcaatgcttgaattctcctgaatgtcatttcattcttttctgaaatacaggatgaggcatgacactaccaaatcacagtctcattgttgggtattttctatgtaacataagctttgtttttgttttctcaaaaggcgtttaaacagaaatcaccttcagctgtttcctgagttgctgtttcttgggactgcgaagctatacaggctgtaagtagacacaaatagttattgttgctttgggtagtaccttgtgttttattaaatgtattttggatctgtttgtgtgtgctttcctggaatctgttcatcaatagattaatggattaaaagtttgtgttttttctttaggaaatttatgatttgttttctagtggttccagttgttttatttggttaggatttagcggtttatgtatgtgttatggaaattggattattattatttttttggtaacgtgatgatggcgagatttacctaccttttaatggaaatgtttgattaagttctgaagggagaaaattgctactgtttcctcttaagaggaagttggcagtgtgttcttataaagttgagatttttaatgtcagcttttttggtattgtttctgggctcaagtagtcgtgtttattagtccgaaatattattataaggtatttaaagagggctgtaaatttcctcttaaatgtttcctttaaagccacaatttcagcctctgcaatatgaatgactgtatggcaaggttttcatatcaaatacgtcatagactattaaaggaagtaattccttaaaggagcataatgtgagtattagggggaatcactttttcctccctggaatgcttttgcactgacctaatgtgtaatagtgaaaacacattttgaaagcatttaaaatgagattttcagccatatgaaatgactttgtgcagatgggagataagctacaaagttttggaaaaataaatagcaatgattattgaggtatatgcatgttgtgaaaaaaactgctggaatgtatagagtaaattgctccattagcccccacctggatggtgggtgtcccatatggtactgtttgtagagaaagtgagcatagttcctttttctgaacttgtctttgtagcctactagttcaatgtggttatcaattccagaagtaggaggactgtcctctcacacccttcacccccaagaatagccaggatctttgttacatcctcctgaaaccttaacaaccttaacttactatagggagatattccccagctgacataccagatctctccagagtctttcctgactttgttcctctaaggatagctaaaatcacctgacatttttctcttcttttttgtgttccctgctgctcaattggaccaatttaagtaaattttaaaaataaaatgaagaaaccttggaattgcatttttaacaaaaattatctaataactatttttacttaggaaatagggtgtaggtttgctataaagattataggtatgcatatcagtagataattatatctaaatatttgtgcttagtttctaaaaagggccatagaattggttttgatagtatttcactttcacctttagttattggtgactgaggagatttttaaggaatcgacttggattaatttcccccagtttaaggtggtataatccattgcagaatccctcatcagcaaattatattctccttgacattttgccatctttgacaatatctcatagcagaccaagagattttcttttatgttttgttatgattttataactgtatgcagctgctgtatgaaaaaagacttgaaatctttaagtgaattaaagaaacagaatccataaaacctatgacagcatttcctaattaattaaatgcgtgttggaaaatggggaaacaggcagctagaaaatgtgttcagatttttttatgtgtctttctggctcaaaggatttgtcctggggagtaataacagctaaagcagtgtttgttaggtggagctagttacaagagggatgtgaatatttttatgtttcaggagttatataacttgatggcctagcactcaatattgacaaagtgtatccctttacatgagatttgacatcagatttaggcactggatgtacatagaaaactagaggtggaatttttatttgcatcctcacgtcaggaatcttaatttgagttaaggaactgttgcttcatctgaattagacttaggtgaattgttgagtgctttttctctcgagagaataagttataagctgcatgtgaccacttgtttatgatggtgataattaattaaattaaacaactgccattggaagtctttaataaacaaaggaacacgtgcttgtgaagctcactactggctagtgtaattatgaaaagcaagggtacaagttcacattttctcacatgatacagatgccaagtagctcacctgaaacaaatattctagcagatgggaaaatgtgcacaaacctatatgcacaacatcctttataatgctcatttaaaaacatatttttttcacaagaagaacaagtgacagaacaaaggatatggaatttttgacaaataatggggaaaaatgataggacaaggaaagtatttgatagttgatatatatatgatcgttttataaatatgtgtaaaacaatatataagtattctataaatatatatttatagaatatatgttttgacatttatataatatataattattatacatagtatatatttatatgtaatataatatataattaatttatatataatatttatatataatttatatttatatattatatatatatatatagcaagccatagttgcccctactgtctaatgcagtagaggcatactatatgcagaactcataaaaaaacaaatttaggatttacttcctctgtataggttgttccgagatacgaattaatgtttcaatttcttttcttagttattgtatactttattcatacttaacactatgttttcccaggtatatcactaataaaaaagtttactggtttaatacatagtttatacactgaagtttgatttttcgcattgtttgcttagattaaagctagttggatatactggacattgtgttgcttttctttgagctttggaataaataatcgccctttgactagtggttgaaaataagatgccaggggaagaagcacacatgcttttcatggactctaaatgcaatataaaagaaaaggagggtatactgtatatgaattatgattcgacacacttggttgctgctagcggccaaatatgcttttcctttgctgtctgctccaatttctctttggacgggttgagagagcactacatgttcaggtcaagatgtttgctcagaaatagtagtacagttgcagctgtgtttgttggagtaggagactagtttaaatagcattaccatttatccagtccattaacagaactctgtaaaataataccaactctgcataaactacaggacagtgtaataaaattacaagcacttgttgacagatggaaagtgcaagtccagggaaactaaaataagggacgataggttggaggttaaaaaaaaaaaaaataagccagcatgaagttttcttaacttatagactctatcttcccctttgctcctcctccaaaatcaaggttgcatttttattatgaacctaagagtagaggaaattatttttaaagaaatctggagctggttaactgaagaagagattgcagggaattttgaaacagttgattatgattgattgaaatttatgagtactaatacaaatcttcctgataagtgtaaccttaaaagaggcttaagagtaagtgattcacactttttgatgagtttgcgactactaatctggactcattaaagaggaatttcattggtagtactgcggttaggcatttggttataaatatttgttttgtggttttcggtttatttctttgagtatattatatttactgagacttctaacgtaagcttaagtatccaaagcactttttagaaactcatttttcacttttatctgccaaaccaaaccaaaactaaacaaacaaacaaaaagaactgcatctgtcccagggactcattttctctacttctttgaatgaaaactttttacttctggttctcaagtgccattcatgattccccagtgagttttggagcgactaaattatctaacattaggaatggtatttttaaggccaaagactctctttatggcctagtgaatacttacctgagacaaataggttttgactgcttaatttcattggccaggtcataattcattatctctcagataggatttcagattctcaaaattgcttttgataactataataattgggactttcttaagaggaaaacttaattttttttattaaggtaatcaattaatttgttcagcataacaaatatatataattaagctgtctttattttcctttccatcactgccatagaaggagacttatttttttttaatagttataagagtaacacatgctcattgtaaaaaagatctaggaaattcagaaaaaaatagaaaataggaagtaaaaattatctattatctcactacgcagatatagccattattatacttatcaattattatcttagaattatttttatgattatacatataagtgctacttagacgtgtattatgaaaacttttttttaatgtccccagggtctagtataaggcttgacctttagaagctctcatcaagtgtttgatgtattgaattaaatctctgttgggttcagggtttgtaacttgaatgagcaaatagtaactctgggacggcattataaataatggagaaccaaattaaatttaaaggataacttggtcaattaaatgtttgattcccctaggtttctcaaacattgaagtgtttcagtagacataacacaatcaaaatgatccatttttcacctaagcaaaatataccttaatttaataaaatgttttataaaacgaactccctagttcttggatgtcagtttagtctcataggtttcttggagtcaaccatgaaagcaggatacaacagaggagcccatgtacaaatttctcttgaattaatttctgccagctctgattaaagtgtggactactagagatgtcaggtgccatcgtttcctgcttcattttactcttggcctgtttggcccctgccacaataaatccgactgtgattgtgcaggaattgcaggttacagttgctacggttactgttgttcagccagaccgacatcattactcatctagcgcgctgccatgatagctaccgctgatttctgttgctgagactgccaaagagcttcatgtgctaagggtgaaagttccgtcgaaggtggcgtctgtgttctaatttggtgtaaggaaacactatctgaattatatactgatactttgctaaggggaacagattgactctgtatcgagagagaaaacttagaaaagtgttcactttcagtgattaaaacaccaagtccttcattactaaggtaactttttaattacttattgggcccaagggactatgtttttgccacttaaaaaatagaggcatacaaggagtattgcatttaaaaaaattaccactatttaaccaaaactttattttcaaatagataggcaacagacttgatatatggacatctgaacacaactcaaaatagccattaccacttgtcatgaaagaaagaaaagtgcaaagccctgagcaggacctacttctacttttattttttaaatcaacgtgtaatcctgtgatttaaacgtcctaaatccaatgaagattaagatcatatttgagattttgccagatctagtgttgatggtttttacttcaaaggaattactaatagacttgttgctaaagaaagctaacagttgtccggtttctgctgttaccaacacacagagtggaccttctgagtgtgaaatccacagcatagctcatagcataagaaaatcaaatgcaagaatgcaagaaagtttctgtgtttttttttttttcactcagctgtacttatttaaacgactgctttcacaagtgcaaatgtttctaactccaccaacaagtacttatggactgccaacttgaatttgtagaatactatgatcaatgctcagaagggaaactaacaaaatatgtggctctatataatatgtggtatttgtgggcctcagctgttgctaacgtctgacctatactgcgtgaattaatgcctagagagttcattgagagtgatcaaatatgtgaatttcagtctatcatattcatgtaaaaaatatatcgtatacacataatcaggtaatattttaaagtttttaaataatgaaattgccactacaatctcaaggttacaattttggggactgaaatttacataaacattatttctaggaataagggttggtagggttttagttatatttaggtaattttaatgtatttgctttatgttttaagacactgaaatcaatttactttctatcttaagggaggttgtgtaaaatgatagtgtttaaatgcctactcagatacttgcagttctgttaactttggaagtcagtagacaaccgtattgttgaggtttcttatctgtaaaatgggaaggatcatacaatttactttctggggatagcacagtaaaatttagattccatattcaaaggaacattgtaaattttcaagtatgatagaaactataattatattattgtcatcctttcattgcaagcaagatggaaatgatagtcactcagatgtccttgcaacttgccctcagtcagcaaagttcctgatactattgcacagccctcttgcatttatccttactgtagtaacacgtaaatatgtgtagtcacattaattatcttaccacagcaaattgacataaaatgtgcatttgtaccatgttatttctctttacttggctgcagaaggtacattagggccaggatattcttaatgagatctcttcatgctctcccagttgatgattcatatagttttaaaattcatctataaaataaattacagatagaaacaaaaagactgtgactcaggaactatttgttagtgcatatatttagattgctgttttaatgatgtgtttttctgaatgacaaatgaaggaaaaatacaaatgttagaaaatgctgagtaaactccttaaactataggtaaagtattctgaaagttgttcagaagatttacatatgttgctaaggaacactttcactactaataaaaattttattttttaaaataatataagattactctgttagctttgtaatatgtacatatgatttgatctatggaacattgtcatctttatataaattgcataggtgattttaagtgtatttttagactactaattatgtcaaaatccagtaaaaattgcaaatcttttagcactttaaatctaaataatgttacattatgagacaagtttgaaccagaagtcgttttgttttgttcttttttccacaattccagtacttctcaaagtagcatagatctatatggtgtatatccactcattacatgttacctataactgagttgattataatcactgaattttttctggagggttaaccttaaaatattttataaattttgatataagaaacctttggatggaagttttaaaagaaactaaatcttagagaaggaagcagtgaagagtaaaaagaccagtccttgacaacacctatggcctagggtacagcatagaggtgtgaaatgttattaagagaacatctgtgtctcttgaaacatcccccaaatgaaagtttatagcaaagtatggcaacttgatttaagtgttaaaaacaaaacaaacaaacaaacaaaaacttaaaagagaaataagtaaatctggaaacagaattggaaaaaatagctttgccccatcatgataggtttcttctgctagtgaaagattaaagctcgaagtatgtgaatagctgagaacagcacagagaaaggttgattgcttcccctccgacagttccaattgattgaaaaaagcctaatttaaagttctgtttgttctatgtcttaaaccatcagaattctcttttgggacctgaggaatgctctggaggaaaaagaatccaaggataaaaagtcattgcaagccaacaattgttcctaatcctcacaaaatgctggagaaattaaatttattctttattgctcaaagtgttacctaggtcactgggcgatgggaaaattggactggaagtcgagtaggcgcaagctttgttttgtgtctagatgcttaaccttagacacgacaaggcatcttagagtgttgtgggaacttggttcagagcattaacaccaagacttttattaccccggatttataataggctgtgctgtcaggagatgaaaatgttgtgtttacatttcagtgttaaatgatcatttaattaacacctaaggggaaaaaaaacttgtgaaattcttagcagcttttattgttggtttcctgggaggttttaatatccaagtttcattgagaatttttttgtaagtaaagacacaaaagacattataaactttttaaggaagacaaacagtttaaccttgaccctttaaaaaaatattaatttaaattaaattttaaatctggtgttcttctcataagtttctagactaatatattaaaatacattttgattggacactacttttgtgtaaacagtatataaatatgattgaatttacattatacattttctagggtaaaacatttgaaattactgattagtttatcttaagaagtttaaaatgtttagaacactgacttaaacattttgcatctgttaaactaccactgtagttacattgtttagaatctgcctcaatgtaggtattcatatgcaagcatattctattggtaagttatgtcattattctattatttttaatcattaatttggatatagctacatcatgatgaaagattttcatcatgatgtagctatatccaaattaatatatatatatatacacacacaaacacaatagggaagaataatgccattaatatgaaaactcagattcacttaattagaaataactaaaagattagacgtcataaaatgcttttatttactcttgctcttttatgagacagttaaccaaaaaggaatggtcttgaggcagagtgataacatttggaagatgtaatgtgtactgtcaagagtagctgcatagttagtaacactttaagggtacctctctaaaactatctttaaagtttacatcttttttattcccattttatctgaatatgaagctttatgttcaaatatatgaaacttaaaaaaaatttaccagtttacatgctgttaaagtaaaatctttcttaatttttccagaaatgaacatgtcattatgatgtagtctttttctaaatacactgtttatgttcacactgaaacagaaatgcttatctgtttttttttttgttgttgttgtttaaattcaaatgcctcaggataaaacccactctctgtcttattcatgataaagaagtgcatggaaaatggaatgttgttaaaatctctcaataaaaagccctgcttttaactaaggattataccctcacttacaaaacactactgagcaattatgtaggcactttttatgatgttatatgctctacttacttctatcaagtttcaacctttctgcaaactttcctcattttttttaacacactttgatctttttcttcccaaagcgacttttctacccagcctcttgtcacaaaaacccagaaataggaatatcgctttaaacattttatcttctttacgtaaggaccaaccttctggttgagttagttgcaagacaaaacaaacaaaaacaaaaacaaaaaaaacacaaaacattgtccagaagtataaaagagtgaaagacaagagaaagagaggagtaacaaaacctggttatttaatataatagccagggtattctaaatggtatagtttgtcataccaactgatattccaagccaattgggtgatgccagtggtggggggcggtggggggagggcgtgtggagggggaagcgagaggtgggcatactgagtgcttaagaaacgtacagaagaagaataagtatttagggaaattataggaaattccatttaacatagatacatgtatttcttttatactaaggaagtcaatgctgtgcttttatacggagaaagtcagtgttaaaatttcatacattccttttttgaaatctctgctcagaaactaaaaagaaatatttcagtatttattttagataaactctccaggcttgcctcttaaaaaaaataggaataacttctaaatacaatctgtgctaacaaatatatttgacagttactctaagtcatttcatgtattgaggttgggaaataaaatatcgagaaatactctgtattgtacttggcagtgattagttaaaattaacctcccatttatatcacactctttcacttggctttgatgacccaccataatgtagttctgcattacctcttcaacgttatcatgctatcatagcagatctaccgtatctcaagcaagcagattttcccattgctgcctggaaattcccagcattatttctggacttctttctttcctccttcctcctcatatgggcctcagctcctctactaaagctttctcaatggttttagttacctccacatgatcattcattataatatggtacagactattgattctatggtacattataatgtggtacagatggttgattcagaccacctgggtttgagtcactgaatgtgtcatcttgggaatatcactcaattacctgccaagcgcctcagtttttccttgtgtaaaatgaggatactaggagtatgtttcttatggaagtgatgtgtggagtaaattatttcctaaatgaactgagcttactatggtacttggcatataataagtggcatgtacttactttttttgcttccttttatcattaaaactgtatcactgtttcctgtcccatataatgggttgtcacatataattctttaatcgtaacctgtgtattaactttgccaagattcctgtcttatatttgtccttgtttcatatgtagcatccagcctagtacaggtcggctaataaatatctttttgatgaaatagttggaaattaagcctgagaaagacactaccaatagattgaatttgggatgatatatgttgaggtgtgaaaaaagcactggatcagaagccaaaaggcttttacagctgggcatggtggctcatgcctgtaatcccagcactttgggaggcggaggtgggcggatcacgaggtcaggagatccagaccatcctggctaacacagtgaaaccctgtctctactaaaaatacaaaaaattagctgggcgtggtggcgggcgcctgtagtcccagctacttgggaggctgaggcaggagaatggcgtgaacctgggaggcggaggttgcagtgagccgagaccgcatcactgcactccagcctgggtgacagagcgagactctgtctcaaaaaaaaaaaaaaaaaaagaacaacaacaaaaaaaaaccaaaaagctttcactagttacattcctagctctgctgatcactagctgcagttgctgagcaaagatactggcttttttttgaggatcagtttctgtgtttatatatgagtatgtagtaagtcagataagagagggaccttgcccaatgtgttcaccatcctattaccagaatttagcagaaggcctccaagcctctagggaatgtgtgaagataattgagggaaaggaaggagatcaaaatacatctaagatgtgttctctctgtttttcaaaaatttacagggaactctacacaggccctggaataattacagtggtggagttattcatggtaataaatcaggaattagataattaggttgtggataagtgatttgagattattctctctattattagcttacattttgaatggctttgctattaaatgtgaattgtttgaaggcttatattaaaaaaatgttttttttttttttttgagacggagtttttctcttgttgcccaggttggagtgcaatggcgtgatctcagctcactgcaacctccgcctcctgggttcaagcgattctcctacctaaacttcctgagtagttgggattacaggcatgcgccaccacgcccggctgatttttgtgtttttagtagagatggggtttctccatgttggtcaggctggcgtcaaacttcacacctcaggtgatccgcccgcctcggcctcccaaagtgctgggattacaggcgtgagccactgcacccagctggttaaaaaaatgattaaaggagatttgatgcttatgccttattaagtggtgatcttgatacttgataatctctcaatatgaggtaagtggtgtacaactgaggtagttttaataatcacctgtctctcaaacatcgctagtggtagcatgaagaaataagttaaaaattaaacagggcaaatcaagataatataatggatttggttaataaaggtttatatgttcatatttgcgttataattttttttgtaataggttggaagcagggaccatcattttctgtaattctccctaggaaatgcattgtgcacccgggacaattcattttcctgactttttgaggagaacagaatgtgtggaacctgaataccctgaaggcaaaggaatctggagtctgtttctaagaggagagcttctctctgacttggtgtgggttttctttccctctgttgaaggggaatgaattccacacctaatgaatagtttcaaggaaagttgttaatcaggtactccaagtgaccaccctggattcttcttttattacacaggaacgtgagggaatgagaaagcagcatagttacatttgataaaaggaaatactctttctcctctcccctcccaccacaccatcccttggaatttagttgatgtgggaaattactgcagcaaataatgtgtttgaaaaagcaaagttgtatgaatgagaataacgcttgtagctacaataattatgttaaaaattcacaaggtatatccatcatcatatttcagagcaagagttttcgtctaacgaggttggaaaagaatttttccttagttcttgtcaatctcccagggaagcatggcatgcaggaataactgttgttaccaacattatattttgtgcttttctgattcatcagaacctttctgttgccgtaaaatgggaaacttcatcaaaatcagatgaagaacttcaagtaaatgtgacagaggggtaataatgaactataaatataattgatttttattcagatggacaaatgttattctttaatcctttcccatttagaagccatactctaatttaaaaagagaaaagtggtctctaatttaaaaagagaaaagtggtttaaaacaacaacattacagtccagatatttctctgtcttctaaattaagccacctgggttgaagaacactattcaagtgtgggtaaacatgttttgataaaaagttttgttatttccaaataactattatacccccaatcataagtgtgatatctattaccagatactcatttgggttgttttttaaaaataatatgattcagttttaggtttttaaaagtatagttcttatcttcaattctcaagaatatgtaataccttttatttattactatactaattttatattatatttcaaagaagtgatacctccagtgtgcactccagtggttcaagagaaaagtgttctgtggtcaaatgtgttgggaaataatgaaagtcatatcacctgtggtggctacagtgtacacttgtgtgttaatcttaaaggcatactacaataaataaatctgtttaaccttttaaaatttgtttttcaaagttatttaactatagaggcctctcttctttcttaactattcctgtttgttcttgttaatccagagagcaaaaccagtttttagcttttccaatgaatagttactttttattacttctgattgagattttattaaagaccatttaggacatatagggttgacatatattattttttttgtgccagcgttgtcacgtgtaagacttttaatagtgcattggcttataaatctgttcttttcaatccatctttgaaggtgaactcggcattctgttgtagccttgagaaatagaagaacttagaatattttctaacaatttcattaacttagcaccactatttgctttaggtatttgtttatatgtgtgtgttgcctgtgtgcctgtgtgcgcgcgcgcacacacacacacacacacacacaaagtcattcaactactattttaaggactttaacattttatagcttaactgtctctctcttccctgcctcagccaattgaagcaccagaagtcctttgtggaacacctgctgtgcacagcattctttagcaacacaatgaggggtgcatcatctaagctggtgtgaacttgcaggagtctttctcactctatagagagggtgttggagccaaaagcttttattttatgtacaatttggagatgattggtggactttgaagtcattgcaaaactaatttgttcagtatttttgccaagaccaatctttccagtattagaagacaaaataacttagatatgagggtttagacacaggaaaaaaaacaaatggaagaaatgattataaatctccaaaggcaacttttaaaaatacacctgaatgatgcttctcaccaggacacttaatattaatcattactgaaaattaccatctcatctcttagttcccccagtaagttgctttggggtcaccaatttttatttattgttaatattgagagaaaagacacaaatgaaaacagaatcataaaattagagtatgactcagtcaaaactatttcaaagcttgatattaaataaacaatataaataatttacttcaaattatacccaatatttgcacacacatttaatcttcagcttttactgtgcctaaagatctattcttaatcagttttggctccctcttcttaaagaagcagaatacccaaaccctcccattccccttccctgatctattcttctcctttggtttccataccatgtatatatcgcagtgtgtattttgcttatgttgtctttcaattccaattaatgtggaagcgttgtgaacatagacagtaacagtagatgtacaagaaatacaggttgagtgagtgaatgagggccttccaacaacctgccagaattggaatcctagctccagtgtttactaggtgggcaacttgctgccattcagagaatgccaccaccctgcctggagaatggggcccctttccttgtgttgctgtgcagtaccaaatgatggacaccttcccatatgcagatgttttcacttactttttaacataatgaatccacaaacctctagcctggggacttaaaaatgtgctgctttagttaactctagtgtattatagaaactgctaattcttatattgtcattattagcttactaaccaaatcccttccataggttatacattctgtgagggtttggacatacatatgcctctcccttcaccacagagcagtattcacatgcactgagtgctcaaatattcataggttgaaggaaaagggtagggagaacaaaggaaccatggaatcatccttcatggtaaataagcgaaagacagcatgtgaagcatcatctttttaatatctttgcgtatgttctttcttgatagtgtttgagtttaaaaagaatagccatcagtacacttgttcagtcaatatatctaagcacttatgcataggtgactttttgtaccaatgctttgactgtaatatattaattctgtttacaaaatcctgaagaaagggctgtcctacaacactttttatattatttgtcagttctctcccaatgtttttacccatttatgtgtgtgagagattttgttttgcttaatttgcaaataaaacaatattactacaaaattactacaaagttgaaattgctaatgtagtaggaaacaaatgaggcagatggtttagtctcatcattttgtgtctttacataggtttctaagggatagcttacatcatttagtgtgcttccaccattctttgccattctagggcatgtacttctgacatttttattaggcttttgtgtttggtcactgtattacatccagcaatttattcctttccacttaaattgtcttccctgtacaaggggtggagaagaattcagtgtctgcacataaaaggccattatcttatcttagcaactccagccatacactcctctgtgaatcatgacagctcagctgggaaatgcagaactgtatcataagagggcgagatcatgggagtgagacaatgatgaggcctatgacattggaaggtggtgagttcatcatctgcaacaaagattaacaaccctttgctgagcctgacctgataggccatttagtggaaagaccaaagcttgcatccaggaagtgtgctctgcctatgatcttgatttacctgtagcttgtaaagactactcaggtgatctcattgttatttttcttgccccaaatcagaacacctcctttatcagaaaactgagataagcacactgacactgatacttcatatgtattgcagcaggcaggctgtagggcaaatacatagaaacttttgcactttactcttttatttttattttttctgagacgatgtcttgctctgttatgcagggagtgcagtggtgtgatctcagctcactgcaacctatgcctcctgattcaagtgatcctccctcctaaacctcccaagtaattggaactacaggcacacatcaccacgcccagctaatttttgtatttcttgtaaagatggtgtttcaccatattgcccaggcaggtctcaaactcctgggctcaagcaatctacctgcttcaacctcccaaagtgctgggattacaagcatgagccaccatgcccaacctgcgttactcctaatacagtcttcattctacaaagagaactattttctgactggaggaagtggtgatgctgaggatggagtcagttgtgtagctctcataaaatgagaacatgatccagaggctcttccaagtgccttatttatattaatagtgcttcattcgtttttcaataatatggaggaggaccaaattacggatgagaaaactgacacccaaagagatgatgtaatgcccacatggcaggctagcatttgaatacagtgcagtgttctttaccatgtatattaactgttctggggataagagggtcttttaattaaataaaaacactatacaatgtgtaatcctcatggtaatctcttttaaatcctcacctcactttatgcatcgttaattgtgcataggtgcttacagggagcttgttatcctctctcccccaccctcatcccatcattttccaaacttgaagtttaatgtcactcttggctccttttcccttccttagctccactttcaacttctgtcagttctacctccacagttggttcatccgtcttctcctttccctctcagtaatttgcttcctaactgtacttcctgctcctgtatttctttatctatacagtcctctgcctaatggccagaagtatcctcctaaagtacagctaggaggccaggtgcagtgactcatgcccgtaatcccagcactttgggaggccgaggtggatgaacacctgaagtcaggagttcgagaccagcctgaccaacatggtgaaactctgtctctactaaaaatacaaaaaattagatgggcgtggtagcgtgtgcctgcagtcccagctactcgggaggctgaggtgggagaatcgcttgaacctgggaggcaaaggttgcagtgagctgagatcgtgccattgcactccagcatgggcaacagagcaagacttcatctctaagtaaataaatatagctaagatcacgtcccttgcccaaagatcattttgtatacaggcacagcagtttagatttaataaaacatttttccacgcattacactcaaaggtactctgataaatatgtatcaccatctcagttttatagatgaaataactgaagcctaaagtggttatcccacttactagcccacctttctagggctagtaaataataaaaccattattttcctgtaaacttacccagctgctgttgtctaaactcctacactggccttcaagttgtctaagtggtctcaagctattgttcttatttcctggtgttttctcactgtaccatggacttcaggagtgactcaaggaagctagctactcttgagcctatggacatgcctctgatatttcttctgccttcttcaccagtaaacgtgtattcactgcccaagaactagatcccgctttctctgctctactgacctacctgattgaacccaagaagctgtgaccccatttatgaaatcaatgccacaggcaagcaatgcgccccattaggaagcctctcacagtggagagtctagcagagaatatctctcttccctggagtgtttcttcctgctccttcactgcctgacaacacctcccatccccttttttgttaacaggatgtcttatacatctcaaaggaatgttctaacagggttcatatttatttatctcattatcaccttaggtcttggtccttagttggaacttttttgttgatggaaagactgtacctgataaactcaaatgtgtttttctcctgtgaggcttgtttggagggtttaatctgagcctattcactcttcagttgtgcctagaagcatctctccattgtctccatagttttatgtaaaaatgatcatatagtgagtatatccctatctctctccttctagaattcaagctactggtggcaaattctaagtatttttcatctttatgcttcccacagcacttaatatagggctaataagcacataggagaggctggataaatacttgctaaataaattcaataaggtcttttcttaaaaacaattttctttaaaaaaaaagctatgtattgatgtttaagttttataaagacttctcattcttttcctccaagtcaaatttcttttattgaaacagaaaacttgcttttgaaatgaaacaaaatttcagtaacatggtatctgatttttaaacagcctatatagttgcacataacagagtgtgtttatgtgtgcaaattagtaagtcgatagaatttccaggtaaacaatcatggctgttattgtatgccatcacgtttattatggaaacatattattgtaatttatctgggaatttaaaaaaacagtgtgtgagtcagcacgctgtggtacagagccaagtttttgtgggcaaacagggtgggattccgatcttggcttcagcagtgtggtgtgtaggcctgggttcctcacctgtggatggacgctccttacctcattggcttgttgtgaagatcgaatgagtctgtgaggtcagtgaagcacttacacttagtaaattctcaataaatattcactgtgatgttttttattagaaacactgacacattactgagtgcatgtgctctgcacgtgtgcatgacaatgaggaaatttccctttaattcctgaagtgctgggtgatgatctatacccaggataatttttctagtaaatcagcttattggggatgcctatggataaagcccttcacttttaaggtattccctttaatttaacaataagacataaaacattgaagtatacaaaatgaacggctatggttaatggattacctgcaaataaatgacacctgtccaaatctggcttcaataataagggaattcatcactttacaaaaacaagaagttcagaggtaggtcaagccatagcttttagttactttctccctcttcatttctccagcctcactgtcagtgtccaaaggctttgctcctggtgtcaaaacagccatcagtgtgccttgtgcttcctggttcatagtcagtgagagagagaagggaagaagggagggcaaaagagagcataggagatatctcccctcaagatggacttcaagtctctgttttcaattgaattgaaccaacttaggtgaagttgccaaagaaagggcatgtgttgattgatttaaactagttgagatacgtctctagacttttgcatggttgtgtaagtgaatcaggtcaggactctaataggacagagaaaggtggggcagggggtgctgatgcatgtggggaagtaaccaacaatgtccgtactctccaattaagaacttaaattttaatatttcatctgatttttgccacaggaatttgaatcagttttctgttacagcatttttaatttttgtgaataaaatggaacctcttagaatttggtttctttgtgactcatttcctcatagagggataataaaactcacatttccagttttgagatgactattaaaaaaaatctgtgtatgacccagtgccagcaagcccagcttgctttttgagtagttactattgttgttgccattgctattttcttggtcaggatgtctttattttattttgtctcatctagactccagttttctatttccaaatttttacattatgaatccacatgggtgccttatcacctcatccaagaaaaaaacccatgaaggtgtgttttctttttaacattttataaattatatgctcatacaatctcatagagttctcacagaaaccctatggtgcagatgctatttgtgcaattttagagatctctttatctgcctcctttaaactatgagcttcatgaggacagagactttgttttgttcactgttgtatccttagtattcaaaatagtatatcacacaaggtagactggcagatgctcaatcagtgttttctgaagaaagggagagaggggaggagggaggagccctttgtgacctacagaggttggagggctttcccagtttgtgacattctagttaagatataaaccctcattcgtagtgggcctctgaggcctgtataccctgcctctctacagcttcatcttgctttcttcactctgctgtctctgtctgtgctccagctgcacaggcatatgcagttcctacgatatgcctccctctacaccgccacagggtctttgcacatgcagattctttagcctgtggaactgcttgctctacctgctcatctcccagttgcctccctacacctggccattctcccatatccctgctttactctgttgagaaccttcatattccagcttgaacacagttttctgggaagccttacctaatcccccaggttaaaccatgttccctttataaatccccacagcatcaggattctttcctcaactgtttttaaatacagtcagcccttcgtgtctgtgggttccccatctgtggattcaaccaacagcagatcaaaaatatttgaaaaaatgaaaaagaaatgaaaaataaccattaaaaaatacaaaccaaaaactatacagtataacaacaatttgcatagcatttacattacattagttactgtaagtagtttagagataatttaaagtctatgagaggatgtgttaggttctattcaaatactaggccatgtaagggacttttgcattcttagagtttggaatccctattagcctagagcacggggtcctggaaccagtgtcccatggataccaagggacgactatatgtgtgtatttgtgtgattacttatgaataccctttcttcactagagcttgaaaacaggggtgggttttcactcatcattgttttgccagtgtctggcatatggtggttgcttggtaaatatgcgttgaataaatgctaaaaaatactgttttgtcagcctgttttcatggttttttttttttttctgattacactcatgatttacagaagaaaggttagcatttgtattaatatcttatttttttctgtatcatttttcgtaataacctatatatcagaaaatcataaagtctgcagggacagcttctgtgtccctagcttaaattattatgcccatttccttcttttagggctaagcttaaaatttatcttcactggcctttactcagtcaaggctggattgggtgtccctcccaatccaggggtggcccagcatcctgttaatgtggtcagcacccaactatttttttttcatctggctctccactgaacttaaaagtagagactgaatttagttcgatatgtttgcccattgcccagcacaatgcctggcatattagacaccagagatacttttccaaatgaatgaattaataaatgcatgtcttgcacttgtgtgatgttcctcagatatctaagtcgttcctggaaaagcattcagtaaatagttgtaattcagtgcgttcagtgtggtatgcacattcttcaaggattgtccaagttaatctactttttagtgatcttatcactggattgcagattgcacactacatacgagtatttggctgaggaggaggagaatggggcctgaaatccagcatgcactctgaccattatggtatgtctgctcctaagaaacctcatatatatatatatatatatatatatatatatatatatatatatatttttttttttttttttttttttttttttttacagcaatgctatgtgtaattgcatggtcctaaatgtaggaacaaaaatgttaaaaattttctgtttaagttctattcacattttctctcaactttgaaatgtctctattttaaaaaatgtatcgtatattggtacaataatactaatctatacaaatagaagtaatttataaatggtgaaggcgtatgttcaaaaaattttgctgatgcagtaatatgtaatcaaaacaattatagagaactttgatttaatctctaagccgagtgccatggtagtttccaaaaataatttgcagctttcttttgatctcattttgagatggctgaagaagggactaaatgatcttagggtagaaacatcctagagctcctgcacacctctgtgtgtgtgtgtgtgtgtgtgtgtgtgtgtgtgtgcatgtgtgtgcatcctgtgtgtatcaggtgttcctgcgtatgtgctgaagaggagaatggatagactatggctggactatggctgagatttgtcttcaggtttggtgcaaatccatcccaatgcagtccattttagggaaagcagatacactaatttcaagatttgttagccaattctcctttcagatgagtagtttatgatgaattctcttttccccattcattggctttctctaaattgtagatctaaaacaacctcttcatgtctgctctgcctctgggatagaaataatgaattgtaggtttctaataaaagagacacgttttgtgtctgaacatcttgattagaatcgttgcagccatttactcaacgtgtgactatttaggaaaaataatcattctgagcttcagtattttcttttgtaaaatgaaagtaatattaattaattcatagatttgttacagctacttgggaggctgaggtgagaggatcgcttgaggacaggagtttgagagtagctttctgggtgatatagtgagacctgtctcaaaagaagaagaaggagaaggagcactgagacggagaaggagaagaaggagaaacactctgacatagtactaggtagacagtgtttatggaaattttttagttttgagctttagaagtcttttttattagcaatgataaaatcacagctgtttatgtgctgtctgatgtgatggttactttaaaacacatgtattatttctctatatcaaactcgttaaaataagattatttggttagggattagctaatgtatttgtctgttttttgaagagtgacagcttcctagctttttcttttttctttattttttggtctacttgaagctgccgtatttattatatgattgagtaatgatacagtgataatgtattatatgactgagtattgatacaatgataatgactccatcccatggtctgagtaattttgcaacatgtgggtcccacaggaccgtagagcaaaaatcctttctgaatggggtatctgcgaaggcaatagagacttcactttaagtggatttctgtagtttccaaagggatgagagggagaaaaaaaagtctgtatagaaagaggggggaaaaagtctgtatggaaaggatgacttagttgacatggttaaaaggtgtgctcattgactgggaaaaagttcataagtttgcagtattaggttaaggaaggaaagtccattcaagctgttttaaagactctgagatgccagactaagaacttcattcagactttatttgataggcaggggtgatgtgattaagatcatgccctgggaagattatgactatgaattgaaagaaacagactggaagcctagagatcagttacaaaaataataccatagtccaaagtcataattcaggatgaaactgttaggaaaagaggaaggacatttaaaaagatatttgcaatgaatagctgttgtatattgtatggtgggtttgggtgaaactagactaaaatttttaacaaagcctaaataaacagcaatgagagctggttccctcagcgttttgtttgaggtactagtgattatcaagtgaagttcttaacgcgtagtaatgtgaacttaagaaaggaagagcattactattttttcagggtttagcatcaattcttagctttcttcctgaaaccatttcccatcttctactatttgaagaactagaggcatagatgtattaatgtggcctttatttttcttgtgagaataagaaggataatacacctcccatgctggaaactaccttagaaacttaggtgaagagacaggtgtcagatatattatgtgacttgcccaagattgcctggcccgtggagagagagccttcactgtggctcagggatgtgggcttcctgtgtgaaggtcctcccaagactctgtgctgcctggtctttacctggtccacggacaccaatccttttttacttttttttttttctaccatttcatggtgtttgcatttgtcaatatttaaagacacctacctgaaattcacagaactgtatatgatgcttctcatttttgtttgtttgttttttgtctttagaaagtacccacatattgtctgggtgtggtggctcatgcctgtaatcccagcagtttgggaggctgaggcaggtggatcacttgaggctaggagtttgagactagcctggccaacatgacgaaaccctgtctctactaaaattgcaaaaattagctgggcatggtggcatgtgcctgtaatcccagctacatcatgagtctgacgcacaagaattgcttgaacccaagagacagaggttgcactgagccaagatcacaccactgcactccatcctggatgacagagtgagactctgtctcaaaaaaaaaaaaaagaaagcacccacataataaaaatgttgtgctgggcactatataaagccaggtaaatatacaaaggtctcagcctccactgtgtatcatgtttcatacacggaagattatatcctgaaatcactggagtaaatgttgaagtatcagagtatcagtttctcccccataaattctccggttacacttagaaagttttttgtttagttgtgttttgtgtttagttttggctctaagaggaaggaaaggaaattcacattttgtttgtctgacacttttacgagaagttatatatggccttttaatttacacatgtaaaattaatttgtaaaagcagctatgatgtaatttatggatgaaaaagctgaagattgactagccttgttaatgaaaggtagatagccatggttggaattcatgtcttctgaggttcataaaacaggccatcttttaaattgagaagtgacatcataatagcaacatgggcaacctgaaaggcagtcaaagaaaaacaaggagggtattaaaaggtctgaatggtatatcacacgaaaatcagttgaagagacttgcactatttagaagaaagagataaaacaaaggtgctacttaatcaaaaatttttaaacagctgaggtgttatcctttcaaagaagtatcaaagactagttagctcaaaaagatgaaagtaatttgatattggaagtgactttcctttccaaggctcatgtcaagggtttggggccaggtatttggcaggacttcactgttgggaagattgcaaaagaaccttgccttaaacatttataattttaacctttctgccactgaattcattttaatagtgaatctgatacaaaataattacttataaaatagattaactggaatttctttgcttaaagcaaggatgataaagaggcccctactcttgaaagttttccggggcccctttctgatacactgtgagtacaatgattttaatttgaaaacctttgttggtaaaaatgatttccaaattccattcctgtggaaagatgctaatttaactttaatttgaacaaagtcgacttatgctaacaactcctaatttggtcatgacttttgggggaaatcttcactcaggtttgggcagtgaagttactgctaagatagctgctcaagtgaagggcagatgaccgtcagctctcttagtagtaagtcaatccaaaccaactccttcattgccaattaatccagtccctgcgtcatgcccctggaaaggtacttgggcttcctgagaagttattcatcctgataaagtgaaataaaacaaagcaaactcatagtattttcaggatttcaaggaaatatattgaaagatttttgctgtgcacaatgatttatttatttaaaaaatttaaaattgatgctctgccgaaaaggcataattgtaagggaatctataattgcagccttcatttctcttgagtactaggaaaaaaaaataagaaaggaaaaatggaaggacagatattattaaataaagtgttactagcatcacatgctcaaattaacatgttctttgccacagtgctctaaaggagatatttgcactttatctgtatgatggccagtgccatatatgaagtatattcaatccaagaaaatgtctgggagtcagaagtatgttcagacaagttttctatcatgtgttgtctaccagccttttacatactgtagatattctagaaagactaacaagctagacaaattaatttctccttttgttatgcttatgagaataaactgattaaacagttcctattctatctgtgtaaacagagacatattagttaacttactgcttattttattttcccacatacttacagtaatttcaaatgttgaaaaatgaggagagcagaatatggcattaagcaaagagaatgaaataaaaaataaagcaatgatctgaactagaaaaaaaagttttaaaaatgtaatttttcagttacacaaaagttaccatggcattacctttccttttgtgtctgttggtgatttaatttagtagttttagaaaatgtgtctattgctgtatttaaaaattctaattacagcaattggtaaagaagtttccaagtacaaggggtatttgtagagaacctgtaggactgacaagtgattgacaggtaaacaaccccactgtggccttatattccattctgtgatgttggactatagatactacataagcctcaggaagtaaccaccttccaatttttattaaatgcttggcgtcatggatgtaaacagtattgtgccttagttgactaaatgtggcactttcttttacactgccgcaccaccctgactcagtgtgatggaatatctgtgaaaagaacaaatgggaacttttctttaatgcgtttaactgaatgtatcccccgaaaagaaaagcaagtgcagatttcatcaaataaattgaaaccatctaaaagtgaatgaaagaggatagcatttctaacttcaaatgttctgtttatgacttactagtgccagtgtgaaattgccctttcttctctgctaatgcaaaggctgacaggtcagcatgcacacacacattatgttatgcgcaatcggaagctcttgagcttgtccttgaacatgctttacagttaatatatcttgattttcaaagtgccattttttcccgttttgaacccagactttcttttccttgcttccttacaaatagtttccttaattcgtatgcatttcttactgtacttcttggtactcatttcttttttgaaaaatctttataatagcctgctttaataaaatattttaaaatagttaataaaattggatgaatgctgtcatcaactgtgattctttaagaaatagttcgtatgtttactaataaattcaaaattaatggatttgcctgatgtgaaactttgttttcctgaattttaaaatgtggaagcaagtcttctttttgtaaccatttcatatttttaagatgttctaatgattgcctcagagtctagaggaaaaatattctgagggttttccccccttccacttgaatgctaagaacttggatgttttgaatgagctattcgccagcagatgaaaagtcattccagataaatgagaaaccaagtacagtaaaatctgtgttttctaaccagcaaaatctggaaaatcgtaattttttgattccccaggcaaaaatgtcaatctaataaataggctaactgaaatagggtagggtgactgtggtgaaatttaagttgttaagagatgcaatatgtattcttattgctaattttaaaaaaaatctcatgggtttttgtgagcaaaaatgatatatttgtgtaaatcatggcattttccttccttttctagaccatgaggaaaaacaaataggaggtaaaaagaggagatcaacacatgaattaactctgagttatctgtaacggataccctgtcttcataatgtatctcataaaagttttaataccagtgtatttcaaaggtttgcaagttatttagtacttggaacatgttttcccatagaaacaatgttgtaaatattggttcagttcccaggccagtgcacacagcctatttaatccatatgtatctaagagacagtaccaatgtttgcttgagtactggatcctaaaggcatatgtgcagaaaagagcatagtaatcggtatcttctgttagttttttttttttttttcctttttgagacagaatttccctcttgctgcccgggctggagtgcaatggcgtaatctcggctcactgcaacctccacctcccggattcaagccattctcctgcctcagcctcctgagtagctgggattacaggcatgtgccaccatgcccggctaatttttgtatttttagtagagacggggtttctccttgttggtcaggctggtcttgaactcccgacctcaggtgatctgcctgccttggcctcccaaaatgctgggattacagacgtgagccactgcacccggccctattttctgttaattttatggaaaggaaatggtcttataggaatttccagaaggcactaattttgatatttgtccttttcttttgtgcctcttattcaaaagtcaccagagttctcttgtggacctgtgggaacagcaggacccagagtttactatataacctgctctttaaaggaaaaacaatctccttcaagggattcctgtaggttggggcattttggcccctttattgctctggacttgttgataaagcttattaacctcagtgttctaaatggtacagttaaaatgatttactaagcccaagaaacacaatgaggatatgacagaaacatcttgatatgttgctggaggtttaagaaagtcttgttgcttagttgtgacttttaatttatttctttgttttccccttcacaatgtcttatttcaataaaaactttatagtttttcacagtagctctcatagtgatggtggcagagcctttgctgagctgaggcaatatcagagaggttgatagtaagctctttgtttggaaattggggattgtaatttattgcattatttttaataaatgaaaaattaccattattcatagttgtaatttgacatttatctgtcattaatttttgcaatatgtttttgtatattgcaaaaatgcaatttgacaatgtaatttgacatttatctcagactgtatgactttttacaatatgttttccccaatattttatatatataagcaagcagggcctgtatgattttctttgctcttgccacaccagttgtattcaagccaaagacaatccacccagtgggtgatttataacatagctattttttaaagagatataaagcactgtattgctttatcagtaagaatatacagacttttaaaaaacattatttctaatatatttatatatcaacaaggatcaaaacaaattttgttactggaactttatcacaaaccatgtttttagtgaagaaatagctattatactttcttgtacagttcgttcaaaggaggacatgtgttttgtcaacgaggaaagaaatcaatgctatttgtgatattatatacctcatttgaatattttatctatttcaataaattgaaaatgagttcctactttcttttccatatgctgattttcatgatttctttttctatagagaaaaatatagctgagcagatttttaaatgcagcattggcagtgttacaggtctttaattttgttggcattgttcattttgcctttttttgttttttttttttagttttgtgatgtgaggtgatgtgatggtcaaaaatgtggactttttaaggcccgacagggggagccaattccatattctattgagatttcctggcattattgcagttgtccatttgtcacggccaaaatactttctttagccttggctgtccatagggctccgtaacagatactctttgctaaaaataatacagtattttatattaattacctttcagtcattaatattgaaattattaatctattgagataatgcctaggaaactgaaatagggtcattattttaaaatgtatgatatcatcattcaaggtaaagttaatcttataaatataaccttttcacaataaagatcaatgtagaatatatggaacattttaatgctcataaaaattctttagtataatattttatggttagattaataaacatgggaccatctcttctcagatttttaagcaaatcaaatttataaaataattaaaatcacatgactctattatatgacttttttaaaaccacataccttactttaaaaaaagtaaagatcctaaactaagttcaaggtctaccacaatgaatcatttaggatggtattgaattcccataattgtttggttctgtgttttgttctcagtaaagaaagtggaatggttttatttatttgaattatatagggtatatcttatcaaaagacattctaagattacaaaaacattcaatgtgatacatttatcttgacaaggaacatggaattatatgtgcaagaacattcatttgttttcatagtttagaatatataaaattttataatttctgtgcatttatcactttgtaagccttaattccctagttagctacgtatctatatatcctaagatataatatatgatgagtgcattttagttgtctcgcacatgtagacacgtgcagacatgcacacacacacacacacaaatatagacatcctctttgtttttatttcctgtatattcactaacatgataatggacatatattatgtgataaattatattgtgtgttaaataactaccatagattacctattttaaatttcaagagcaataaatctctgttgctaaaatcaagcactaggcttttatggaactcttcctattttttaaaaaacttaactttgtttctgctagagcttcgtttgagtatgattatgctatcaggagcctaaaatgcaatagcatttaatgaatttttggtttgattttgaaaaaaaaatggatatggtatacatcgttttctaattttaaaaagtaatctcattagcctttgtgttaccttaacatatagtacagattttgccttatgctaaagacttcatgcaagttggataaatgaatgaatgaatgagcaactctttaaaggctatgctctcttgaacagtgtatctacctgttttctcatatattcaatgagatgctaattatttgctttgttcatatggttgatagggaaatcaaataagatattgaagagctttaaaaattagaaaattttaaattttaaatttatgaacaatgataacactacatttttataattcaaaatgctggctatttgggatacatctttatttttatcttaaagagataagcatgttactggctatttgaaactttctgtatgagaatgtctcttttttgcaatgctgcagtgaatcatgcttgtaagaatggccaaatagacctatgtttgctaacgttagattcttgttatacccaattacccttttgttcttcatgccattctgaatgtcattttgcaccaatggccaggcattaacggggcatactaactctattgtacctgccacttatgcagtattagtttcagactccctacttttaattgaagagctatgtagttaaattatcatgtcatgaattccaattcactagaagagctaaggaagaaaatgctattgaaagctttcccaagtaacatttcttttaaattgacaagtctttagactaatgagatattagtagaggaggatgtattttcatttgtaaataaaattgagattaaaaaatgttaaagagaaccattttagaataatcctctctctcctgagaaaagttgtcttgacaacagtaccatttataattagaaatgatgaatattttatttctcgaaggaaaattctccctaactatgctagacagtgatcgggctaaatgttcatcaggctcaatcattttttggtgcaaaaatatactgtcgattttttggctcagtaataatcaagccttgccttgtagtttataaggactgggttttcctatgcatttcttaatagtaatctgtgaaattaagaaaaagagatcttattgacctaattttacagaaagagtatgtatctaataagtgacaaaaatagaactagagaaacgaagattaatttttttgcttttcatcattttgccaaaggggcagaaacacatgacacatttcagagttgtgctttcactcatgttcgaatctattcttttatatcatggaatttgtatttctttcaatttaaaatattttattttctttgcctattataagtgaagaattggcttaaacttaagatatctgatatagatttcagtctttctctagtgttcatgaaaataaagccatttaaacaaatggctattcaaattaaaagatgtgatggaaacttcatcttgtgtcatcatttattccatcagttatccagtgtctgctacatgccaggcaatgggggagggacaagttaaataaatcataatgtctatgggggggatggaaggacacatctagaaagcagtgaccagccttcagagtattgaaattgaaatggctgcatgatgtcagaggctagagcattcactttgagataaagcgttcatgaggactgtgggaggagatggcacttgaggtgtgtcatgaaaaagggggatatatttaaggagggaggttaaggagagggtgtaacatccaccagaggaaatgactgtgcaatccagtgaccaagagaggagagtaatcgattggaggatgcattggaatgttaaatggggcttgattctagaaggccttggtgcaattctaaagcaaacgtttatcatccaatcaaatctattaccttgaactcagtggtttagtgaattacacagttgtttgtatctgattgtatatgacgtggaactttcatgatataaatttaccttctgtcttcacttttatgacttcgttaaaatccattcactgatgaaatcttatcccattatctacattaaatcttatcccattatctacattaaatcttatcccattgtctacattacacttaaagtttaagacatattttattattaattcaaataatatacttttgaaacctttattatctatatctgtgatgacctcaaagttcaagtagtgttacatggaaaatgttagttttatactgtgcaagacttactttaatacaggttcactctttggattctgtttgtaaaagagtagaatttaattcaagatttcctgtggctggctggatttagagagccactctcagtacccttacaagccaggcactttgcagatacaaggctttgaaacaaagactgaaacaaagtgcagtggctctttatatttatattttacttgttttattgttttcattgaggaggaatttatttattagcttccatttatcattagaacacatttcattttagagaagctctgaggtcttaaagctaatatggaattacagttactttttttttttattttgaagatcatatatgaaagacagtacatttcatagaaatgaaagacagatgcctcttcctctctttctttcttttcctcctttgtaccaacctctgtgttaatagaaaatgccttgtggtgtggccatgagcatggtggtcttgaggagcccacgctccactgaatggataaacaaacaacagtgacacagcatcaggcttaagtcagaggtaggatcaccgtctgtgtagacatatgtatgtggtttcttctttctgtctatgtgggtgcctcatagcagagtgtacgtgaatgtggttcttaaataaaattatatgcactgggagcttaggactgaggaagaatattccagctagatggaatggcaaaaataaagacatagaactacaaaggtgagtaggtggtaagttcaagggaaatgataggagatgaaccttggaaggctggtctatgccacactacatgaggtgataactgagtttgaatcacacctgctaggctgggaacagcatggaaaatatttaagcaatgttgagacatgttgaaatctgtaaaatagaaacataattaccattttgagggtgggtttgagggcctagaggcttatgtgattttctcctgcagagttttagctatgatagcagaggaggtgttttctgcagtatctcttgtgtcacaaaaagttcctaccagtgtatattattgtaaactactcaatacacatttgttcattggatgaatgatgctacttatccccctactcttaattaaaagctcaactagataacttttttaaaagaaaagaaaacgaaagaaaggaaggaaaaaataaggtaagagagaactaaaaattggactataaggcagtggaaataggtaatacagagtgtatttgcagaactcaaagatacatggttgtgaaggaaggagaggagttgtaatagactattactttgactccagtgaaacacacctctcaattttcatgcccttgtgtagtgcctttccttgaatctgagcttggccatgtgacaagcgttggccaatgagacattagcaagtgagatgcaagcagaggcttgacaaatgcttacatgttagagatggtcttcttgcttggaatacttgtggttagagtgcaccatcttggaacagctgccttgctgttaggaagcccgagaagtgatacaaagagatgcacatgaaggaaaatggagatgcagagcttacattcccatctgtgctcccagccagtcccagcgctcaggccattttgtaacttccaaccatcccctcacccccaccataccatacaaaacgcaaaaactgcccactcacaccacagaattttaagagagcgtgattggtggttgttgttttaagttgctacactttagggtagtctgttaacatagcaaagtataacttcaaaatgaatggagaatggttttaatatatgcaggttaattacttggtggattgtgataccttcatttatcttagctcaaagtacaagataagtagttttgttgctagtacactagactgtgaattcttcgaagaatgaatctatatttttactgcattttggcaaataggtattcgaaaatgtttgctgaatgtaatattgaaagcaagccatgctcatgatgctatgccatttagctgctgctaaactggtaactctccatgtggctctgctttttatttttgcttttggttatcatgtacccctgtgacccaacatacagaatggtaacaggaggtgtaaatacacacacaccccacacagacatatatacaccaaaaaaagaacagaaaataaatgtttgatgaaatggagacggctagatcacaacacgtgggaaaaattaaggtctatgtcacctgtgaaaaaactgaaattaatgaacaaatttctgtaacataagtcagacattctttctattaaatttaagctaatttatataaaacaccatgtatgggaaccccctattcaaacacacagcttgtatacttgggtaagaaaatgtgggttaccattagaatgaaaggcaaatgatgtatttggagattagttattacttccttgtaaaaatgtgtaattaagcaatcctgaccgggcatggtggctcatgcctataatcccagcattttgggaggccgaggtgggcagatcacttgagatcaggagttcgagaccagcctgaccaacatggtgaaaccccatctccactaaaaatacaaaaattagccgggcatggtggcgctcaactgtaatcccagctacttgggaggccgaggcaggagaattgcttgaacctgggaggcagaggttgcagtgagccgagataatgccactgcactctggcctgggtgacagagtgagactgtctcaaaataataataataataataataataataataataataataataataataatcctaaagaagttatggtgcccacataggttagcgttaagtgtatgttagattttcaaagctgtaagttactcctatgaagttatgcataattcttacatcttcattgcttccaatttggtcaagaaagaaaccctagaatcttgatccttctggaagaaaagggagaaaacaggtaaagtggtaaaattggttagtgaaagataatgaaagcctttaagaaaaattctgaaactgaaagcagcagggggcagtagaacattttgagtatggaacacggggagaaaggggactggtcagtggagaaggatgctggcatctctgaagaaatgttttagttttatttttaaatacacaagactatcttttgatcattacgtttcctgttttcatgatcctgcaagctagggatagtcacctgtggtcaatattaatatcaaatgaaacctgtccatttagaaaagtagcttatgctcctttcccaacatcagtatgtagaatgtgcccctatgcataatatatagcaatttatattttaattctcttttcttcttttgtataatttggcttgaaaatcctaaaatgtagggtagagggactcaaattaggaagcttgagaattacaagccaggtaatccattgagtattaatttttcaatagatttatttcccgcgatttgagatccttatcccactgcattttcgtgtgctttttttgttttgttttgttttatcaagtcaaaacaaaccagtttttattcatggagaaatcttgcctctgtgcctttgcctggactgtacttttacttaggatttcctttcttgtatatccatgactccaagttataatcagttcttcaaaacttatttcagattccagattattggtgaccacttctggtatttccccaaccaaagaaagctgaatccttgcttgcattctccatagcagtatccatgcacttaattatagtacttaattttctatcttaaaaaaatatatataaataaaatttgtatttttcttataggattgtcaacttcttgagtgcagaaattcatttctctgatatacacagcatctactacagtttctttcctccattcccttcctttttacctaccttccttccttccttccttcattccatgcctccatccctccacccgctctatttctttccctccctccctcccttcccttccctcccttcctccctccctccctccctccctccctccttccttccttccttccttccttccttccttctttccctgactccctctctccaccccctctatttcttttccttccttccttccttccttccttccttccttccttccttccttccttaaactaagggtctccttgtcacccaggcaggagtgcagtggcgccatcatagctcactgctgccttgaattcctggactcaagccatcctcctgcctcagcctcccacgtggctgacactgcaggagcacaccaccacactcggataaattcttaattttttttcatagaggcaggatctcactttgcagtccaggcttgtctcaaactcctgacttcaagtccctccttggcctgctaaagtattgggattataggcatgagccactgggttcagccagtttcttattcttgttagacatttgattaatacttgttcaatctatatatgcagttactctttttgaatcttacctatgctgcattaagacattcaagacaatggggtgaaaggacaggaaactagtatttagtaagtgcttaagtgtataccagggactctaattctttgcatctgttcttttaaaatcctattagcaactgtttaaaataggtaatattatgtccatgcatttaaggacatgaatctcacaggcagtaacttgcccaagctcacatggatagtgtgaggcagaactgggatttgagacccactgcctgtcccctgaccacctccaaagcccatgtcgttttcacaacacagcagctattatctatttggtgctacacattgctttaggaactgctgattctacattgaataaaatactctactgtctttgaaagactcacatgccagcaaggaggagattaattattatgatttttagtgataagtgctttaaaaatgtcctatggctaccaggccagggaccattacctgtgcctggcaagagacacgcttcatggagaggtgtagcttggacttgggaagtgatggggccttgagggattagcagttcaccaggtagagatgctagaaaggccaaggaaggagtctaccattcagaaacgggatgtcatagctcacttgatcagctcattggctgggaatttgtgtacatggtaaaacgagtggaaaatgccatcacctcattatggaatctctggagtgctccaaagtgccaataggtaacctgatgtattaaatcacatgacaacagaggtttatagtatatagattagatatcagagaagtgatttatactgcagtggtaaggtcagacagaaaatataggaggggaaacaacgtggtatagaaagcatgagctttgaagtcaaatacatgaagctttgaatctcagctcttgacacttttcagctacatgaccttgaaaagtaatccagttgctttgagtatcagtcactgcctctgtaaaatggggatattagctacttcaaagactcttggtgggattagagaaggaatggaatacttaatagaaggtaggtatttagtaaacagaggcttatatatacccttaatttttgtacatatgggtatacttataaaaatgttggtaaagcaatgctgtttcaaagatcctattttaaatatatcaatatatgaagtaatgtcaagtttctagttgtacatatgtacatacaaacaaacatatatttacctttattctaatttagtgacattctgatgctaaaaggacatggaaagttcacatgcttttcattttcttatacttacttgtatgaaaaagactatgtcattcttcattgagtcttattttggaggtttcgagaataagtttaattttatgccattcctaaggtattttaggattctgtcatcagattcatcattattatcataattaattcaaaattataaatgatatgattctccttgtttgtaaaccagtttccttgggttttagatatggtcaatttaacaatgatactgttcctgttgttgaaataacgtttgccaaaagttatattctagatattcttaaattaaaagagtaatattcttattgcaataaagttatttttatgtatttcacaaacaactttattgaatattgaaagtttttaaataagaacaccaattatagcattctttgcactaaaatcctctagaggctcagatttttacttttagttttagaataaagcagtgaaacctctttctgcttttaacagatctttttttttctttatccactctcttttcttcttttatagcatcccttttcaccaattattttcatttctcttatttttttaacttacaactttttattagagcttttcctctgtcttcaaatatgcttaaaattcttctgtcctcaaaaaataaaaataaaaaagaagcaacaaataaaatcctctttacttgtgtaagatcctatttctctcctctctctagctagacatcttgatatacttaatttgctatatctaatacctgatctttaaattaattgattaaaaatctactgtgataacctcagtgtcctttactgtactactaaagctccttctactaacaatctttggtgaccttctagtctttctttctttttttttttttttttttgagatggagtcttgctctttcacccaggctggagtgcagtggcgttatctcggctcactgcaagctccgcctcccgggttcatgccattctcctgcctcagcctcccgagtagctgggactacaggcgcccaccaccacgcctggctaattttttgtatttttttagtagagacggggcttcaccatgttagccaggatgatctggatctcctgacctcgtgatctgcccgcctcggcctccccaagtgctgggattacaggcgtgagccaccgcgtccggcccctctagtctcttatcagatctggtggttctatcttcatcagctactttgcacaaaatttaccaccatctccttctcatacatcactatttcctcaaatttctttcttactcttttttaatgtttctcattgtacacatgctttctggacattcttgctaattttcaggtttttaacttccaccacgagctgccaacactagagtttatatctctgtctctttttactatctgtacaaacctggatgaaacattagcaactcaaatttagtcagcaaaaaaacaattatctttctctatgcaatcttctctttcatcctgccaagacttcgttccttctgtatttctttgcagttcatagcaccatcataacccgagtttcctagggcaccaacctggatatcacactgagacttttctcttatccccacattcagtaagccttcatccctgacaactttccctcttaagtatctcttcttctcctgtcctgttcagcatcgtcccagatttgccttctctagattattacattggtactaaatggacttgctggctagaggtatgtatgcttcctttcagtgactttgccccaattgctgcagagtgctctatcctaaacccacgcccctgcaggtctttattctggaagctctttcatattatttggtctcattctgtaactgaatttcaagtaagtttccactcataaatctttaaatgaagggaatgtggctattattatctgtgttctgagagagtttatcacagtataggtaatccataaatccttatggatgaactgaactcaattttttaaattagttaattaatttattttcagagacaggctcttattctcttgcccaggctggagtgtagtggtgcaatcatagctcattatagctgtaaactcttgggctcaagtgatcctcctgcctcagccttcctagtagctggattacaagttcatgtcaccacactcagcaaattatttttttaattttttgttgaaatggatgtcttactattttgcccaagctggtctcaaactcttgcccttatgcaattctcccaccttggcctcccaaagcactggaattttaggcgtgggccatggtgccaggcctgaactcaatattttataccaaaataattttgatttaaaaaacgtatgtgtgggaaaagttgggagcaattagaaaacagttttaaactttgtatctaattttaaaaccatgctcttaaaataagattatccctcaaatatttgtgttcacaggtaaatattttagcaataacttttgaaaaatgtgatgaaataatgttgaatttctttacatttttgtgttcgaaagtcagtgttataaatgaaaaatcacataatcgatgtaacaagttattataggatttgctacacagtagatggtaattctgatttttatttaatatagattgttatggaaatctttataaaattttgctacaaaaatgtttacatatgtgaccttactggaagtgaatagtactactttggtttaaaagtttgttcttaagaataagaacattttagagttatagaaaatagtccagtcaatgataatagctgtgtgtaactattctaattgagaatggatcattctttatggaagatttggtaaattatacagaatattgagcctttattgtttgtaaaattaatttaattttgtttgaaatatactctattaagccactataaatgtgtatccaataagctatctgaattagtattcagatgaaaatatattgaatttctcagggctttcaatatcagttctatttccgtgagcattttagctttctaatacaagaaatgcaatttgaattgtttactgctgtaagccactggttattttcagacataatggaataatggtgtttagccacaatgtggtattttctaaaagcacttgaaatatttcatgagtaagattagctaaagaatttagtcttgttttttatgaccatgatagtttatgtctgcaacctgagaagtttttattttcagaacagtttctcaagagttttattttaaagaaaatgaaactttttcttataagatcagatatcaggtttccactaactgtgttaaatatttcgctttaagttacagtatggaaaatttgagttactcaaccaactcaactaacttaggcattttattgtgaaccaagaggagaggagtgtgagataattataatcaaaaactaccataaatacatgatgtgattgtaaatttattctttagtgaaatactgagaacagattattttagattatcatttttaatttatgttcacaaaacattttaatgaataattcatattgataaagtgttatatattttgtagttataagtaaaattaaaatatatattaaagaaaacatatggctgggtgcagtggctcatgcctgtaatcccagcactttgggaggctgaggcaggcagatcgtgaggtcagaagatcgagaccatcctggccaacatggtgaaaccccatatctactaaaaatacaaaaaaattagcgggtttgttggcgcgcatctgtagtcccagctacttgggaggctgaggcagggaaatggcttgaacctgggagatggaggttgcagtgagctgagattgtgccattgcatttcagcctggcgatagagtgagactttgtctcaaaaaaaaaaaaaaaaaaaaaagaaagaaaagaaaacatattttagagtagggcttttaattgatattttagtccttctttaaatggcaaatataaaatagattttcttgctcttattattttatcctaaagtgattttcatggaattttgtctataagaaattgaaataaattttatgctgtataattatgtcagaatttgacacaataaagatatttttcagttctatgattgggttaactgtttctaggcttgagggagaattttgcttgtaaaccgtattaatttggtagatcgcattctactgtagtcttgtcacatttgttgactttctgtaaaaagtggctgtattagtctgtttctgcattgctataaagaaatacctgagacttggtaatttataaaagaaaagaggtttaattggctcagagttctgcaagctgtaacagaagtatggcactaacatctgatggcttttggtgaggcctcaggaagcttacagtcataacagaaggcaaagctggagcaggcacatcacgtggtaagagcaggaggaagagagagggaggcagatgccgtatgtttttaaacagccagctctcatgagaagtcagagccagaatccactcatcaccaaggggatggtgccaagccattcatgagggacccacccctgtcatcaagtcagctcccactaggtcccacctcccacactggaggtcacatttcaatgtgagatttggaggcagccaacatccagaccacatgagtggctttctgattactttctgccttctttttttcttttttagtatatccactttactgtttgtatgtgttaaagcggtggtccccaacctttttggcaccagggactggtttttggaagacagtttttctatggaatgggtgggggattgttttgggatgaaactgttctgcgctagattctcataaggagtgtgcaacctagatccctcgcaagcacagttggcaaaagggtttgtcctcctatgacgatcttacgcggctgctgatctgaacacgaggtggcgctcaggcggcaatgctcacttgcctgctgctcacctcctcctgggcaacccgctcctcacaggccatggatcagcactggtccaggcccaggggttggggacccctgtgttaaagtcatgttcttatagctatttttaaggttacaaagataaatatttttcatctcttatgactgcaaattgtatatcatagttagattgtttctcaatccaggagcaattaaatttgtacattaggtaataagcatttttctgccaaccccatattaagaatacatggtaataaaacaggatgacacagagtaaagtacctgtttctggtgtcagaaacaactgacatattccagctctctattttttgcctgtgttatcttgggcaactttctgagttttaattttcttatctgtgaaatataaacaattaatgaaacgagataatgttaagatctgataaggattagaaacaccaaatgatagcaaagtatgaacaaccttctttcccgcttgggaaacaggtatttcacagttttagaggtttatgtatatatacacatacacacacttactcaacggtttgatatattgagtaaatgtatctgtagctatttactgagttcctgattgccaggctctgttctaggtttctgagatacatgacttaataaaacaaaacctctgtccttgtcgagcttagtattttagaaagtgaatattgtgggttttcctttcatgtcattaatatttattttaaagcattctagcagtattggctgtctatattcttggctcacaatatattcatattcccatgaactaatgggaagaagaaaaaaataggacaggataaaagttagttgtttttcatatgaaaagaggtcttatgactttatttaaaaagacaaacaatataagggaaattgaaaaaatgatgttaacaggtaattcacaaagaactgcagatggtcaataaattcatggaaagctgcccaaacttactagtaattagggaaataataaaagcaaataaaaccatggatactcttttttcctgcataaaattagcagaagggaaaaatgttaataatgcctagtgttgttaaaggtgtggggaatataagcacatttctacacagggatatgaattgtaacttttttggaaagcaatctgtattacctgtaataaaataattaattattataattaaaaattataaacatgtgatcatacccaaggttctgcatttttagtcatctatcttagagagatcaaagtaccaatatataaaagtgtgtcttcaatactgtgtatattattatttgaaatgacaaaaagctaggaataaaaccttagagtttctcaataaagagacatttcaagacaaaagtaccaatatatgaagttttgcccagaaggcataatgttttcatccatgcttgtgagaacaaggactgcaaaacgtcatgaatattcaaccacaacagagtagttcaacaaattgtgatgaactcaaagtacacagcattaggtagatatttcaaagataaactagagttgttaccattgacgtagatgatagatatctgtgatatcttaagtgagaaaagcaagtaggcttgtgatgtgcttgttataatccatttggttttaaatttgaagatactttatgaacatagagaaagaaggggaagaatgtgtatcaaattgtaaatatttatcacttcaatgtggaggttgttgaagggagaagggaaggaacacttgactttcttctgtctgatttatttattttctcattgataaaattatcagaaaggaaaaaacataagaaagttaaaatttcaagctgttaaaaatgttctatttagggtagcattggcatatgtcttacactaaagacagtacagagttctgctggaactctttacattaggtagtagatgtttagtaaatatttcagtcactcattaattgaaatatattgagaattctatagccatgggcttttaatacatacacacacataatctatgatacatttattgtgtattctatgtacttattacatattaattcatatttatgatattttgagggccattacatccacggtacctttatctatacatgattttcctacttactttgcagttttattttcttggtagtgatagtgagccaggcagggatagtaatactccacaataaagtcacctccctctggcctcctcccagattccaaaaatgtgagctaggcaaaacataaagaactttatgcattcattcactgcgttattctaaggtttattgcttgctaagtcttgtgggaggaaaaaatatttattctaagagatttattcaaaggtcttttacctacaaggagtttacacttctgcaggttataaacatgtcaacaattctttggcacttaatttttattcttcagcctagattaaggtttttttacatacttatcaactactacacaaaaatcaaaacccctccattcttaacttttaaatacgtcctcagtaaaggagacaagaccagaaattatttcacagaagatatttacaaaaattatagccaagacataggagacaatttagatatgctacactataaaaatggctaccatgggtattttgcttgttggatcccagtatatttggtctttattttagtttaacaggtctcacataaagtcatctactaaaaacacttccattctttaagtccagaattctaagtagaaaaagaaagcattctgattgattcacagaaatctctgtgaaagtattgccttttattatatttatatataaatatgttttatatatttgtagtgtatctatatactcatatgtgagaaatatgataccagaaaagctactatgaattattttacctatacattagttgttggtatattatgcatttttaatttgtgagtatatttgggtagcattattatattcctggcagggcttgagctttttttttttttttaatctccagggattcttcctattttctaattcagttcgttgttcttggtttattgtgaacaaggaaagcaaataatcaagctggctgaattatgtttaaaataagtatgaataaacccagaaggaggacctgcagtattctatgtgtaaaacacatgggattagtgggaaaaaaatgtgtgaaatattttgactgtttgaaagattaaaaaaaaaaaagtatcgtttggtttacttactagttcacagccacgttttgaagagttaaagttgtcagatggtttgcttctggatgcatgacatacataggagagtaatatctccttgagtttattaacatgctacaattcatgagactttttccccacatacctgtttgttacgcagtattaatgatgacatggtatatttacatttaatttatatagacaaaaatgcttcattgttgaactcatatttgttaaaatgaaaggaaagaaaaaaaaacaaaactgagacttcaatttcatgtattttaaggtaccaaagcattcaatctttaagtaataagaattacagtaagaccctacagcatagcaaattccacaggcagtttattgaaatacattcaattatctgaaacttctgtagtccttagaaggcactgtgagaatcagaggtgcattagctgcagtttcagtcagacctgagtttgaatcattgctcttttattaggttctctaaaatgagttatctaaggctgaacctcagattctatgtctgtaaaatgggatttaagtactgtacttctaagtttgttatgaggaataaatgatccttgtcaagtacctctagcctaggcctagggcttgttcctgtcagtaactggtggtttcgtgcttagttatcatatgccaaaattgtgtgtaatgagttactactacaaaggccaaagcttgaccctggctgtaagaatgcatttttcaaaatcattaaaaaaaattctcattagaggataaaagaacaaatactgagagaatcctaaagaatctacgtcttcttgttgtgactgattctcaagcaaaggaaaaggaattttaaataaaggatttctgttggatttctagccttatagaagaaacattttccaaaatgctgatatgttttaatttaatgatgtgctatttggggtccattttttgtacattcatcatgattctaaaactgagtttggatgaaaagcatgtagtgcttgccttgttcttacatcagaagaattttttcttttgtccattttatgcttgtttccaaaggcttaaaatgaaagctttgtttctgcaataatggcttagtgtaggcttacattgttgatcccctcagtagatgcaatgtaatccactttggtaatgtgaatttttaaacaatcatcggcctctgccattaacccttctctgctaatgataatactctacaaaaactacaaagaagctcgggcctagcttaacattagacttggagcgcacttagctgaatttgcatttcttattttagcagcagtgaattgctgagcatatgttgaacttcatcaataccaaaagtagaataggtgattgtgaaactaatgttcaagtgcaagcattcaaacacaaacacgggaaactagaagaaaataatgatgaaacgaattaaaagtgctttccagtccaaaattccccttgaaggggcttcggctgctgttgctttttgcaatattttttaacttgacctgttgctttgcctagttcattgtagtgcaaatgtctcaaataaagctgtacatgagtcatttttttttccttctcagttcaggctacttggataatagctcactttgaacacaagcatgggaacctattgaatgtttcctgcataaagcctacagagctttgctcagtaacttgacatgtttctttaggagagagaaatggtaaattagctaagagtgattttattccatgacttatttccgaactaactttgagaacacatttccacttagtgtttggattccactctggggacttagaactaaggcttcttacgtatggttaagtaatatatatggtggacgactaagttaagatgttccttagagacttatagacatttaaagctttacctaaagtagagaggactttactgcaactcctattgaagctgcagtactgtatgccttcagggctgtggatttaataaacaaaagatctgtcaccaagcttggttcacagtagggggtagatgtaattatatactttaaaggggaaaagactgttgttattattttacatttattgagtgccaacattttgcaatgtgctgtacctaacatagaattagatacagtccttgcccagtggactatctatttaaattagacacaatctaaatatttctcttaagtagttcctgtgttttcaaatttgttacccagtgcattgtatgagtgtacaaaagtattattgtacttgcaaatgttatttaaaagtataaagacttttaaagacaggtggtgaaataagatgtgattattagactataaaatcgcccatgtttttcaggtctcttcctttaacaattattataaaactaaatttgaaatgaaaagcaggaaaaatattaaatttagaaaatgatggatgcatcatattgatttttactttgaaaaaaatggcagtgtaacaataatagcacttgtttcttgcttaactaggtttggaattatatttatttgtgtggcttttaagtaattccagtatggaattccacaagggtcaagatcacattttctagaagagtacattgcacctaataggcattcagtaaaaactgttaaaggaatgaatgaaatgagtttgcaaatatatttccatcttagttatcgttttctcaggactcttctgattttagagtcagaggaggcagtgctggactggctttgggccagcactaaaaaacaaaacaaaaaaaaaacaaaaaccataacatccccaaaccaaaacaccttcctgggagtatctttgaatagccctggtttggaatgcattctttctaataaagatgtttcttgtctctcagcaagaaaaagcatgactacccagcagatctccgacgcccgtgagagtccttagagctgtcctgatcctcatcagtgatcaaaggatcttttcacactggattcctggtttccagggatgtagtcactgtacagtgtagtcagtttactggtctggtgtgtagtcacacacaattcttaccatctctattataagtcaggctgatattaggggaaaatctacagataaacatgaagaagaatctataagttggtatatttatgtatgtgtcctggatattgtgactattttataccaactgctatattcccagccccaacattctcattcagtttcttcttggtcttaacagcgcacgtcagttcccagttgcatgactatagctattcatttagcagacagaaacaaggatccttggtgtcatggtggaatcactcagctttcagtttgactctctggactcccatttacactgtgttatctaagttattcaacttattctgagccccagcctccttagatgtaaaatgcaggaaacaattgtactgaacttgtcttctgtttgcttatcacatactcactgttctccctgcctcttgtctaagattgtgttccagaaatgcatttgtcatgttctcgtcactgaatctgatagtctcttcagccacttccctttccttatccccactactccctttactcatccctgttttgtcacttaatggaaggattttcctggacagttttaagctcctttcactctcccctcctccttcactaatatcacaaaggggttaagtgttaactattacatttttgtacaggatgtacagatctgcatagcccactccaacttctatctcaagctttacgcctttcatctccaactctgtgctagaaaggttcatccttctgtttttgagacaactccatcaaacacataaaagctaaatttaggccaggtgcagtggcccatgcctgtaatcccagcactttgggaggttgaggcaagcagatcacttgaggccaggaattcaagaccagcctggccaacgtggtgaaatcctgtctctgctaaaaattagccagatgtggtggtgtgcacctgtaatccagctacttgaaagggaggcggaggttgtagtgagactagattgcgccactgcactgtagcctgggcgacagagcaagactctgtctcaaaaaacaaaacaaaacaaaacaaaaaaaactaaagctaaatttaccagctctcctccaaaccaatgtcttctcttgcttttgctgtttctgttaatgatcccaaatttctccaaagaagcccaggctacacatcactcagtcattggatagtcaattgccaaaattctgcagattttcccaccacactatctttcgtatttgccacttctcttgtttcctctgtggctggccctcactaacgcttggctcccctgctagcaggaaaatcttcaggggctacaccatttctaagtcttaagtaaaaataggagtatatgagtaaagaaggagccataaaattcaagctggtgtgtaggaccccagtgactagcttctgacccagtggccaagagacctaaacacataaaggtcacttcctgactctagagctcaatgaggctgcagaaatgagatgcctttctgagagaatccaggagaagtactgtgtaatactggttcactgcattggaaccatgcgggaaaattcataaagcatgaaatgcgtgggagcaaatgcctctttgtgttcctagttagtgccactttacgttagaccttaccgcctcatgcccagattttttctattagtcactttcattttgcattctctctccctacaaattatctgccagaatcatttttattcaaatctgattcctaaactcatgtttaaactttatcagtggcttgatccatctgaagggacagtggttctcaagtgtggctttgggaccggtagtgtgaacatcatctgggaattgttagaaatgcagactctctggcccagaccagatctgctaaataagaatctggaggggtggggtcctccagttaattctgaggcactaacaactcgttgaaagccagtgctttagctaagatagttataaacatagctgggctttcagcatcctactcagtacaggccagccagattccagacttgtatttcctgctttcctctatcaccagaacctccatttcatatgtgaacctccaaatctcagacaggtttcagtcaatttaagaagtgtattttgccaaagttaactacatgcacccatgacacaacttcaggagattctgatgacatgtgcccaaggtggttggagcacagcttggctttagacattttagggagacatgagacatcagtcaacacatgtaagatgaacattgattcggtccagaaacgcaggacaacttgaagtagaagagggacaactcgaagtggggaggggtcatcaaggtcataggtagataagagacaaatggttgtcttgaggcccccaaatttattttcctttcactcataatttagccctttgtgaatgcaggctcctctgtgcttatcaggtttttcataattttgagtttttttcttttgcttctttagtccagccattttttcaagtctgtgtttatgcctcacttccatgaatctcttctgaagtgaaatcctatagtatttatacaatagcaatactatttaagagtggtcatgcattattccctttgatcattatactttatgtcttatgccccaaaataagctctagggaaagaaagtcagtgtctctgccccattttaattccccgcagtgtctagcacaggacttctttataggtttcggtgatgaatttcaggactacagagactaatggtattgaacactctgggctctttattactccatgtcaatacaacttcaccttctaaccaccagctcttagggacactgtttgtaaaaggagtcttctacatcagtggattagttgagtaccattttaaaaatgcttcagagtttgcaaagtactttcatagaaatatgtcattagatcctcatcacaaccctgtcataaaagtgtttttattatctccattttgcagacaaaggaactaaaaccggtcatgtttaaaagtactgctgtctgtgtgagagtggaaagactatggaggttagagcaggaatctcctatctaggcaaagatagtaaaaatttcagttccttttgtaaataatttcagctaaaaaatgtattgtaaccttggatatgcagggtatttattcgtatcaagactctgatatcttgctttccaggcaaaagtaaaaccaaccttttcagttaactgtagttgaagagaaaagagtggattctgtctttggatgaggatattaacatttaaaggattggaaacaatgatcagaataaatgtttatatgtgcacacatgtatacttacaattaatggcagagctttaaattgaattgaaatcaatttattgaatgaatcatattcaaaatactttataagaaattttatcattaaggcaaatacacatggatatcagtctaaatctgatcttttttttttcccctgagattttccacaagggaagtggaggaagaaaacagtagaatataacatatacaataccggcctccagccacagtgctacttcccttaaccgtctaaggaaaataaatatatattatgttccagttcagttatctgtagcctgtagttagagatagaaaacatatcagattgggcagagtctaagattggctggcataggaaaaaacagaaacttgtataagctaaatcaagttatgtcactcgaactaccataaaatagtttgtttctgatttttcctctttaattatccccatgtgccttgcacagtatattgcatatagaatgtgttcagtttgtacttacaaaattatttgatgtatacctaaaacaatattttaaatttggaagttcataacatgatcctgaaggcactttggacaatttttgattaatgacaactaaaacttttcaaggcagaccactaaacacttaaaagcggggaagaaacaataagattgtgaacacttgcggggtaaaatcaaaaagcaagtcaagagcataggggtggcgaaacagagcttgctgaagggtaaggctagccagtcatcacagcacgagcaaaccagactgaggactgaatcatgtgacacttgagatccttgcgatagagtctttggagcctgggcatgacacaaccagcttgctatgttgacaaccccagtgcattgagacaatgtattggtgaggtgctgatgttgtattggtgaggtgctgatgttgtattggtgaggtgctgatgttgtattggtgaggtgctgatgttgtattggtgaggtgctgctcaccccgaccaggccatttccctgctctctttgccattggtgttaaagcagaggaagtgattatagagatatccttttaaaattcttccttaaagtaacggaatgatgtaaccaaagggcagaaacctgcaagtcccaaatcattcctgaaaatggaatcaggaattgaaaagacatgggaaagagatctgttgtacagcgtgatgactatagttgatgacaataaataattttcttgaaaaatgcaaagacggtggatattgcattctcatcacagaataactatgtgatgtagttcgtgcttttgttaactagctaaatttaaccattccataatatatatacttcaaaacatcatgttgtaaatgataaacatatgcagtcttatacaaaggacacaaaggaactgttgaagctggtgaatatgttcactactttgattgtggtgatggtaaacacagatgtatgcatatgtccaaattccccaaatgtgcatcagattggtgcaaaagtgccacttttaatggcaaaaactgcaattatttttgcatcacctaatacgttaattatattttgctttttggtctagttttcaactatatcttaataaagctggaaaagaaaagccataggaagtcaggcaggctttttctcaccctcagctcctcttcctccttctctccctttcctttttgctttctcttttcttcctctccctcctaagctctttttccctcctactttctcacccctctaaccctgtccttcctctgcttttttctaccctcatcttatctttcgccatatacaaaatcaagcaatggtggaagatggctttcaaactgctctcaagttgatcttacttctgctcaagggaacagcctaaacccagtaagaatactcagaaaaatgttcttggagaaaaatatctctgggacagctttagtttggtgaccaactctgagccactcacctgtggccaatggcaagattagtagtaaatgcaaactcaccacaacatgttgtagaaggtcaggggtagggtgggggtggggggtgggaataatcttaaaaaaaaaaaaaaagaatagaaagtagaaaaagcctaggcttaataaatgccctggaaaatacctgcaacattaacaagtgccttagaaaatacctacaccattcattcttatattcttacaaatttttacatcagattaccaaaagagagcatacctaacgcatgtacttattttaaagcactgcttttatataagtatgataaaatattttgccctaacttcatcaaagtttgttttcagaaacagccctatctagaacatttgaattttgtttttgctagaaaggacaccattccttcatcatactgtttggtatctttcatataaatctcaaaacaataaatacctctctgagttcaaagctaggaaagaaaaactcttgatgagctattgtttctttttttatagttgaccataattttatacatgcaatgtgaccaataaatatttgctttgtggtggaatacagtgatgaaagaaatatactttatttagccctttctctggcagccaaaaatttagtgcttggttttgtgttaaatggcagtggcttttcttagttaagtgtttctagtatattcttgttcaccccgatttactattttaatgctcttttatgattttactctgtctgtgcccttaaaaaatctgttttggaagatgctggagtataaatagcatagaaagtgaactgcatattctgacatttacagttctaaggataattctattttaaggatgattctgtctgcaagtaaagttattagctatctatatactatatgttttagacaaattttgattgtcatataccttttctcagactctatctactgtgtcttgtttattgttgttgttgtttttcttcccataaaaccatgtctcttttacacaagaatgtgtaatgactcagtctgacttagtttattattaaactgatgtttcaaagggcatttgattcttctgaacccttccataggccctaaattttcttaattgtaccaaatcccatatggatttctataccccagaaagtatggctacccgtcttgctcatttccaactttgtgcttttattttttctggttcttgttgcatgtgcttgcattttttccttgggttttcaactactccacttctgccttgtctttcaaagcctggcttaagactaacctcttttagtaagacttacttaatgaactctaagtgactcttattctgagtcttcttggaattatctactcagtttttgttctattaatttgcccttatttgtttgacatgttgaaagcattctgaaacctttttttttttttttttttttttaagtacatgaatgagttctggctccagttagaaaatttgataattgtttcttagaatgtgtcttcttttcctttttttattttccccaaaccacagagtttaatgtgctcattaaataatattggctccctaattcttagaaagcatagaatattgattatgtttgtcatagcaaacattttattaggaaataacaagataattatttttgtaaaatttaaatttcatcttaaaacggtgaaactcatttttgttgtagttatacattaaagcatcccaaacagtaggtttctaagccagtttctttgttttccctcctattattcatattctttccagattgaggcatatggctttaattatcaagtatatgctgaggatatgcagagctacagcttttttcctgacttttctaatgaagccagttcctaacagcaacatttgccagaatattttgttgtattatgacattaaacatgggccagcagaggtctggctaattgagaatgatacctttccccttccaactgcttatttactttccacgaagctaatttagttcagttataaaatcaaacctcataatacagtgtaaatgagtttgttcacataatatcaattgctaggatggggaaaatcctaaaaataaataaacaaaaattccaaaaaagttattttagaaaaattaataaatgcagctttgttgcttttatttactacctgcaagactggaaatgacatagagtaattgtttttcttccttcttttaataattggcaagcattatttgtaattagtgggtaaattgcttataggcaaagacttgctaaagagctttaaaatcataattttatttcatttcactggaaaatagaattatttcttatgtgaagtgataaaatgttttaaacttttataaccaaattaagtaataaatattatagatatattttatacttacgatgtatgaaaacttgaagccatgtgcacttgccaccactgcccattccattaattatcatcatccatctcctttgaattatgggactctgatttctgtcaaagcagaacctgtgttgcctatttcatacatgttggaaatctaaatgttgtttgcaaatttggacttttgaattttgctctaatggctgcatactaattttatgaacaatgccaatgactatatggaacatgatgcctttggcttttagagcatattctacatcaataagttacgcaatgggagagtcaacaggactcctgagaatgcagtggccatcaaagtgtgttttagggaacgtaagagtttcttagaactaccctacaaggtttctgggagaagaagaaggttattggtcaagttagaatgtccatttcagttctttgaatgtttttaaacaaaatgcagattcaaattgtaagtaaattttgaataccactgagttcaaaagcttctttcgtagataagaaattattcaaacaagtaatttgatgaatgacacataggaatattttgctaaggcttgaatttgaaccagtactataaattcttagaggatttatctttcattgcaagttgaataaaattcgctccataaagatgtggaatctattttgatattttaatgttaaacaaataattagtttttgaatttaaaaggtggaaaagtaccaaactcctaaaatttgctataaggttcaaaaatgttagttaatgtactccatattgtgtttgtagattttctaatttgtagtctttatctagctctaattgccagttttgctgcaataaaaacaatagaataagaggtttacaatttgaaaaaaaaaattatatttgaaaattgagtttgggtatgtgggacttcaagaaaaatatttttaaaacgttattagattttacttatgtcctaagcactccactgtatattgtggatttaaaaatggagtcaaataaggactccacaattaaagaattcagaattcaacagaagtgacaatctaaatataaactgtggtatgatggtgatgctattgtaatggataagtgactttgagctgggccttgaactgaaaatgagaatgttccaaaataaatgtgtgtatgtacatgtgtgcacacatgtgcacatgtctgtgtgtctgcatgtgggagcgtggaaagtggggagagaagagaaaggcagaagaatgacagagagacagagatattaattcatggtgatgttaatcaagttatggaagctggagaataggacagaatatggggacatttgtgtcacagatatcttcagctaacgaatgtccactagatagaagatagcttagcattcaggcaagtagttaaggctggggatagttacctgtttattcattcattcactatatattatagggtattaactgtgcctcaggcattgtaataggaacaatattagggaaggaaatacgtagatgaaatgacatggactatttctccaggaaatttacagtccatcaaggagacaaatataaataaacattataacttaattattataataagatgattatattagaataattagatgaaataagatgtataattaaaatatatgatttataatcatgttagaataactttaatttttataattctaaatacctcattcttattaaataaggagaattgttttaccacaggtgtttgttgagagtgtttattccataagagaagatcaatgtatgtatactatctagaagtcttcacaaagaaggtagcatttgtgtaaggattgacagatgatgttggaagtcactgctagcatactagtaaaatcataggactagagtctatttaaatataccagttaagcatatatttggattggaaagtggattttgctcacatctctcaaagttaggctttgaatccttgatagcaaatgcccctctgggtaacagtctaagctgatttgatcatacatgtccatgatgtttgatgttttcatggcactgaaaataatcagacaggttctaataatttgctgaggaataatatgctagcatcataaccagcctcaccagttgatgatagtttttcattgtatctcaaccatcctgagaagtaccatgggctagttttctgaggcctttttctgctctcatgagggttttcttgacctgcgtgctcttttcatggcttttccaaattctttggctatcctaattttatcattttttattttcttctttgcctcttttatttcctttttctttaggttttcattccattttcttattgttttcccatgtaaaccttacaccatagcactgtattacatactttctcattttacacttcccttaccacaaatttggcagtgttgattgtgcaaatctagctgaatgatcaatttattctgtggttttttttctttatcaactggtatgtagatttttcttttcaactagtttagaataaatcaatattccaggaggcaacatggctcaaattagaaggtcccaccaaactcctttcctgcatataacttattgttggtttaagatctccaaacaccactgaaatcttaaatgtaactgtgcaaagtatgaaataaaagtagtgtattaggtgataatgatgtggtcggtgttagactagcactattgtgaattactcctcactataacacaacatcagttttggattttgaaaaattagttatttttcatttgagtggtatcttagaagtttagagagttataacttatgattcatagcatgtttgcaaggaaaaatgaattaatagttttaaagcatttggaaagcatgaagtgtcaaatacataataattacatactctcagaagatagatatttatgtttgttagcatatacacaccaattctaatttctcacagttggttttgtggattctttgatttgggaatggtattttttttcctatttccagaaaattgacaacatggggggaacatggatagtattaattcataccacaagtaaatcatttagaatttaagtgtcaagtcatggtcttacagagttagaaaaatcttgcagatcatatacttcattacttgttaaggaaagagacatcctaatatatagataaattcattaagtggcttagccaaaactggttcccatgcttatgttaaaattgggtctttaattgcagttctcttcaaagtaagcctgtaagaaagtcagaaaataaaccaacagacaaatattccgtagacaactaaatttccgtatctaacaaaactcagctttttattgaggaaggacacatgactgtgttgtaaagtgattctgcaaatttgccaaaagcattagaggaaatgtcctgttgttatgcagtctcttttatgatactagacatgcctttttgaattttcagtaaatttcataaagatttctatgaattcacataggaaaaaacagagaaataaattatgatggcataggaaaatattgatgctatctggaggtaaaagaaatttacatcagaaaaacacatttccaatacattttccaattattgctatgaagtgatattcgtttacaaaagaagtgttattgattgatcttcaggagtaaactagtgcaacagtctataagaatgttgcattctccctgagaaaaggaaattttgtgtccatattgttactataattttcaaaatctattttgctaaatacatttgttttcaaatagtaattacagataattatagctaacatttctttaatactgtgatgtcagtcactgtactaagggattttcatgagtttgctcactaatattttcttacatcaatctttgccactagattttttaaataagagctttcttgaagtataattcaaatgccataaaattcagccttttagagtatgtaactcggtggttttattatattcatagagttgtgtaaccatcaccccatctcacttttgaatatttgcattatctaacaaaagaatcccagtacccattgccagtcactttttactcttctgactcctcctggcaaccattttctgtctccatgtatttgccaattctggatactttatgtcattgaaattgcacaatatgtggccttttgtgaatggcttctttcacttagcaaatattttcaatgttctttcatggtttagcatatattggtaagttattcctttttactgcagaataatatttcattgcatggatatgccttactttgtttatccattcaccagttaatgatcatttgggttgtttcctctttttagctgtcgtgaattatgctgctatgagcagtcatgttgaacttttgtgtagaagcaattgtttccaattctcttgtgtatatacctggaagtgttacttatttcctttccaatctggatgtcatatatatgtgtgtttgtacacacacatacacacacacacccacacttttgcctaattgccctggcaagaacagaacttttagtaaaatgtgcaagtgaagtggagagagcagatacccgtgttttattcctgttctttggggaggactatttttcatagacaccaggatcatgagccagttgatttccaaacctgccctggagctggaaagaggggagtagtaatagacaagttaaaacgaaataaagggccaggtgcggtggctcacgcctgtaatcctagcacttgaggtcaggagttcgagaccagcctggctaatgtggtgaaaccccatctatactaaatacagaaaaattagctgggtgttatggcaggcacctataattccacctatttgggagactgaggcgggagaattgcttgaaacctgagttgcagtgagccaatgttgcgccactgcattccagcctgggcaacaaagtgagactccttctcaaaaaaaaacaaaaacaaaaacaaacttgctgtttttattgatatttagctattttatttgaataaattatcctcagattgttgcatgactgtgattttcagagatctgaaaaagttgattttgataatatttgtcattgcttttcttgagtaaaggacttcaaaatggttcttaccttaccattctggacgtggcataagtttttatgagacatattttaggggcagaaaagggaaaacttagtgtaaagagaggtcttatgtaagtattattttctatttttaaaagaaaggacataatattttctgcagaaatatttcttaacatatattatctcctaattttcttgaaaattttagtatatttaagactatcagtttggagttaccacatgatgtaagtttttttgtgctttagaaattgtccttttatttgcaagaaaaagtagcatatttggaggagaatacccttatacatattgaaatgaaagccgttaagctttatagcgtgcttttagattcttctgggggaaaaaaattcaatggactaataattgactgagacaccttttatgttttattatgtgagctgagaacttggatctgtgctaactttctcgtcatcaacacactgtatttttaaacaatcagtttctttgggtgaaataaatctcaagatagaattcaatttcttactgctaatccagaatatgcccttgaatcattctttaagcactctttttttaaatcattgtatgattatgcatatgtttcacctccttgtttctccctctccctccactgaaaacagattgactttgtagtactctgcaatttgctttgccagtcacattctagcagctgaaaatcatccttgcttactttgttctgaataactctgaaccaggaatttagcttgtttttaaaatctgttaactgacagatgtttctctataggcccctgttgtcacacagaacaaagagaaagatgctttagccagttcaatatgccaagaaactgatttttcactatttggttcaagctttgagccatagacagttcctttattaatttgttttgaaaaataacacaggtcaaggatacgatgttgtattgcttttatttcatgtgtaaaggttgcaattatttaggagaaaacattatgaaaaatggtttcagaagaaactttattagggactagttagaaatgtttgtcaattgcatttgctttggattgttgcctaatagataacaagaaataggtacctactgcaaagattggtgccaattgatgcaattagttatagctttgaagtaattgttcagcaatgttttctaagctcactgtgttctccttgattagtgaatgagagaattcagtaatttgtgtattgtattttccctatgtctctactttagatcatttttaaaatcatcatcccatctctagagagaaaatatggttatccctcgctagagaaattaaatactgagggaaaagattatgttgcactgggttgaactttggaggccacaatcgtggtaatatgtaagacttttgcacccccaagaactgtttgcttcattcgggatgacattgtccctgttgagtatgcatgccttgtattgtctcttttaaaactatgttttaaaagttcatgatttcaaactagacaaatgggattgcatcaaactaagaagatgacacagcaaaggaaacagttaactggaactgaaatccttcttaccctagtatctcaaaacctactttaaaaggttgccaataaagtataatataaaactaatttttaaaattgtttaggagagatatctgcccttaactgggtggttccttttctaattggtatgaactcagttaagacaaattacataatcctacactcagaggtaaatcatttctgttttgtctgcaaaatatcaccttccttgaattcattgtaactccctgaggtaaaaaagtccatgttgaatttatctttatatgtccatgcattcttcttcatactctttgtacctcagtttttcatagtatggagtccaggaattagactgtctgggtttgaatccttgttacacttattactactaatatggcaaatcaattaaaattctagaagcctcagtttcctcatgtgtaaaattaggatgataaaacctcatagaatagaaaggtaatgcatgtgaagtcttgacatagaatccagcacactgaagtaaggcttttcatatgtatagtaattaataaatatgtttcagggatcgaataaataaactcagaatcctctcatgcagtgtcatcaccagttaaataaattaaatactagaactttcatcttagatatatgcaatggtgttctttctgtgtagtcccaaagggctggagagagagcacagtgttaccaaagcccagtgagagttgatgttgaggaatgggggtccctcccaagtcacctgggaatttgggagctacaattcaagatgagatttgaatggggacacagccaaaccatatcagggagcttgagtgattcatctgcagagtcaggattatggtgcacaaatcagggcacagaatggagactggagctgcagggtgaagccaaacagaatcaccggtgtgcatagtcagtgtcagtactctctagttttaaccacagaagttaaatcaatataaagtagaaatgaaatggcatggcttattattcaatgaatgtttgaaatgttacaatgccatataaatgattacctttttgataatatgtgtaaaagaggaccatagttgttattgagcttatattatgtaacagggcgggttaaaaaatatgagttgaaatattggagctgtgtacccttccaaaaaattgttttgaagttggagcacaagatggaaatatttctccttaaaacacaattcaggagtcaaggaaccagcactgggtcatcagatctcaggttggaataatatttgttgtttgtggctgagtgtactggagaggggtgataaaactgctcaagtactcctagtctcaaagcaaagtagatttgagtatttaaatggggctataaccatcagatggaaaaatcagagaaatattactgtctaaggactcataggccatagtcatggtaataccattaataataatatacaattaataataataactaccatttatgggggactacatacatgcccaacatgatggtatacctttaggtaattttataacaatgtgctgccaatgacaactgatagatgtagagaggtagaaaactgagtttagccgaccaacatgttattcttgttgtatctaggatagggattttcatgacaaaaacctaccaagttatattccaggtgtgtagggtgatacagtgtaactttccattccatgatgacattctaggatatcaaagtgggcacatagcccaagcaccttcatcaaagtaacacagtctttgtgttgcgtttctagccacctcttctcccaggagaagcctccccaaatttccattttaatgagctgaaattagtttttcctttaatatgtgaagacacacaataacaaagacttgcaaccaacccaaatgtccatcagtgatagactggattaagaaaatgtggcacatatacaccatggaatactttgtagccataaaaaaggatgagttcatgtcctttgtagggacatggatgaagctggaaaccatcattgtgagcaaactatcgcaagaacagaaaacctaacactgcttgttcttactcataggtgggaattgaacaatgagaacacttggacacaggatgggaaacatcacacactggggcctctcatggagttgggggaggggagagggatagcattaatagaaatacctaatgtagatgatgagttaatgggtgcagcacaccaacatggcacatgtatacatatgtaacaaacctgcacgttgtgcacatctaccctagaacttaaagtataataaagaaaaaaaagaaaaaaaactgaaatatgaagacacagagtatacagtgaaggcatagacacaactgagcaccagtttgcacatgttccaagtgtgaggggctgcctgcagcccatgaacttttcagtcacttactttcctccccagtcattaccatggtcatttgaaccgcatttgcaacattttaattttaaaaatgttgacaccatgtgggaattccacatgattttctaaacatttttagtgcctgataaaatttttgtttggatttggctcctgagaatacagctaagaattttatacttttcttcaggggtccaattgcttcctattcctcttataagagttttcagagtattttattagaattcttttagtaaactactgcaataggaagtagttacatatttttatcactttttagcaaaggctaggttaagtagtgtattagtctgttttcactctgctgataaagacatacccgagactaggtaatttatacaggaaaaagggtttaatggacttacagttccccgtggctgggaaggcctcacaatcatggcggaaggcaaggaggagcaagtgacatcttacatggatggcagcaggcaaagagaaagcttgtgtggggaaactccaccttatgaagccatcagatgtcatgagatgtattcactatcacaagaacagcacaggaaggacctgcccccgtgattcaattacctcccactgggtgcctcccagtgggatacccagcacagtcagtccttaccacataaagacctgcccccatgattcaattacctcccacaacatgtgggaatttaagatgagatttgatggggacacagccaaaccatatcaaatagcaaagagcttaagtaattgacactggatgaactaggtagataattatagagtcaggactgaaacttagataacttgacatttaattcaattgtctctctagactagcttagtactaaaaggcaatactgacactccacataaactaagccaaaattgggccactaaatagtttcaggctcacatatacatactgagtaagaagcacagaggttgatctcaacatgtagcagatggcttctatattcttaagggataaaactttgagatttttcttttgctccttgtgtgttaagaagaaccaaaacactttagaggtcccagtcaatttgtgttttaaaagaaaaaaaaaatgatgccactaaatacgccagatttttcagtggaaaaaaccctaagttcacagcaattgcttgaaagctgctttaaaaattagttgtaaatccaaggaaaaggaaggaaacctgaaaaatgtcactcatttgaaaagggatgttcatttttgataaattattaggtaatttttcaaggatatcactcacaagtaaagatttttttggtatatttaaatgattcattttcagtctctcatacatttttaaattgttctcattcaagttgtcacatcctgacagggtttcttataaggatttctcttcccttgtgttagaattacagaggatgaaagtattttaaaatctctgttgctgaacagggacatgtgctaggcagcctacaattgtcagttttattccataggtacgttagtggtcagaatgacttcttttttgatggcacaattattttcataatattagattgaattaagctggtgagacaatctgtccctaaaagattcagaaaatgacgctttgatgttagctttgaagcagggtattcccagcatcacatttagtcagaaatatggaaggtatatgttaacatgatttacatatcctactctggtggagtctaaaggtaaataacagaaataagcaaggagctatgcagcaaggcaaattcacctttgtttcttgacacaaacagtgaagcttattttgggaataatgactgcatatgttcaggaaaattgggctcatgagtctactgtcagaacatttttcagaaaagagaaaaatgaatgtactgctgggagacagcagggaggggttcttttattatatacacaatctcttcttatgagaacaaataccaacaatctattattgttcccttaattaataaatcattactgtgggctgggcagagtggttcatgccaggaatcccaccactttgggaggcccaggcaggaggatcgcttgagtccaggaggagtttgagatcagcctgggaaacagagagagatcccatctcaacaaaaataaataaaaattaggtaggcatggtggcgtgtgcctgtagtcctagctgcttggaaagctgaggcaggaggattgcttgagccaaggaatttgagcttatggtgaggtatgatctcactgctgtattccagcctgcatgataaagtgagacactctcaaaaaaaaaaaaaaaaaaaaaagaaagacattgtaatgattaaatatttagaaaaaaatcacatacactgtacattctgtatggattacaattatttctagtattgaaaaggtaataaccaactctttaacatgataatataactgaacctgatttaatttgtttttttctttggataagggagtggaggattacaatttctcagtggtctacttggtcacatatatttgttaaaagccattgtatgactgaaacaatcttagtgccggggtgtacacagtaattgaacacactccctgctttccagatactcagaatttaatttcaagaaaggcacagcaacaagaatttcaggagcaaaagggtatggtactaataacgcttgggctgtttggaggaatcttcagaggaaatggttaaagagactcttagcaaatgaatttctatgtgattttcatgtggactctagggcaaaggacattcccagaagggatggcaacaagcacaagtttgaagtgtatgaaatggcattactctttctaggtagcacaagggattagatgtggctgaagcatagattgttttgaagacattaacaagatctaagtttctaatctaaagacaggccatgttgtgatcatgaaatggcctgtagactctcctatggtcttggatttctatcctgaagaccccaagtcattgaaagaaagggaaagcagtgtgatttaaaaaaaaaagaaaaaaatctaattgagtttcagaaacaccattctggtttttaccacattgtatatcatcgtatgtctttgtagtatggtacctgacacattgtcaaattaatctaaggatcattctaattgcctttaagtatagtaatttgttcatagttcattactaatcccctccatctataatctgaatacctttcccatcaatcttgccttctccaaaactttcttttctcctttattctctttctctttttaaaatttttaaatttgctttctgttttaaatttatgtgggaacgtagtaggtgtatatttttatggggaacatgagatgttttgatacaggcatgaaatgtgaaataaggacatgttggagaatggggtatccatcccctcaaggattcattctttgagttactaccctttctttctcttaatctaagtgtttcccttctgtactaccttctttatttaatattcttctaacccttgggaagagaaggagaaataataaccacaaaaacaaaatcaaaaatccctggacatattaatttatgtgtgaccattcttcatttatgtattataatccttttaaaccaagggagtatctgtatcttgttcattcattaaatatttattaaaaaccttgtagtgctacttctcttctggatgtttaggacatattaataaacaaaatgatccatgatacctgccctcatagagtttaatttatggccagaagagatagacaaaaacagtaacataataaatattttttataataaatatatattttttgagatggagtctcgctctgtcccccgggctggagtgcagcggcgagatctcagtccactgcgagctccgccttccaggttcatgccattctcctgcctcagcctcctgagtagctgggactacaggtgcccgccactagacccggctaattttttgtattttttggtagagatggggtttcattctattagccaggatggtcttgatctcctgacctcgtgatcggcctgcctcggcctcccagagtgctgggattacaggcgtgagccaccgtgcccggccaataaattttgtaatatattagaacacgttaagttctatgggaagaaaaaagaaagacggaatgaggagggtagggatggttggtttcaatttcaaatagatagctagataagccttactaagaaggtaagatgaacaaatacagagagatacagatgcctggggatggactaaaaagacagccagtgtagggccttcaaaacaagttgccactagtaccccaaatgctgaggaccttgcactttgtaggagtatttgaaagtatattgaaataaagagcaaggggtcactggccttctgctcagacgcatagactttagcaaaggagagctgaaggaattgtgttccccttcagtacccatggagaatgtgtcctctgttgtgtaagaaagaattggatgagatattatactgagtcaatgtttgtaccataacaccttatttttccttagacagacagtaaagcaaccactaagggtgcttaggcagccccacttactgttttgtttactgtaacttttagtgttcaccaaacacatcttcaagggcattttaaatagacttgttttcaaatagagtgaaagaaaatttccgcaagacatttgtcattccttatttccacacgaaccaggagcagcaggagtgagtggagaaatccatctgcgagttaatctagtggaacaccactgagtctgatcatttgacagaagtaattgtatctaggggaagtattcaggtctctgctttgtggtaaacatcctgccctcctaaaactgtgaggttgaaaaagatcaacaaaacagccatttaacgcattattgacagatacaagttttagagaattaatcactattaactaactgtattacatactcacacttaatactagaaataattatagcttctttaggtatgaagtagatttgtgtctttacttctaattctctaatcattcatgaatttgctgaatttagattctgtttcagttaatgtttgtcaaataggatgttataattttcgcatgaaattgcatttttgtctacatggttaacttcctagagtttgttcttttctggtagtcaaaatctatgatgaatttattaataatgatattagggtaaaaaagtcattgaacatattttgtgttcagttcagtgagttgaattcagttgctagatttctttgtataactgggcagattaggacataatttttagaaagtgtaccatttattattactagttaattaatcacatttctaggaaattagtgatttcctttaagtttatattccactgtgggataaaataaaattaacatctgtttagcattgtatgccaagtatggttgatgatgcagatttcatggatgattttactaatagacacattaaaataataaaaataaaagtaaattttctaataattccagacaatatattgataaatactaaaatggaaaaatgaattatagtgttgtttatttgagtgttgatatctgggataatcaaaacccatcatatatgctaacagggttttaccacatcatttttcccatacagaatctcacatagctttacatttgagaagaggtggaatttgactcacgctatttctaaatctgacttttatatcataataaagtattacctaggatagaacttttagcataaatctaattaatctatgatttagaatctagatttgaatatgctactttaaaataaaaatattgatttatttattccttttttaacctcttaaaatagatatcttatagttatttgatttgattctgccattcatcgactatcgcactttttttttttttttttttttttttgcacaaatacacgttctaatgtcggtccatgtgctggagatacaggcataagcaacagcagggttgactagctgtggatagtggtacatgattagaagcctaaatgtgtaagtcaggaaactaataaatcctgcctgccttgcctgccttttcttccttcattttctttcttttctttctttttttctttcattctttcttttttccattatttttgatgcattatacttgtacatattttgagatacatctgaaattttgttacatgcatagaatgtacaataatcaattcagggtgtttagggtatccatcaccctgaagagagggtgttcctctcttctagctattttaaaagtacagtacactgttgttagctactaacacttatactcttctatcaaaggttaggatttattccatctatctaattgtatgtttgtacccattaaccagcctctctcttcatcccccaatccactcatacacccttcccagtctctgatatctatcattccactctccattacttcgtggggtcaacatttttagctcccacatataaatgagaacatgtagtattttctttatccctggcttatttcacttgacgtaatgatctccatttttattttattttatccatgttgctgcaaatgacatgatttcattttttatggccaaatagtattccattgtgtatgtatacgcaatttatcctttcataaccctgtattgctgataatcacttagatcttcataaaacttttttttttcttgagattaagtctcactctgtcacccaggctggagggcaccgacagcatcacggctcacagcaccctcaacctcctgggcttaagcagtctttccatttcagcctcctgagtagctagggctacaggcatgtgccactgtgctaagctaatttttatatttatttttttgtagagacaagatctcactatgttgctcaggctggtctgaaactcctaggctcaagctaccctccctctccagcctcccaaagtgttgggattataggcatgagtccttaaaactaaaaaaaaaaaaaaaaaaaattgacattcattcagtaatctattattattattagtattatttttttgagatggagtctcgctctgttgtcaggctggagtgcagtgtcatgatctcacctcactgtaacctccgcctcctgggttcaagcaattctcctgcctcagccgctccagtaactgggactacagatgtgcaccaccacacccggctaatgttttgtattttggtagagatgaggtttcaccatgttggccaggatggtctcgatctcctgaccttgtgatccactcacctcggactcccaaagtgtgggattacaggcgtgagccaccgcgcccggccacaaagtatccttttaaatatagttgaaaccacaaagggaaatgtggtgtttttgctaccgtggcttacaatccaggagagtagacagacacctgatgagacagatacccctctgataaagttgacaatgatgtaagtgctataaagagaaaatgagtttctctgggattggggaagtgagaattcattttgattagagcaatttgggaagaattcttggagaaatttttttaggtattatacacgatttcatggtcttctccaagattttgatatttctctcggtctctctctttcattctctctgtctttctgcctgcattgaaacactgctagcaaaaattttgatgttgccagggcatataaggctttaaatgaaaggaatagccatctgttgtgactgactgaggcagggagagtggatatgtagtcaatattttctctttcctttccttttacttccaaagtcttcacacatgatttgtatcctttttctgtctccctcattgatatcctggaatcttttgctctgtccattctagtgaactgctttgtgaatggtcactgttgaacttgacttagtcaaatataagaacttctaatcatactaatcccctttaacctctgtgggttaagagatactactgataaccctagcttctgaaaatcattttctcatgagagtttctttctgttattttttctgcacttttcttttgtttaaatatgaaagatatttttctcctctaatgcatttttggaagagaacatgcttaattttaaattctgtagtgcttaccttgccacgtgtatgtatgtaatagaagctctataaagatactgagattaattttgggagtgattatattggtcatacccaccattaattattgatagtaaaatacataagttatgtggatagaattaaactaatatttttgtgaaataatacaaatatctatgttttaaatcaaattaaatttgattttaagtttgcatcctatgaggcaggtaagaaattaaatctcaatcattatggcacacctccccaaaaataaaatcctgtgagaatagaggatattgggtagtactcagaaaataatggcaggtcttctctctttagtctgtcttggtctgtgctgatatatttttatccacatctccttgaaaacctgtagctctttggctttgtgcctcaattagagcacaggaacttttgccaaggttgggagcttgaatgtccaggtccagcatcctattgcacacttttccctgcagaaaccctgctattcactaatggtactttaaaaatctggctctttcctggtctggaatacttatttcttttttttttccttttttctttttctttttcttttttccttttttcttttttctttttttttgagatagagtctcactttgtcacccaggctggagtgcagtggcgtgatcttggctcacggcaacctccacctcccgggatcaagcaattctcctgcctcagcttcctgagtagctgggactacaggcacacaccaccatgcccggctaatttttgtatttttagtagagatggggattcaccatgttggccagaatggtctcgatctcctgacctcatgatccacccacctcggcctcccaaagtgctgggattacaggcgtgagcacccacgtctggcctgaaatacttatttctatgtgactcttcttgatcccctttctcctatcttcatggagccagtttcctgaaaagaagtaccttgaagcaagatatctgtagactaattctgcatttgcccttgtaatccaaagtttctcaacctaggcactatttatttttgttgttgttgttgttttggagacagagtctttctctgccacccaggctagagtgcagcggtatgaccatggctactgcagcctcgaacttgctgattcaagcaattctcccatctcggcctcccaagtagctggaacgacaagcacgcaccactatgccctgctaaattttaaaatatttttgtagagatgggagcctccctctcttgtccaggctggtctccaattcctgggctcaagctatccgcctgcctcgtgctcccaaagtgttgagattacaggcatgagccatcactccgggccactcttgatattttggaccaaataattcttgtatatgagaagctgtcctgtatagataccagtagcatccctcaattgtaacaataaaaaatgtctccagaaattgccaaatatcctctgaggggcaaaataacacctggttatgaaccactgttaaaatctgaagttattgaggtatgaaagactgttaataaattacgctgtaacagatatagtgttggatgatgtattagggttctctagaggggcagtactaatagcatatatggatatatgaaagggagtttattaaggagaagtgactcacacagtcacaaggtaaagtcccatgataggctgtctgcaagtcgagaagcaaggaagccagtggtggatcagtccaagtcccaaaacctcaaaagtcaggaagctgacaatgcagccttcagtctgtggccaaaggcctgagagcccctgactatccactggtgtaggtacaagagtcttaaagctgaagaacttggagtctgatattcgagggcaggaagcatccagaacgggagaaagatgaagaccggaaggatcagcaagtctggtccttccacgttcttctgctgcttttatcctagccaagctggcccctgattagatggtacccacccggattgaggatgggtctgtctctcccagtccactgactcaaatgttaatctcctttggcaacaccctcacagacacacccagtaacaatactttgcatccttcattatgatgaagttgacactccgtattaaccatcacagatgataccaattatcctttggaaaatatcagaaaatgagtcagattagtagccagatggaagatggtaaagaaaaggaagcggattggcacttatgtgtcagcaagatgttattgccattttatagagcactgagggattgtttgccatggatgcttctctgttaggtaaaggaggcagggctcaagcccacatctattcaaccttagaatcccaggacttttcatgataccatatactgttccagctatgtaactcactttgccaaatatttaagtacataattaagaagactgaattcttttttttatttgtataaatttaggggtacagtgcagtttgatttcatgagtctattgcatggtggtgagggagaagactacattatttaccttacttattcctgtggcattttttagtaggcactgggtgacaggcatcagtgtatttcaccaaagataagtcagaatataaaacaccatcagttcattctgatatgagtggcaaatatgtcaggaatccttaagagttttgccttttataaattatatgcatggaaacatccatcaggcttagctaaaagcccatgctatttactattttgctaaactctcattcttttaagccaagttaggcaactgagaaggcgagagagcagtgatgaagcagatatgataccctttcaaaactacacattgtgtaatacggcagatgcaacagaagcaaagggtgaaatgaagagaagtaaagctcatagatacccagggacttggctctagcatctttttatgctgtgtataatgagctttgactttattctctaacacactagaaagccatggaaggattttaagcaatatcattgtttcatgaacaaatctttgttttaggaaaacaaaacaaaacactagtactgttacaatttaaacattgaataaaagtctggatgctgttggtataatctaattttaaaaagggtgtgtaccaacaccgtaccagtggtgaccatttatgtatttacgtatttatttatttttgtatttgactaaagtttttaattttaattcataagttttcagagtttagtgagcaaccaaatcacctgttaaaatgctgagtctgatacattgggtttagatgaggcccaagactcatgttttttgtttgtttgttttgttttgagatggagtcccactctgttgcccaggctggagtgcagtggcatgatcttggctcattgcaacctccacttcccaggttgaagcaattcttctgcctcagcctcccaagtagccgggactacaggcatgcaccaccatgcctggctattttttttttttaatatatttttagtagagatggggtttcaccaggctagccagggctggtctggaactcctgacctcaggcaatccgcctgccttggcctcccaaagcgctgggattacagacgtgagccactgcacccggcctgactcacatttttagcaagcttccagatgatgccaatgcctctagttgggcaaggctatgagctgccaagttctaatgacagccactgtgctagacaaggggagaataaggtagtggcatgtagtattgcaactgtaatcccaggtgactggaatataagtgctctgtcattaagagttcgtttgtcaacgtcttgagtcttaaatatcctgtgttggtttcattctgatttcacacagtggccttctgcagctctgggagttcatcctcccagattcaagttttacagaaagaaattacttggcactttcacagaaatcccagtgagaagcctcattgcatttgttccagttaagtcatatggctgcttctgaatctaaacaaatcactgtggtgagaagactatgatgttctaattagcctgactccactttgccttttcctagaatcagtagtagagtcaactccatctgaggtgcttggactggtaatatggaaattgtgccattcccaaagagaaagtgaagatgttgaactacaaaggtgattggatatctattacatataggaattcggtgtggacaagaggtttccatactttcttggtttcttaggaaatgttcatgataccctcaagtccaaaagaaatgcctgagagttgatttattcggcagttagttccaaatgatgtaagatttacgtccttactattaagtagctgtttgataaaataatacataaggacttgaagaaaattaatatttttgtttccatcttatataaacacaatcacttcctaacaaggatgtgcacagctattgggctgtacagaacgtcttgcccttagattgagattggatactgtcaccctcacttcctgttctgcatggattttcatgcagtagttcccttttttattctaatggtaaccactaaagcccagatttataaagatatgatgctattgaaagaaatgtactgtgagctccacgtttcctgaaactgcaaagtacttgaagctagtttttgatgtgaacttcaataaatgttcagtatcattgtgtttccctgaaaatgttaaagtatcacgaaagccccatgaattccccaaattgcttttgtgcacagattgagaaccataatcttaggacttttatatttgaatttcttattagacatctttgtagagatgtagaataaaatgttgaccctatgggttcagttctgataagagatctgggctggtgaggcatctcagcacaaaggttggattcctttggtatcatggcctatagtgctctaggcatgcactacacatctttctgtctcttcaagagaagaataacatatgtctgctccactaccacacaactttacaatgcactgttttattttttgatctgaatctgtataagtaatattctacttggagtaactcatcctagtatttgcattctacatgtgcattcacatttacagtagactgcaataagagtgatttttatcctaagctctggatagttcatatattggcataaattactaagaggtaggcatcatgtacttcttgttcagattgcaaaccctctgaagtttaaatcttgttccttaaaacgtaaccatctgtgggatagctcaattaataagcactgagcagagcatacttttgattctgaagtgattttttttattaaataagtcgatatagtattttctcagtgattacgcttttctccttgctttttttttttaatgctgagtacaaatatcctccaacccaattttaaaaataacttatatgtagtctggaaccagtagatttcccaaagcatgagcaaattctattttactggagtcaataatgtttcaatctctcaagtccatgtgtgagatatagtgaatcattgtcatattatcattatatcactatggctcatctcataagatcccgcatcatctgatggccctatcattactgcttattttgcagaataatatgtaagtctcttcctaaaatccagaaaacaaatggattgaaaatattaagtacatcattattatgtaaatatttaatttttgaaataaaaatatggaagctagtaacaattgttcagttactagggaaacactagttagatttttctgtttaaatattcaaattgctgggtttggtagctcatgcctgtaatcctagtgctttggaaggccaaaacaggaggatcacttgaggccacgagtttgagaccagcttgggcaagaagtaagaccccatctctacaaaaaaaataaagagttaaataatttcaacttttacttataaaagtaatataatattaaaatgcgtattctttctattaaattatctttttaataacttttaatactgcaaacaaaatatttgaaaagtattagtgcagcattggccattgttcacagtagatctggaacacacaacttcattatacatgtttttgaggtttgatatagtctgtttctttttttctttttttttttttgagactgagttttgcccttgttgcccaggctgaagtgcaatgctgcaatctcggcttactgcaacctccgcctcctgggttcaagcaattctcctgcttcagcctcctgagtagcttggatttcaggctcccaccaacacgactgtctaatttttgtatttttagtagaaacggagttttgccatgttggccaggctggtctcaaactcctgacctcaggtgatccacccgcctcggcctgccaaagtgctgggattacaggcatgagccaccacacccggcctatagtctgtttcacaaatggcagaaacattgcttggctatggatgtgtagatatgacattataatatattaggacatagaaagtaactctttttctattgcaatttccctgtcttcataaattggcctttctgggcagtgggcaagaagaacccaacacttatatgagaattcccaccctgattcctctctaccacagacagctccccaggttactcaattatcattactgccaggtgacaacctccacttacaaagatgaggacactgaccatcccgggcacaagatcagtgagtggggaagcagggtcacatggaggtgggaagagtggatgggcagtcctgggcagctctgaagtgggacagtatgaaaggaaggccctgggctttgtccctatgagtacctattgtgtcacataaacaatagtgtgttaatggggtgctgaaaaagtctcctgcttaagcaactcagtttgtttatgattatgaatgtcagcagaggtctataaatgacaatgcagtttgtgttttgatgattgtctctctgatgggggtgttgatagcttttcttagttcttgtctcagcatttattcttgattggcatatgacagtcatattcttgggttctgttggtgtttttaaatcatgcacatgcttgaatttctcttacagagcgagaatgacattatatctgctgcttgttaaatagattctcagtttatgctggcaaagtgtcagtgctgtatgtctctatgtatgcaatttttcttttgtacagtcatttttctcttagcattctaaagattgattgaactcttgtgttatagcagtacttaatgtgtcacttactgaacttaaaatcatcactgtaactcaatgcataacgctattcatcatccattgaacctgtcactcctgctgattgtgcagaataaaagcctcttctcacctttttttttattataacagatatagtttgtgcattttttcttcatgttttaactgatattttgtcatcagttctctgatgtttatcaagagttaactttttttccaacccagattaatacaggttagagagtagaggagtttgttaatacgtaacaactactaatcactaaggctagatttattacatataaatatgtcaaattagataaacgctacttaaaattttggctgttggaaaaatattaacttgtaccttcaaatttattagggctcaaggcatattaaactttatagcagactttggatgttttatcttttaagaaatatttgaggccggatgtagtggctcacgcctgtaatcccagcactttgggaggccgaggcaggcagatcacgaggtcaggagattgagatcaccctggctcaacatggtgaaatcccatctctactgaaaatacaaaaattagctgggcatggtggcatgcacctatagtcccagctactcgggaggctgaggtgggagaatcgcttgaacctgggaggcagaggttgccatgagccgagagtgcgtcactgcaatccagcctgaaaactgagtgagactccatctaaaaataatgataataataatttgacttagtgaacaaatttgcagtaaaacagaaaaaataatatagattacacacctttataaaatctgttgtataatcatctagagatgcaatttgaatgcagcagtataacggagaagcatcagatgaattctcagagtatatcaatcttgcctttgttctagattagagcctggtttttagctagaggtgctgtagtaggaaaaacaggtttgtattgattcagattgtgtgtgcattcatagcagatgtggaatgacatatttctgccagataattatcacttagcaaagggtaaaacattagaacatcatgaaagttaaagttttaacttcacaggaaaaaaaggagctttactttaaagcatgatgaaaattatagaatttatgcataactcagttattttgttctgaactttaagaagaaactttcagaagacatccctaaaaaagcaagtataatgaccatagtatgaaacttaattgtgatataataaagctttttgctgtatccagacatgttacacaaatattctttatgaattacataaacagaaaggcaggagctagtacaaataatgaagaatatttatttaaaaaaaacaaaaagcggttattttatgtagaacaggctgcatacattatttattacaccgtattcaaaatattgtacaactctgttatgaggaattttacttgcacttggagaatacaggtaaatacattagaggcttatagatcctgaatgcagctgcagatagtgtcccttaaaagaagaaatgcagctggtttcctatttcccactcttttttgtgccagacaaggaagtgactttctttagaaaagaggattataatagtcatatccttaaatgaggaaactagaaccagatttctttttagaacttgcagtggggattagaagaaatgttgcaataaactttaggttattctaatctcagtttactaagtttttggtaacactgctcatttaacattggaaagagatgggatctgcataataaagtatacttcccataacttaaaagtaatcatgttcattgcgtaggataaaatcatccgttattccaaaaccagaggaaactgcaaaaaaagagtgctgtgttagcagtgacttaagtatcctttcacagtttgctaaaaatttttaagaaatttttgcaatttccctcaaattaactaccaggcaggcatcaatttgtcatttttgtatattgcattaaagcatttaatgctaaattaagacggaaaggtaggttttttttctttttttttttaacttttcctttctgcaaaaaaaaatcaaacatttattaactgctctctattgttgtctttctctttagaaggtaatttgtggtcagtggagcccagcagggaagctccttctcctccagatggcagtgacatttgagaaaaccttggaggattaaagacactctagtgagcactcactgcaaagtcctgacacaatttgacagtcctaatctgggtcctcaactgattggatgaccaagggcacaaaattctcatccaactgtgcaatcaccaggcacattgttaagggcactaaaaatgttccaaagttttggtgactgttttaaacaaaaatatataaaccttttcttcatggcatgtttttggaaaaggtcttggaggtaccttgcatggcttttaaaaactgactatatttttgcatgaatgagcacagcatgctataaatgtctttactctttattaagtagggtttgcaaacaatctaaatggttaaatggtagaggaaactatagaaattgatctcagtgagcaaagcctaccaaatctaattatatattgtcaccatctgctgcaatatgataacagaattaatacaattactttgagaattttgaagaaaaaacttttgaaaaaaatggacacgtgtggcaagtctgcgtgtgtgtgtgtgtgtgtgtgagagagagagagagagagagagagagagagagagagagaagcaagggcaagaaaaaaatgccatcttagctgttctttctttttctgtttcttttttacctttcctcatttttaagttattgcttaaaatgatttgaaatatgttttcctaattttcgtgttgattaaagttatcaagttttggtaaggtgattttatgggtttggaattttaattatatccactgcagcttctaaaatcaccatggcaacaggtgtgtaattatcaacattgcacatagcttcaatgtgtaatgcatttcttctggctgaatgaatattaaatcatactgcttaacacctcctctactagtaaacagataaggctttggccatggcttgcaaattgatcttgcttctgtagatttctattactgcagagccattgaatggggtaatttgtgcctttgagggttttctgactttgctagagcatgacagaaagtccagttttatttcatgtaatgagaaaaaaaacatgtttaattattactcacatttccattagtagaattctttccaagagaatattctccttattgttttccatttcaaggtgtgtattcaggacagatgagatttttttaaaaaagacattttcttaaggaaagcttacattttaaatgctacttttcctagcaaatgcaggtggtcattgtatgaagcacatatgaaatgaaacctttgatttaataccaaactatagcctactgtcaactctaagaaaactgtatgatccataattttaagtaaaccaaaactttactttgtttctaatattccaggtggtcttttcagactgatatctatgtagaagtacgcaagaaagtgacgtgattatctgattatcagattatgtttatatgtctctgattgttatcaagctcaaaattttccttaaatagctatggaaagagatagcagtttactactactactattattattaggtcatctaatgtaattcaatttataaatctgatgcatacatttgactgataggatacagacttttaaggacctagcattataaaaaatataatttaaatacatagatcaaatagagccatatataatattgttaaatagggaacaagataaatgattatgaagatgtatagatcttttaatcattcagtgtttgtttttagtggacattttattttgggatgccattcagtaacttgaagttattaaatgaagcataatcaatattagaacaaaagccagcataagaagatttatttaaatttgatgtatttagaatttggagtctggtcactagaattttgaggctaggtgattctatgaaaggctgtatgtaaccaccttctactctattccttcctctccacccaggtcaaatatcccagaatatggtattatttaagtatcatcaacttttaattttagtgtgtttccattttcaaactaagacaggtgcaaagttgaggttaccagcggtacaagatcagatcacctagttagatattgatgcatagtaaaatgtagcctaacacactctattcataatgtggattgacaactaagaaaaaagtgaatgctttattcacacaaataggttaatattcctgaaatagtgtccaatgcatttaaagccatttaaaagaacatagagaatacattatttttcttagcttatttctccagtatttctccctgtattactctagctcatatttagactttttgttaatcttagaaaaaggataaacacacacagtgtatttctgcagactcccctttaatggatctctgccagtgttagccattgtttcagttgcctgtggctgctcaactgtgcaaggttgcctggaaacgctccttcttcagtgcaaagctctccggccactttccatacctcccagcccagggcttaaagattcagggactccagccactggtgtttctttttgaaatctccttagtaaactaatgatcttgtaaatgtagaaaacagaaaaattacttctcagtctgtagggcgtgcaagtttaaaacaaaacaaaacaaaaactttgaaaaaaatatgtatttgttacaagttaaaacaaatacaatttttcttctctattgaatttgatttaaaattttgttaaaccagcattttgtaatgtgtaatatttttggcaaatattttaagttaacatctaccactgtctttcagcctggaaattgtgtgctattcccatcaaggttacatcatgtttccattactcctttaattgggggaagtttcaaagtcagacaccttgatttggaatttcaatgcttttaacaaattttaaagcaagtaccactattaggtaacagaatattattattactcacttttttccttggttaaatttgtttgttagtcctaagaggctttaggaatataaaatgaatgtgatgtttgatagtatcaatacagttgattttacttgtctctgctattttctcttttcatattataacttaataacaacaacaaattagagatatgctatttttccacagttagttcaagtttctaattctggagtataagatggggatatcactgtgcatgagttaaatagatgcccctacataatacctatatatcattactagttttaaaagaaagattatgtaaaaagtggtagtaggtagtaggtagtctttttcttttgttacaagtgctttgaaattactggtttgtgatataggatgtgaaaagaaagacaaaatccgtgatgtttgaaagacatactattatcagatatggcttacttaaaattagttattagactttggtctcctaacagcttttattccccccaatatactttcaaattccgattttcagaaatcttaattgtacaatattaatattgctacagacacaaactttgctagccctttattggtagattacatagactacattggttattagattttaaagtttattaataacatcatatccattcaagtttattttaatactttttccttatttatttaaggaattacttcaggtgatatgtggattttaattgttacataaatgcattttatggttatttataacattcactttaatttaaaggcctataagacctgtggttggatgacggtatgtattaatgttgtttttaacattaagaacttacataattggtccagaaaatcagacctatcccttcatgttctctttccttctgtacttcataagcctacgtgtcccttaggatagattactggatctgcttctcgattgctgatagacctttttcagttaaggtaagttatatgttagacatcatagagtgatcggactggttttattacatagcatattgggagcaaagcaaaagaataaagcagatacatatttctgcatgtcgatgcatgtatccactgtatttttaacgcaaactaattaattgtgggccaaaagttacagtaatgaatagaagtctgttgttcttactcacatcaggcacgcagtcttacttttttgtaaatttaaattgacgaggtaggtagagtatcacgataagcttaaaatggttattttgaagaaattttcaagaaaaatattaaggaaaaatttgggtgtctactctgtgagacaatctgtctctaaggtgctttacatattttatctcacttaatccgaggaaccaccctatgatttaggtagcattgttcctattttgaagtttgacaaactcatgcaccttgaagttaattaaactcagggttgtcttaatcatttctaatttcagtgaatatactttcccattggacatttaactttctaattaatgtgaaaaaaagacagtatttctgatagcatatacagcagtcactttaggggcagataaacatgagatgccagggatttggattgttcaagtcaatagtgtcctgaagaataatatattcactgtgtgaaacaacaacaacatcaactagatacaaagtttctgtaaaattcggacaatcattttgggttcttaacataaatagacaagattgatatatataatggtatttcagtagaaaccaggaaaatatcccaacttcgagaatcgtttcttgccaagcccacagtaagagttctaaatataagttaaaataggttctctgccaccatgaaactggtacccaacacatatcccaattataaaacgtctttatagtccactatggcaattatgaaggcagagtataatatgggagcctgaaaagctatactaaagaggcgacttttgaatggggtctggagggatgtgttcaccaaggagtgaaaggaggaaaggaacttaagttggtgaaaaaacacagatggatgtgtgaacaactccacatggccaaagaatggtgtgttttggtgtgtagggagggatttctggttaggtccatgagccagtattacaaagggctttgcatggcatgagaaggtattcggatgccactttgttcaatacagagatctactaagcacttaaaaattagagacaaataatattcagattcatatgttgaaaagattgcatttgtgccaatggagaggacatagcaaagggagctagattagagttagcagtgtcacttaggatgccattacctttgtctagggatcttagactcaaggtaagcaaagcttaggtcttgaaccaagcagataaagactagagaagaggtgctcagaaatgttgaatcagtacattttgttatactttaaaaattgttacaaggccagtggctgccacacaagacattaagcttttttgtttttgcttaatgaatgagtacaaatgtgggggaagtaaggaaaaaggcagctctgaggtttgctggaagttagctaccctcatgtttagcagacctacaaagtcttgaagcaggaagtagatttatcatggtgggagggagatggcttgatagaatgaggaagtgaaatgaaatggctcttcccaagagtgacaatgcattttagagaagatgtgaagatgatgcggttgttgagaagaaagagtattcagtgagcagcacagtggagaaatggtatggtacctaggtaggaaaatgaaaatgaaggattcctcattttctcttccagatcaggtcatgtgacaggactctgctcactccctctctacactttaatcttcactgaaagatacatagggataggaaaatttcctaacattctctcttttcctctgtattaagtcattccattaaccaaaaagttcaataaatatcaactgaatacctattatctgtccctttttaattttctttctgccctgtaaaaagctgaatagaggaatgcttatacgttagtgggagttttagaagtctctgaaagtgagaggtaagtcgtttgtcattttggctagatcttcccctaggaacttctaaatggtttcatgacctcatttcatcctagacaaatgcaagagggctttaatatgagaagagcctcaggaatccaacttgtagatataagcctctcttttaacaggttacttagtaaattagttttctttgtactgtgattcattaagaacaataactttgatttcattttatactttacaggaagcatagaatgactcaatagtagaaaaatacaataacatttttaaaaattatgtaaattaaataaaatggtatacgttaaaattgtgaaaattgtgtaaattacataaaaaatatatgtgattaaattaaaaccaggatttgtggggtggctgaattagatttcttaataaaatttatgaaaaactgtgcatggtacatactattctttcagaagcaataacagttgtaagagattattttttaaaaaatagataccatttattgagagcttactaggtgtcagccagtgctgtatccacattacatgtatgaattcatttaatttttaaagtcaacctgtgacttaccctgtgagctcactatgtgagccatcacccttgttttgcaaacaaacaaattgagggggagaaatgaatccatattcttattttatatcagccatatctctcaacaaacgctaatcagagctgattaacaaattataatcagcatgttcaatatttgatatttcatttaccttgcaggacatcctttgttttacagaattttttaaaaaccttagtagaatttttcttttttaactattattaaggctccttaggtgagtggttttcaaacgatatcctaaaggtctccagaaatttcttagagaatctcatatcttcttcaaccagattcacttgaggtatagtcatttcatatattaggttttattagagcttttccctccttctcttgctctgcctcgcatccatccatccacccgtccacccatctacccatccatcaatgaacttaatttttttagctttaaataactaaatcatgtactactaataaaaaataaagctaaaactggaggacaacatattaaaatattagatttcaggatctctctttagattgtacacatcacttcatgaatgttagcagtagcattaaatccaaacttataaaatgttagtgatgaagtagcagtgcattaaatataggcaggtgcattactttcaattaaaagtaatggcaaaaccacaattacttttgtacaaacctaatatgttggcctttcctgattgaatgtatattagctactttatacatattgttataatgtataacattaaaatggcatattgaatttttaaagtagctaatacctttaaagattctacaacataaaaacaattttgcataagaaatgttaggtatctctaagtatattttatttttaattttttatttcttttttctcttccaaagaaaaaactcaggtttattgatgtataatttacacaaaaagcattcacattttttgggtgtacagcccaatgagtttctgtaaatatgtcctaaattttttttaacaatcatattcagaaagtttaaattcaaaaaagtttaaaattattttcgaccttaattcaaaatacaccattcaggatgtttcctgctcattttgctacactgtattaagaaagaattttcaaaatatggctgcgttctcttggtgaaaagtactttccaagggacagcctaattagcccatgctttccctccagctccatcttgtcctcctttcctgcgctggatggcctttttcctgaggtaggtgagagtgcccaggacaaaggacacactgatttctctgggaaatttaaaccatgttatcaaggatggttctgtctgcctaatttgtaacttttggttggggcttggagtcagttgtggagcacagggtgggtgaaggcagaggagagagctccataacaggaacgcagagcagcaaggtctcaagggaacctgacaaggatacctcggaagaggcaggctctcagtgcgtcaacttttcattggttctatggactgtgggggaaagcaaagggacagcttgtttttcatggattgattttccaagcagctttatgaattgttacaattttgatctgggttacatacattcagttaaatggatgtttgtattaatataaacattaattttatattatttatgtaattaaatatttgtgtttaattatataaatttttatattctgtgctgttttacttttttgtattttttaaaataacgtgtatcttctttttagcttgcataaatatgtttattcacttaaaaagtaaggtttttatatttaaaactatattaaaacaaacgcacaaacatggatttttcttgaaggttattctggaaggttttgcttcatcttaatctcaaagactttgctttgttgtttactttttataaatgaatatattttagcctaatacttctgttctagaacttaaatattggctgtattatttttcttaatattaaaatgtttcctttaaaatttattttccaagaggaatgaaatttttttttttaaaaaagggattttaatgtttaaaaactgctttgggactgggtctgtaggttcagtacaccttctgagactgaaacaataagagcactcgtggcttattgaaccatgataatcaaagcaaccgaataacagtaaatactagaactggattctgcttcttatacctaattaaaaatatatattgttttaaatggggaatttatagtgaatctcatgaacaagtaatatagactaaacaatctgacattaaaattagagaatacaaatatttgtgatttatgtccttttcttaatttgaaacacgtgtgtgatacataacatgtacagcaaaagataaaaataagattaagccagaatgccattttgaaaacaaaatacaaaaaagatatgttccattaatccacagatataaactatagtagtgtttctgcattaccataattatttctgcagagcaggagaataagcagaagagaatttacatctatgtttgcttaatattgtttctgtctttaggtttcacttctctcccatggtaatgtaaaagtaggaccacctgttttccattgggcattcagtttgggtaaattcttacaacacagcaatgtatttctaatcagaattttctggaaatctgagggaagttaattataacaataatatttttaaaaactgcagtgaataaaattaattccaggaagacacccttcctccccaccaaaagagaaatctaggaagaaacacacttcctatgcagatttaaaagctttgggaatcaaggttatgaataaaaaaaatcatttcacttccataaggatccagaagggaaatatttaaatgtaaaatttgatctataaaatctaggcagcatgtattttcctgcaactatttataagagaacggggcattgtagaataaaatttgtaataagtggaagtatttctgtcttcgaaaggattgctgtaaattgtgggatgtgtagaaaaactgctcctgcttaaaaaattgcaaacgtgtttttaagcaatgtttctaagtttctattttaagtcagcaataggaaaagttattttcttgtatatatgtcaaaaaatatcaaatcagaaaggccatctacaattgatttttctacttgaaaggaacgaggaagggaaagttcgtctttgctcttgtccatcagagtattatgcctgccagcttgtgtgcaaatgatttattctgaaaagcagactttacacttagagaaatactgggatggagcatttgtgccctgtggagtgtttggaaatggaataatgcatccacaaagacagctttctgcatcctttctgcctgcacatatgaaagggtaagcattaatttcaataatggttcaagtaattgaaaaagggcctgcatttcaggatagctggacagttcacccattagctctctactgcaaagagaaaaagaaagctgacctgcccattttaacattttaacagataattaagaatgacaaaatctaaagatatcaaataaaatgtaaaacttaaaagtcagtcagtaaccatactctaatagtttgttttctagttcctacttttcattaactccaaaatttttatgcttaataccttaactgccatttggtgtaattatacttaattttttttcatgtaagtcattttcctgctctgaaggttatttttagaaaaacttgatccatcttttctctcattcacatatatttgcaaacagatagtttctgtgaaaagccaggtgttttcagtgatctaattactataattacaggctttgaattttaaacccaattcttaacttttaaaataaaactttggagataaattaaaggcactagaaggtcacaaaaccagtattaattgtaatatactgtgaagttcctcttggtttacatactaatgtatagaagatttttgaaggctctttttactcttatcaattgactcaatggactcatgactgtagcatgtcttattttcacagatgaaacatttcagatgcaccgtaccaaataaaatcatactccttagcatgatttttcagattatccacagtctagtctcaatctctttccagcttcgactcactgcttcattcccccagttgcctaaactctatgttattttgagtgtgctcgttctgcaagtatttcaaagtttcagtgcaggtcccagctattcagggcagacatttgaacataaaagtgtttaactgctggacagttccagtttttcatcacacatgctgttattcctaacattcccgtatcagttaagaatggttcatataacagaacatacaaccctgctgttggtgttgatataagaaaaagtccacagggaggcggccagttcagaggtagtgtaactcctcagggatgctgttaaggacccaagatctttctgcctctcagccgtatcatctttactatgtgaacgtttgtcctcatgatggttgaagcctcagttgaaggctgccgcaccttcaactctctgccatgttccaggcaagcaaaaaagagatgtggaatggggcgtgagtaacgggctgtacccgattgttctgtccttccccccaccctcccgtcacttctttctttttttcaggaaattacaagctttctcagaggctgacaacagtagtctttgtttcacatctcattgggcaacacccagtcatggctgcccctacctggaagatggctaagggagaaaggaatgcgagtggggactgggccagtgaaagaactgtgcctgccacactgcttttcactcgcacgcatccctccacttgaaatgccttttctcttatcctttatgtgtgttcatctacatcttgtgtggaggctgtccactttctccagttctgtgtgagctcctatgagctgctgtttttattttcctatgggatatcatttttaaccttcataataaaaggcaaaatgactgtcattagctttatgtagctgtgtcttaacactgaggtcagaaattgtgctatatgaattaggaatctttcagtgacaagcgtcaaaaaattatgttaattagtttatcccataatttgttggttcacttaacatggaagtccagggaatcgctggcttcaggcatgtctggaagcagaagctgaaatgatatgctcagtgttaactcctgtgcctcttgtcattcttaatctcatccatcctccctccctctcttattgctcctctctactcctctttgtccttctttttcttcctctctttctcctactctttattctatatccctctattttgctcattctgaaactggttctcaacacttcgtacaatgtataaatgataggcattcacagctcttagcttacctgacttctcattatgccagagtcaaggaattcctttctacaaaatgcatatatcaaatgtttctggaaggaatatgattagccttggttggccacatttctgttttttgaccaatcctaccatggaggagaatagaatagtaagattggctatgaataggtccattctagttgcccagaagtagatgaggcagtgtatttgataatctcacccaaaccatatgtgttgttgggagaaaattctgggaatgcaaaataataagtacttatcccagatctccttttacctgtcatcattcattgcatgtgcctatctctatctaagtaataggagctcagtagggagatgaggaagtgaatggataaatgggagaggggaagaactgagttgacctataagcaaaagaagaaaacggcagttttagtgttttatgagctgtatttagatcatgcaataatattttagggtttttttagtttagtttattttttttaatttttgaaacagggtctcactctatcacccaggcttcagtgcagtgctatgatcgcagctcactgcagcctcaacctcctgggctcaagtgatcctccaacctcagcctcccaaatagctgggactacaggcaaccatcaccacccctggctaattttctgatatttttacagagacagtgtcttcctctgttgtccaggctgctctctaactcctgggtttaagtgatcctccttcttcagcttcccaaagggttgagattacaggcatgaaccactgtacccagatgttttatgttttaaatttatataaatccacagtggctgcatcattcaaattacaaaaataaggaaatgtggtacaaaatcatattcaaaaaatgcatctgccattgctccttcagaaaatagttattgcttgcttactctgtgataaggcattaattacatggtgcttcatttttttagtgacaataattgagatgcttctctctgttcttagagaacatcttaagctgatagaaaaactaacaaatgggatacatagtttgtaagtaaagtatatttgggaaaccttttgtctttttaaagcatataaaactaatagtgtgttttcaacttcagtgtatggatgtaagaagcttaagaaaatgaattcatatatttagcctcatttattttaaaccatttatggagacatttgatatatttttaagtctcccagaaaatatcctaagcataagcaaataacttcaaatacaatgtttatatttggacatactagttctctgctgtcatcttgactgattcagaaaagttctgaagtgaaagattttagcatttatttctcctggctttcttccatctgccaggaataactcagttcactgaaggcttctgacaggtccctgaccttggcccctatctttgccatcagtgtttggggtgaggagagaatgggctttgaggatggttgcctctttttcactgctgcacctcctcattatctctccaggaagcaggttgattctggccggcaaagctccctgaggtgggatccattcagtccattcttacaggggtaatagggcttggggctcatttcagtcagccttcgttggaagagagaggtccctttcctttccttttgaagattgattagtttccaaagaaagacagataacaccactctcattctcactttctctcttttttctgttcttgaaaactcaatagttgtgtacaataagaagtcttgctagacaaattgtgcctatgctttatgttctgtaaacatgattcttgaagctgagaaacttttaatggaaccctttagctaagctgaaattacttacataatccaactctgtattagttttcctggtttttgaaatagtgtcacaaaatagcaaaaaaaaaaaaaaagaaaaaaaagaaagaaaaaagagaaagaatgggaagtagagaatttctaacacagtcatctaacagactgactcagatgtaacaagaaagtataataataataaaatttaaaaaaaaagattaacagaaaacaaaacaaaacaaaaaaaagagaaagttctcagtagccctctggaaagagaaatttctaagcacaacttttttttgttaaagataattgaaaataattatatgtgtgtttggtaaaccacaacgatctttctatattgttaacacctaaagtaggtgaagaggttaatgaggaggtttcccagcaacaaatttaattgtagtcatgtaaaaattacataaactcaacataaaatttgaacacctgtgcaggaatctgaaaaaatttcattctaagtaattcttataatttggactctcagtctagtggtgagaatttgaaaaagtaaagaatgctcatgataaagtttgacaggtgctctgaaagcagtaaatatgaggaattaaggcaacctctacttttgacatcgtttgctctgaggaagtattgtatatcctgactttaattttttcaggaccctgtgcacttacaggatgacagaaatgatatttcttctctcctgaaaccctggggttgatatttacatatcacactcagacatacaaaaaatactattctgctttatttatcaataacaagaccctgtcctcaatgatggagacagaaaacaactttgctaagttaagctatttcagccactacttctggtttttattgctttatttcagaggaattcaattgcagttgactaaatcctcagtcaatttaaagttcatatttcatgtgaggaatgtttttctctaagtgagtccacattcctttctctttctttcccaagatggtccagggaacagggctgaattcccatgttctcatgatgagagaggaagttccttctggtttgtgtgctgtctctgtcctcattgatgtcctctgggatatagttgcctggtatcttgtgttcttgcccaccgaggtctggccattacagggttgtaatgctcatacatgctgttgaggcagaggttccttttcctctggtttttgagatttccatagcaggggtcggtaaactacagcatacaaggaaaacccagctgctgtgggctaaatccagccatttagcttgttggctaaggctgtcagttttcgttctacaacagcagttgtgagtacttgcaacaaagactgtatgtcctgcaaagtctaaaatatttactctcaggccccttacggaaaacgtttgccagcccctgatctctctgagtccttggattgtccactctttgtttgtccttcctcttggcatgtttcatcttttccagagcacacaggaaccactgggtctcctgcacagaaactcagggcagacagagtcactgtctagggacctccccatccctctcctatgtcactgctttggcatcatgctgtatataaaaaggtagcaggggaccagccctatctcagcctgtctattgctcaccatatctggaggtatttgaagtttctgtgttttaggtttccaccctcttgcctgaaggtctttgatatcttcttagagactcatgtatcattttcaagctacctttctcccttgcaaatcccctttcttctttcctcgaaagacttagtatctggaaagaactttccttacgtgaatgattcttgaagtgttttctgtaccagcaattctgcatcatatgagaatttgttaaaagtgaaaatatttggtctctaccccagaccaactgaataagattgtcagagggagaggcccagcaagctgcattttagcaagctcttcaggtgatttgtgatctgataaagtttgagaaccccctaccttacatcatatctgccactaaaaccagatgatctgagtagccaggtttcctgcttgatgtgtgaaagggagctttcaaaatatagaaaactcctttccctttccacaaagattggctggagtagactcaaaaattctgttttgaaaattgaatatttcaatcgattatctttttccttgtctttctggtctactaattcaactcctccctgaggcggccaatgcctctggttaaacagagagtgtataggaagtgctcttaaggagaaacatctggtgcttttgaataaatgctcttctatgcactcatgatgcacacatttatctaaatagcacagtacatgcctgaaaccagcaacactatttgctgagtcagaaatttaagccttagcctgtgagacagagactccaatactggattccctttagatctccatggacatttcaaacttggcaggtgtgaaaggaaatttactgattccttatctttctcctcaaatcattctccatttcccaaattcttgaccttggtaaatggctatgaggaagtgactataaagtactgatttggaagtggactgatctggattcaaacaccaatttcagcatccattaactttgtgatctgcaacagccaacgtttctagctatacattttcctgtaaaacagaggaagtcccaaatcccatgggtagtttttaagctttggagaaaatgtatgccggatatatgatatttattatcctatgcttgcccattctcaactccacttagtgaccaaatcactaggcatcgttgtgcattctcttttagaaatgtcttgaattgatcatcgtatccccttcctttcaacagattgccactgttaataaaggtcatcttcattaggggatggcatagtttcttatttcttcctatctctagttgggtcacttcttgggagagccacttatggttttgtgggtttgggagtgcacaagaacaccacatctaaggggcaccattcagatgttacccagaccttataaaggtccctctgcacacttacactaatgcaccaacacacattctcacagtcacacatgcacatgttctcacacagtcactcatacactaacacacactggccttgatgctcacacagacttaacacaaatgcacatcctcatagagactcagataccactccaccacacacacacccactcacattcacacacacttttgagtgttgtgtattattacaacaaaacagtaaatcatgtttctccaatagaagcagtatattaaaacatgttcctgtaaccatattgaagaaggactatctttctttaaatctttaaagcacatggaggtgtcctggggccgctctgctctccactcccatcttttcttcaacagttgctaggatgattctatctgaagcccccactttttcaggcttcctgtgcctaagttcccattgcagctcatgcagactgcattttggccctctcacacagtgcatggttatgccacccgagagggaaaaatgcactgtgatcatcactgataaccaccattatacctggtcaaaaggagatgtgtaagaatgtaagaagttattttgcctactgcatgaataattaatgctagtggcctgttttccatatgtatggaaatatagagagattcagccaaaaatactgtactcttgtacttttttttttaatttggtgattatccatttacctattttaattacaaggaagagctccaaagaaataggaatgttttaggaagaacttgatggaaagtgcctaactgctttttaggactattctgtgcaatatgtttttaacaaaaagagagattccatttatccagcactattttcatcattctgttgcttcaagtggatgagagggttctcttgtctttcttattcttcacccacttttagagtttaacatcttacatttactgagtactctttataggtacgacacattatgccagttgtttttgaagccttgatttcatttaattcttcagaccagtcttagaggtgggttgattctatttccatttcacaggtgaggaagcaattattttgagaggaatttacctgacattaagtggtgcagaaagggcagaacatggcttcaaaactagttttgtctgctttgtgagcctgtgatctctagaggcgtgattattggactttttttttttacctccttaaattttacaaaaaactaaagtgaggaaaagaaacccaaagagaaaaggtaaaatactgttgaataaaacctgttttctgactttttattaaaaagaaatgattttatattatctattgttaattttctaatttccaaaattaactttgtcctgtttgtaaattgtctttataatttatatctttaactgtgttctatagcatggatcctgctaaattctgactttcatgctgggaaggaccctattttccatttttatgatctttgttggtttctttgctctgttcttacaattttgcatatgaattctagaaataaccagataagagaaagcaaagcatagactaggagacttttaagcccactcacagcttcaagcatcatgataacaaaattgaaagcaagtgtattgatttgggtggtattatatttgtctctagggcttgaaaagacctttaatttctctctttttacacaccattttttgttgtaagtatgtttacaaatgaataaatgtcatatttaataaacctaatggagagaagttgcctttaaagaaaccaacagatatgagcatcatgttgtgagcatgtttacatttacgaacatattattttctcattacctactcagttatttagaaatcataggagttagatgctaaatgtcattatatttatatgtgaagcagcatttctaatctccagtcacttctttcaacttacacatctgactttgacctctcacttcccatggcatttcagagttgttacagaatttataatcaaaattagtttggcagcttagaacttattggaagaaaaacatcaccttattctgccgctattatcatactcaagaaaactgctttttcactttgtttaaactgtatttttgacttatagtagatcaatttctccgcatttcaatttacaattatatgtaacatgaatctcaatttttgaaatacctaactcaataatgtatgaaatcatttataaaataatttctcctatttgctttgaaggaaattttaaagagataaaagtgcttccactttcacacacaagtttaactcataagtttaatggtgaccaatattatattcttggtgtaaatcctactaaaattttatctatcctgtaatattaaatatatataaattacacacagtatgtgtgtgttattaatatgcacatgtatatgtgttggtgtttaataaagttggtttctacaaaatttcttagagctacccttagcattaatttactcacttgataaatatgtattgagtccttttgaggtgccaaactcacttctagggaccacaaatatataaatgactaagtgaaacccaattgcatatcctgcaggagcttagaatctactggtagaaacatacaattcaagagcaatgataatactctgtggtgtttctctggtgtagcacatggaagaggcacagtccatcccagggaaggctaaacaagaagcaggagttagcttggaatcacagggggaaagaagattttcagtgagaggaacaatgagcagcttatagaagaaagatgtagtagcagaacctggtgatattttgtctcttagaaattgctgtcatctgtgagagacagtgtgtgtagtggctaaaccaatacaatttaaactgcctaagtgtgaatcttggctcagccacttttggattgtgagtcattagcatcacttccctgtgcctcattttccccatttgtgtgaaagtgggttttagaataatgcctacttgatgaaggtacagggaaaattatatgcgatgatacatgcagggtgtctggaggaatgaacaccagatatgaagagagtccttgtatgtgtttgctaggattgctatatcaaagtactatgaagtgcatggcttaataatagaaatttattgagttactttttcctagcctgcttattatttgtgtgaagagaaggacttcttaatgaatacatgaagcaaaattgttctttaatcttttgctttcagttttacccttactgctttttgtgtttggactttttatctagattgtcatttctgttctttggcatttaaatggcctgctttaagcagtccagacctttctttgttgtctgagactcaatagtttcctgctgaccatctatctgataagttgagtcttttgctaattgtgatctcatagcctactccttcaactttcttcttatcccttctcccaatttttccaatctgtattctttttcctcttctctccttctcttccctttctccttctttccttcctttcccttccctttgtccctatttactgctttgtcacttattttcctgtttcttctgcagcagtaaacaggaaatgcagcttcagtttgctgctacatgttgttataataatactctgaagaaattaatgcatggtttcttcgctgtgacaatataaacttattaaaggcttacgttcactcgatacattgatcatttttctgataactctaaaaaccacaaatgtcaataagtcacagagttgaaacctgtcaacatcactacagttgttagatttgttgtttagccttttttattattgctttttttttcttccttatagctcattgaaattctagttggaaagaatggagcagtgaactatgaagaaacattaattaattttacatgacgtgtgtatgtgtataagtggattttaaataattagtcacaattagtatggtttttaaaaattttagcttagtgatctagaccattatcatcttggttattatgtttttaatgttcagattgtaagtggattaatagtagagtgcacattcatccactgaataattgttgaaggaagaatggtatcatcagtctttttgaggagttttgttcgtccagttctgccatctcactgtaaataattgtagaaatggtacaatggatggctgatgaatcggtaaaacatggagatttcctatagcaaggaatatgtacacctgtcacttaaaatctattattttcttttttctggtttataaatagaggcctgaaaatagtttatacttaaaaatatcctaatatgataattttgttgattatgaataaagagtattttatctaagtcgtatcacttgaagagcaagggttagtagaactaggctctggatttagttttgcattaactaacagtttgatttatggcaaaccatttaatcagtcttgaccttcattttctcatcataagttgaaagtgttaacttctgtgttcctttagggccctttaaatttcatcagttgatattttaatatttttaacaacctggtcattacaataacatctgcgtatgaacccatcaaaggatctaattttagagtttaattttatactttgtagatgtctgaaggaaaaaaaaagggacagtgtcatacataaaaatgcactatgtgctttcattttaaaaatattttatatcactgttcttcaaatattgaagcatcaggatccctttatattcttagaacttgtacagaaccaccacgagcttgtcattatgtgcattatagataccaaatttagcattttataaatttaagcagtacatttagagatttaggaatttattcaaaaacaatagacccattatatgttaacataaataacatatctataaaagaaataaaaaatttttcaaaacaaaaaacaatgagaagaatatcattgtttaacttttttttttttttttttttttttttacaaatctctttagtgtctggcttcttacaagacacctggattcttctctctgcttttactgtattcatactgttgtaatatcacacaacatggacctctgggaactccactgtacagtcatgagagattgagaatgaaaaaggcaaatgacatttcagtattgttacaaaaatagttctaacctatagggacccgttgaaaagtgtctcagtgacccatagatgaccctggaaatcactttgagaactaccattctatattttttaatatgagataattccattgtagaaagcatacttcaaaattcgaagttttgatgtatctttcagttacccaaaaattcaacttgacttttaatggtgcaatgatgccgaaatccccctgtccgtgcatcagtttatttttctactgcctatttgcatgatggttaaaaatatgggtgaaatgattttcttcccttttagcccctgcaagagaccttatctttacatatgcatcttctttactcgactataaactctgtaagaagagggagtattcctgggcagccataaaaaaggatgagttcgtgtcctttgcagggacatggatgaagctggaaaccatcattctcagcaaactgtcacaaggacagaaaaccaaacactgcatgttctcactcataggtgggaattgaacaatgagaacagttggacacagggcggggaacatcacacaccagggcctgtcgtggagcgggggttgggagagggagagctttaggagaaatacctaatgtaaacgactcgttaatgggtgcagcaaaccaacatggcacatatatacctatgtaacagacctgcacgttgtgcacatgtaccctagaacttaaagtataatttaaaaaaagtaaaaaaaataaaaagagagagagaaagtattcaatactgtatcctatctaatttctcaagaaatatgtgttaaatgactgaataaaatagaaaagataggaagaagcaaatggaacatattaacaatattaacaaatttgaataaaatgctaattcttgagaaaattggtaataaatgtctaaatcattctcaaatagaaaaatgttatcaaaatttaattttacagtttgtatatgaatgtattatattctctcaggtacaattgaaagaaacttactgaaagtgaatacatctattaagattaaaattaaatgaacaaaaactctaacaatgtagaagtatatggacttgcttgaaatgatggaaatgcttctaagtatataaaatgggaggtattatcagtattataaactagtaatcataagccctaccctcccctgtcatgcagagttataagtagggatccatagaagacaaataaagagctgctcatactccatttcgaattggaccgcctggattctggtgttgattgcatatggcagtcccatcataaacttactcagcccctctgggcttctatatcctcccacagagaaactttgtaacaatggaaacctaaaatgtaacagctgtttacttacattgagggagtgaatttctcactacagaaggggttcaagtccaagtaggtaggacagttccccaactctcagtttatttcatttgaaggaggtagttggtttctcagactgctccccttagtcctgcccatatctaataggtgtggtatctgtaatgctaaaaattcatacaacgagtagcaaaagttgtgcctagaatttatatgcatagtttgtaccattattttaaaaatgaagaataaggaaaaactatattgaaatcaataatcaccataatggtggttttagaaagttgttcttgtgacctaataatgtggtgaagagattttgataagtccctacacccagcgtgtgtggatataatgtcattatgatatgtattattatactgagatgcagagattcatttataatttacaaataaattaattatgattgaaaaaggcagaatattttggaagctgtgtcccagtgactgtacaattttcccagaatctcctaaatgataaaagtgacttataaaaatcagttttacaaaaggtgacactgtttagtaacatacatttgcaagtttcacataatagaaaaaaataatgtattctttatttgaggagtgaagaaatctatctgcatgtaaacaggatatgacattccttgttgctaacttaacaatgtgattacagtttacatatttcttcggatagtggtgctttactagtaaatgactatttatccttttgatacacaaacaagggcttattttatatgtagatgccataaggattactcatggagtttcagaagattttgagctttttttaattaggaaaatgatcagacatacagaaatattggaagaatgtatcatctatatagttatcacataaactcagtagttgctagtattgtgccccatttgattcatccatacatttatttcatgaaccatttgatcacctgtattttcagtaactggaaggttaatctaaatatgtgataacgaccactttggaaaacagttagccagtttcttactaagctaaacatctctgggcattggtatttactcaaacaagttgaaaactcatactacatgatcacctgcatacatatatttaaggagctttatgcataattgccaaatcttggaagcaactaatttacccttcagtatgtaaatgaataaataaactgaggtacatctaagcaatggagtattattcagtgctaaagagaaatgaactgtgaaaccatggaaagacatggagggaccttaaatgcatattagtaagtgaaagaaattaatctgaaaaggctacatacagtgtgattccaactctctgacagagtacagaggggttttaggccagtgaaactattctgtatgatactaaataatggtagatgcatgttactgtaaatttatctaaatacatagaatgcacaacactaaaagtgattcctaatgtaaactgtgggctttgggtgatagtgatatgtgtcaacataagactcatcagttgtaataaagatactactctgcatggggatattgatggcataagaagctctgcacatgtgggggcaggaggtatatgagaactctgtaatgaacataaactgctctaaaattaataaagattattaaaaataacgacatttattataacatttttgagaagaatactttacagatgatattatgtactttattttatgttacattagaggatatatgtcgccttatccaactattaatgatagtaagtgtgagtgcttgatggatcatcttaatacaacacataaatattgatactgatttcaatttctttggtagcaatttaaatatctaatcctccagttataatttccataagcaatagaaactagccactgtgaatgtgtgttctttactgacacagacctgcctttgactattttgagtggttggcattttaaagacttccagctgcattagaatgacaggaatgggatttactctcctgctttaactagaaaattaatgaaaatatatggaacaatagtttcagagattgaacaataataagcaggacaggagagaaatttatgagagatgggaaacaaggtgagctccgcgactccccaagcttactatcgggaaggaatttcaaaacagtgcggggaaggggagcccaaacagaggtgtagtatttttaaatagaagagaaagacttcgaagttcagggaggacgaggcagctggaatttgaggggtaaaatagcatagaggaagaaactacctagagacagctctggaacactgcagaggggttcagtcaagtgtttggtagattactgatctatgcttgactgtgatgaaactaggtaagacgagggaattgatcaatgtaaaggagtatgtagagcaacttcaagagttcatgcaggaagagaatgactttgttcttaccagcaataggacaaaacccttttatgcaagacagcaggtagagtcctcagaaaagtattacctcagtagtatggtcaaattagtcccagatcaaatgctcttctggacttcccttaacaaatcttataagcatttctcaaaatgaataaacaaatccaaattgcttagctatatcccagaatatagtcctataatatttaaaaggataaaccaaaagtccccaaaccaacattgtacaaattgcagtatcttacatgcaataaaaaattactaaacatgcaaggaagcaggaaataagacccataaacagaggaagtaaaaatcaatagaaaaagtttcagatagcactgaatagaagaataagagacaaagatgataattaggtattgtaattatactccacatgtaggacatggaggaaaacatgagcttgatgaggagaaaaatgaaagataagaaaagatgcaagtcagtctcaacagatgaaaaatatataaaaattaaaaatacactgtatgtgagcagtaatagataaacacttaagaagaaaaagttagtgacttgaagacattacactagaaaataaaaaaatgaagcagaaaaaagtactgaaaagaaaatgaacaaagtatcttctgtgggaagatgttatggtggcatatcatacatgcagttgaggttccaggaaataagggggacaagcagaaaaataataaaatacgtgtaaaaattttttccaaatgtattgacaattacaaacccccaaactaataaactcaatgaacaagaaacagaagaaacatgaagaaaaccataaccaaagcacatcaaaataaaattgctggctgggtgtgatggcccactcctgtaatcccagcactttgggaggcctaggcgggtggatcacctgaagtcaggagttcaagaccagcctggccaacatggcgaaaccccgtctctactaaaaatacaaaaattagctgagagtggtggtaacgcctgtaatcgtagctactcgagaggctgatgcaagagaatcacttgaacccgggattcggaggttgcagtgagctgaggttgcgcaactgggctccagcttgggtgacaggtgaaactccatctcaaaaaataaaaaaaaacaaataaaattgctgaaaaccagtgatgaagagaatattttaaaagcaggcagagaaatcaatgcacaaatcatacagaataataaatataagaatagcagatttcttgtcagaaactacacaagccataagacaatggagtgactattaagtaaatttcttggtcaacacagttttagctgtattttacaaactgtaatgtattttcgttttcatgttcagtttgaacaacttctgatttcccttttttcatgtcttctctgttccatggataatttagaaatatgttacttacttttcctgatacctttctcttgttagaaatctcaattttccaaaaatagatagcatgtagtataacctgtattgattaaataaatttcatagtttaaaatctttctaccaaacaaactaacaaaactaacaaatgatgagcaaacaaacttcaaggctgtatgtcttcattggtgaattctgctaacatttaaagaaagtataatgtcaagtctacacagatttttttagaaaatagaaaaggagagaatacttctcaatgtattttatgatacaaaaatcagaaaaattcataacaaaaacataaaactccagaccaatatccttcataaatacataatacatatgtatttgtataaatacatatgtatttatgcataaatacaaaactgtatttatttatacataaatacaaaactcctttttaaaaatttaataaatcagtatatcaataaataaaaaatgtgatacatcatgaccaaataggatttatcccaaaaatgcaaggttggctttaagatttgagaaatcaagcattgaaattcaatatattaacagatttttttcaaaaggaaaaaggatttgactaaatttaggacccatccatgatcaaagttctgagcaaactagaaatagaagggaacttctgcaaactgacaaagggcattattgaaaaacatgtagttaacatcctccaatatggtgaaatgcttttcctccaagttcaggaacaagacaaggatgtgcactcctatctagcatttttccagatgtcctagcctgcctagtaagtttttaaataactaatacagcttgaaaaagaagcagtagagccttctaacatgatcgtttttgtagaaaatcttgaggaattacccaaaatctactcagacctacaaatcggtttaccaagttagcagtatgcaagattaatgtataaaaaatatatttttgtgtgctagcaatgtaattaaaaatttaaaaatcaccattgacaataggatcagagaatacgaaatatatacacataaatgtaatagaatatatattcagtctgaacactgaaaacagcattgctgcgaaaggttagaaaagtttcaaataaatagaaaaatatagcatactatgagttggaagactcaatactgtatcagttctgtaccaagtgatctattgattcaatgcacttccactcaaaatatccacaagtttttctgtggaaattgacaaactaagtataaaattgatatggagatgaaatacaaagtttgaatagccaaagtaatttgaaaaaaataaaataaaattggaggatgtacaaaactgattttaagacttaatgtaaagctgcagtactctacacagtgtggctctggcataaggtagacatagattagtggaatagaaaagagagtcaagaaatagctcatatataaccacatacatggttagtcaattttcaagaaattaccaaagtaattaagtaaggaaataataaccatttgaaatgatgttgaataattgccatccacatctggaaaataaaccttgattctaatgtcacaccatatgcaaatatgggtagctaaaaccttgcaacttctagtagaaataatggaagaaaatcttaactttggttatagcaaagatttcttaaatagaacacagaaagcagaaacattaaacattcgtcctctccaaaagacacaggttaaacaaaataaaagccacagactaggaggaagtattttaaaaatacatatctgataaaggatttgtgttcagaatatgtaaagaactctttcaactcaatgataaaaagataaatgactcaataaaccagtgggcaaaatatttgaacaggtatttcaccaaaggggatacaaacaaacacctgaaaatatgcttaacatattactcactaggaaaatgaaagttacaaatgcaatgatataccactaagcacacacttgaatggctaagcttaaaaagacttccagtccccagggttagcaaccatgtgaaacaactggaactctcacatatcactaaggggagtgcaaaaatggttcatttatattggaagacatttcagcagtgtcttataaaatgaaacatatacttcctatatgaccagtgttactattctttttttttaagctggagcctcactctgtgttgcccaggctggagtacagtggcacaatctcggctcactgcaatctccatctcccggattcaagtgattctcctgcctcagcctccagtgtagctgggattacaggcgctggccaccatgcctggctaatttttttagtatttttgatagagatggggtttcaccatgttggccaggctggtctcaaactcctgacctcaagtgatccactcacctaggcctcccaaagtgctgggattactggcatgatccatcacacccagccagtgttcctattcttaagtgtttttccaacagaaaagaaatttttattcacaccaaggcttatatgcaaatattcagagcagctttttttttttttaacaaaaaataatagtcaaaaaccagaaaagaactcaattgttcattagctttttgctgtggtaagcaaatgtgatatgtatgtacaatggaatactgctcagcaattaataaaaaacaactatcaatacagataactctcaaaagcattatgttatgtgaaagcagctagctgcaaaagatcccaggttgcattttcatgtatataatattccaggaaaatcaaaattattctgataaaaaacaaatccctggttgtcaagggttggagagagattaagagcaaacagatgcaatggaactttttggggtgacagaagaattctgcatcatgacagttttagtggttacatgacttgtaaacttaacattcattaattttactgctcataaattataccgcaggaaaaccgactaaaaataagatataagaatctatcttcagacaaatcctaacaattatactgacagttgtgtcactaagaatatttctcactaattggttcagagttgtgggctgctaaatggattaaagcaaaccaagaaaagagcttaatattattttagaaaggaaccgttgaaagataatcctggaatatagccacataaggagattagcacatactcgccaaaaatttaaatcttttgctatttaatgaaatcaggccaagcagcagcacttgtcagtaattataccggtggtgacaattcatatgtatatgctttatggttttgaaagtaagttaaaatatgtaagctgaaagactcaagggcctgagacacattctggccataggagcaagtaaacaaaacattttcatgggtgcaagatagatggcatcaaaaattggaatgccgttcagaatgcaaaagaacttccaaaatctttacagtcattctgctggtctgtctgcttttcctgctcctactttctgacgatctcttcttgggtatcttacagtcttaactcactgagactagatttgctggactaagtaagtcactgtgatatagaggacctcattgggaagagttcttggattagatcacctttgccagggttaggggttgtttggggccaacagtcctctctggtctacactgttgtaatgaaaatcaaatggcgaatgaacaaacaaggaaatatactagcattttataatctacaaactatttgtaaattatttcatctaattcctctaacagatattataaacttttctttaacagttgtgtattttcagctctttgcacagtgagctagtcttggtagatgctcagtaaatatttgttaaatgaattcattaggagattaatgaatggattgagggagatgtgaatatatcagtgatgtcctcaaaagttgtatagcttggccaagttcagagagcttggcacatgttaaaggaaaggcagtggaggacagtaagcaactaattatacaggttttgcagtcatatctgcaccttcacttgctgagcctctgtttatttcatcggtgaaataaagtcagttgcatttctcttcaggattttaagaagttttaggtgataaagggttgctgtttgcaaacccaagagcacataccagcacttaggaacttcttaattaaaattcaggatctctgattataattcctgtgattcttgtcattacactgtgcttctgaaatatgagtgttcatttagtatatcaaaagaagaaaatgaacacaattttcatcttgggagaaataaaaccatacagtttctttatttcatgtttcttctgcaaattttgcttattactgtttttctacttgtggttgcttatgtaattctcttctttgataactgaatgatgtatcttcccaaatttagtaaaatataacttatctagaaactacatacatttaatttcaactagttataacggccaaagtccaggatgtgaagaaaataagcaaaatacactttcacctccccccaccaaaaatgccataatgtgtatgatatatgtataagtgtataaaagctcatgcatttgactcataagagaataatttgggctttacttagagcttgttgactctttttgcatgtaattgtattaagctgaatgatctgattttcccacaaagagcagattaaaactagccaattaaaaggaagcaagagaattgacagcagtgagaattaacaataatttcccacaggtattactcttcagtaactttacaatacaatgtttatggcttcatctaagatgtaaaatattaattatgctaaaaatgcttctttaataacgggttgtgtttgtgtgacacaagtgtgtcacacaagtgacacattgtatcttcttaaactatcttaaacataaataactcagaaaatattcctttgttgagcagcatttatgaagccctgcaaattgaattagacttgttgaaatatggataatgatgattctgcaataataccaatgtgcaagcctcactttttgatttttcagaacatactgaaattctattattcagtcctcaaccactgatttattgagagctatttatatgtgtcatacagtccagtctctccttagcacagatattgggacagactgattccaaggcatactctagaaatgggaaaatataaatgtttaatagaataatctgtaatttataacctacaaggaacaaatagctatgtgatgcatgatgacctctcttgtatgcagatggtttttgttctaactggaagaacggaattgtagcattttctaaataatgaaacatgctcccatgaaccacggggtatgtggtgggcttttattatagttttaacttctcagcctcttatgcacatttcctttgggggattcctctcagtatgatttgtggtagagacggggtgtggcttcagcagtggttatcagtgctgttctcttagtatttccagctttctgtcttacaggacggaattacctgaccgccttctggtagggtgagcctgtgactgctgtgggtcagtgagatgtgaacagcagtgatgggttttttccagctggattatccgagtgctggtgtgagacccactagagcagtacttaacctttattgttgttctcagggctcctttacactgttaaacatttttgaggattctaaaaggatgtagtttacgttagttatatctattgatatttattgtattggaacttaaaactgaaattataaaaatatttattaaattatttagaagagtaaaataaacccattccacatcaatgtcagtaacatattcatataaaaataattatgttctcaaaaaaaaacagtgaaaagaatagtattgtttaccatttttggaaatcttaatttttaactcaaaagaagacagctagattttcgtatcagcttctgcattcaatcttgaaatatctcagtgtcatgaagcctctggaaaactccactgtgtgttaattagaaagctaatggagaaagtgccatgggaaaatactaggtacagcagcaaaagaggccaaagagctgtggtaaaacgagaggaacttggccagccagtgccggttcccagatggaggcccacgggcaacaaaaagagaggcctctgagagcagagggtggccaccagccgacagcagcaagacaatgaagacctccatcctagaaccacgtataactgaattctgccaacaacctggatgggcctggaagtgggttctcccctatgcctccagtagggtatgcagctttactgacaccctgatttcaaccctggatctacagggttgtaaggtaagaaagaggtgttgttttaagccacttctaccccaaagcaagcaatgtataataatttatcatattaataaactaaaaaacaaaaaaacacgtttcatctctatacatgtagaaaaagcatttgacaaaacaccaaatccttccttcataaaaatcttcatgaaactaggaagtgaagggaatttccaaaaactgataatatgacatctatgaaaacccgacatagaacatcatatttgctggtaaaaaatgcaaagttttcttaaatatggtatcaaaagcacagttctaaaaaactaaactgaaaccttgggcttcattaaaatttaaatcttctagtctttgaatgacactgttaaaatttaagccacagactacaataaaatatttgcatatcttatatttgataaaagacttgtatccagaatatataaagaatctgcaaaactcacaaataagagcaaataagccaaggaaactcaatgacttgagctaaattttaaaatagggttaggttatggactgaaaaaccaagcttaaagggagaagtgaattataaggaagaggagcagcattaaaaatattacggagatacggccaggcatggtggctcatgcctgtaatcccagcactttgggaggccgaggcatgtggatcacctgaggtcaggagcttgaggccagcctggccaacatggcaaaaccccatctctactacaaatacaaaaattaaccaggcgtggtggcgtgtgcctgtagtcccaactacttgggaggctgaaggaggagaatcgtttgaacccaggaggcagaggttgcactgagtggagatcatgctcctgcactccagcctgggtgacagagcgagactccgtctcaggggaaaaaaaaaaaaaaatatatatatatataacatatgtaaaatatatataatatataatatatataaaatatgtattatatataaaatataatatataatatatataaaacataatatatataatatatacatataatatatataatatataatatatacacacatacatgtatatatgtcaaaaaatatatgtcaaaatatatatatgtatataggagatatgaacaaagtcaaagtttaaaaatatatagttagttcaccatagtttatgcttaaaatatctgttcttagtcttgttatccataaagttaatgggtatttgtggtgggtagacattactatttatttttcaagcgtatgataatcaaatgagatcatttctttcagtttataactgtaaattgccattagagatattatcatcactaatatgttattgtaattattatagggtattattatcatcaatatattattgtaattattattattgaagaactagcatatcattataaaaatgcaacagaaacaggcaaataacatctaaatattattatgaaaatagttttgaacttgcagatatccaggaattcccagactccactttgaggactgctacgccaggagttgttctttctgacatgataactagatagagtggctatctcttctggagtgaacacaacgtgtggcagagttcccagctaatgtataatgggacatttaaagagagtgagaaattaagttgttatgtgtttttttttttaaccaccgagattttgagagtgttttgtggctacagaataatctagtttttccttttatagtttccaaaacaaaaatgcaaagggccagacactcacttttttgaagctttagcaaccagaggtgagcataagacttatctgcagccaattacatactcctatctggtactttgaatgaggagcagatgtgaagaggaggtacagatgagagtttattctagtagttgtggtagctgtagaaacacccaggtaccagtggcagcaaagtcagttatcattagcaatggaggctctattgccagacatgtattaatgtctgatatttgacaaaacaagtatcttctcttagttcttatctgcttgtgaccttggttttccaatcatccgataaatactctccttgcttacattatccagctttctattctttgcatctaagaatctcagctagctttgtgcagtccgataaatgaggttttgctctataagaagttaaaattcagaactctccaggggtctccagacttctttgatcatagtccgtatcaagaaagaatgtgtacatgtaactccaatatatttctctgctagagacttggatcacttttataggtcagacaagtcttgctgcatcagaataccttattctaaaatgtaacctcactattctaattaaatgcaaagtcagctgtctgatggaaatgtaaaatattgtatataagtaatatacaaaaaaaattgccgtgcattgaataattgacactattgattttgcttcaccaataagcatcttaaaatataaattacaaacatgcgtgaggcaagtactatcacagaattttcaagactgatgctttgcagtggatgataggaaaaataatacagagataacattaggatgcaagctgtataggctttgatattttctgacagaggggttctggggcatggagtgagttcctaaaaccactagtagtttgagttgaaacgtcatttgaaaaagacatcacaaagttcctatggcactgtcggcctgctgcattgaagaatgactagtttccttttttgttgtattcttcatttagaagtagtgctgctttaattggcattttaggattaaaatttattaaaaggagtatgattaaatgtaaaagaaaatatcaacacattatttttcaaagtcattattttcaacattttagaaaaagatcttattttttttttttaaaaaaaaatatatatatactaagacaattagacttccccaaataccataaaacagacctttggttttttacttcattgtaaattactgaaattcattacttaattgtatgctatgaaattctttgaaagttcatgattactttcaagttaaatttcaagttcattggaaaaaatacacaaagtatctgaatgcataatcttacataattttttccagaattttaattttacggtgcccataaataatccacttaaagatggaaaacatactgtgcttcagggaagtatgcatacaagttgcttttatcataaatatctatttgactctaaaggccaaagagcctttttgtaaaaacggttagaattgtcggggtaaatccttttacctatgtaaattacagaacttgttgcagaataatgtatatgtttctccaggcttctctggtgggtgataacctgatagtttttaaaagtgcatcagccacaatgcacataacccatctcaaaagcatcttgatattcctgatgcatgaaataactgttttgaatgactggcaaagtgtatgagatggagatacaacagtcagggaaatacacacgaacagaaaccaccaagaggactgccagcaatttcattgcaccaagtgtttattcaactgtggaaagatcatatttggcatagaaagtacattctttacagaagctgactatattgttcaacagataatttgcctttatggctgatccatttagacttaagctggaattttcatgacacaattcatttgctgaaagcatattgttgaaaatgtgaatactttgaagtgccaggttaaaaacatgttttagcacgatttctgattcaaccatacaatactggatggtggaatagttgagtaaatgattggcgacctggttatctttctgagttgtaggttctgatggttcctgacttgacttatgttgtcagaagaagtttctgaatgagattatttaaaaagatagagttagtaaagatggcttgatatctatatggttcttttctttgttttgaagacaacgtagtcttcttttgaaaaaaagtcctcaaaatggatatcattgatagtactagtgtgccatcttctagaggaagaaaccaagtactaggtaagaggagaatgtgggattctcaacgataccagagatcactcatcagttcagtgcagagtactatacctatgctcttcaggagaaattgatagtatgccagttgttagcatgagagaattttatatacggtaatatgacacttaacgatggagatacattctgagaaatgcatcactaggcgattttgtcattgtgtgacatcatagagggtacttacacaaacctagatggaatagcccactctacacctaggctatatggaatagcctattgctcctaggcttcaaacccatacagcatggcactatatggaatactgtaggcaattttaacacaatggtaagtatttatgtatctgaacataccgaaatatagaaaaggtacagtgaaaatatggtgtaaaagatttttttaaaaaggtacacctgtatagggtgcttaccatgaatgaggcttggaggactggaaattgcatcgttcattgaatgagtgagtgatgagtgaatgtgaaggcctaggacattactgtacactgctgtagacttcataaatattatatacttaggctacactgaatttatttacagttatttttctgcaataataaattaactctagcatactgtaacttttactttacaaactttttaatcatttataatttttgactcaagataacacagcttaaaacacaagtacattgtacagctgtataaaatgtttttctttctttatatctttataagtgcttttctatttttaatgttttttcttactttttaaaattttgttaaaaactagaacacaaacacatatattagcctagccctacacaggatcatcaatatcactgtcttctccctccatatcttgtccagctggaatgtcttcagaagcgataacacacaaagagctgtcatctaggataacaatgccttcttctagagtacctcctgaagaacctgcttgaggccatgttacagttaactttttttattagtaggagtacatgctaaaataatgataaatagtatagtatagtaaatacatacaccgtactgtaagtacataatattaggtgctagatttttatatcactggtggcacagtaggtttgtttacaccagcatcaccacagacacttaagtaacgcattacactaagacgtcacaatgactaccacatcacggggtgacgggaatttttcaggtccattataatcttataggaccatcattgtatatgcgatccattattgactgagacgtctttatatggctcataactgtatgataattaaagatacatatgagaactttcttgctgataccgtttggatttcttctgatctcttccattttgagagcctatgaagcagcaaatagaagcctaattacatttctgttctcctcccattccccccagaatcctgacccttgggaatgggatctggagccagtgggaagcattctccgaatatgataatgtggttatcttctgacgagtgctggcattatcacttgttgctagtgagcattttttaataaataatttttgctcttgaatcttagaaatctttaatatctttaaaaccttgactaattgatttttatcatatgttcaccctcttggttgatttagaaaaaacaccaggcttgttctgaggttcacccgactccactgcatgtattacgtgcatgtgtaccttggaatggaaaatacatgactaagccctgtaagttatgagctttccagacactataattcaggctggcatgctttcattttgtcccttctttcattcttttctttctgcaagagcttcctacataagaggatgaagccattgtcattttatagactttgaaagcttatgctcatcactgaaaattcatggcttgtcaagctgaactgcgtgggttgttttgccttgtgagccacgtgcattaacactggctgtattggtgatcacagagactgagggcagcatctttattgggatagccagcagtgctgaatcaatcacgtcctgttgtggttggatctgtatgcagattgtctttgcacagcatgacttaataaaagctggccatggtggtattttattataattatgatgacttagttgcattagcatcagcctcaatcacacagtaaaagaatatttggtggctgaactaggaagtgtgagaacctccatcatttgactacttcagatggtgtattcatgatccttgaattaaaatcaggcaggtaaaagggttttcaatgaaaaaaaaacatgaaaaaggagtttgaaaatatataactactaaggaaaggaaaataaagccttgaaaattggtatcgcataagcttacgtggtatcattttgtcgtttaaaaaaatgtgtctctcagtctttacttagaaatatgtatggaactttatttaaaagtttcccttaaatgtgaacttatgtaaaatccttgtttagagtctttgttaggctaccatttcagaataataagattttacccccatgcatgtgatccaaagcattacacctctccaagccacctactaatcttgtctattcaaatgggattttttttttctaaataggagacaactctgcactgtatcctgctattcttccaactgcaggacctcatggagcgagagatccaaacctttctgaagtactttaccttctacctttttcatgctactcaggattgaatcaattggaagccaacaaagccattctgtgttactgtgcctcctgactgtcagcacgctgcactgtgcatttagataattctgccagaaggcatttttataaaaacagctttcaaaatctattcttgaaaagacatttgtatactcattatgccattctatcatttatccatagggagttctgtaaataaaacactgaggtctaatactatagtagctgatggcagtaatcttgaacagagtaatttctttttctttatttatctcgatagtgcacagctggttatgaaaaaataatcacaaggctttgttgttggtggtggtggctgccttttttggacagtaagccgtgatgactcagagtctctggtagaaataattgctttttattttttgcatacacctgtcccaaacctcttttactctaagataaacaagatggaaatagatttaccttaaatagatgaccatccacatattgccattttaattacataattatgatttatctatatcttctaaacgttaagcatttgtgagtgggtgttttgctatatgacagaattagaaggtaaatcctgggccgagatgtgaaggacgagcagagctttgttgccctctcccagcataaggaggaatacacacagagatttggagtatggaaaggaatgtggttagggaaatttaacttcttcagatggctgttttgtcaggtacctgcagggggcagagttgctgaaggttcaaatgcataggcaggaacctgattgagggcatggaacaaaggatatggattttattcaataggattagggaccattgaggtattttcttcaggaggtatatgatgtgatataatttacctattttgaagagtgttccagcaacagtatggaggagagctattatttaattatctttcctggtcagtttaaataatcatagcatcattggctgaagtgcaaataaatagtataccaaaaaagcattgggcaaaatgcaaataaaatacattacctttataaatagctacatgctagctcttaacacagatcattattttttaaaatttaaaccactcaactgatctcatatagaccaatctttagctgttaaaaatatgaatgttacaagctaacccctaacttatacctttattaaaacacaagtattgaaaattttaaaagaaaactaacagtaacaaagacacacattttttcaagcaatttattatgtgatgctgacatttttgagagaccttagacaatgatttttatttactaatgttaaacattacaaagtaaaattaatataagtaaaatagtatttttaaaaggtagatcacaagaatatactattagtagtaaatatttaaaagtacccccccaaactacatttcattactatattctgtcatccaggtacataccttggaaatgttttggcacagagtatataataacaaaaacaaaattggataatggcattgttctacctttatatctctgattttttaacacagcagaatttaataaatgctatgtgtctgcatataaatgtatgtgtgtatgtatttaacaaacaccatgtaggccttattatgtgcaagatactgtcatcagcactttttttcagttattctcatatatttaaaagaataaatgaaggcacaaatgaaaataaagaagatatggtaatcatatagctcattaatgttcagatatttttctccactaccacaagactgatcactttgttgtctgaattgccatgctgtctacagacccctcatctagttacaaaactggatgaaatgctttatgcttggttgttttcatatacttgtcatataattctgtttctgggtgttgttattaccagaaaggttgataatttgcaaaataagtacagataagtgaaaagagttcttttaaaaacctaatcttttttcttataccccagggagaggcagggctagagaaagagcaattcagggtcctctgagtgttctcttcattgcgatactcatagaattaactgtgcttttttctcttttctggattttgtatattgtatgactgacaaaaccacccctatttatctctttttttttacccctttgtgtatgcatatgtggttttttttgttctcatatatatgagaacatatttcatatatatttaaatatttaaatatatacatctaaagatatacatattaaatatacacacctaatatataaatacataaattatatttatatttgtaaatttatataaattttactcatggtaaatatatgattatcattcaatcaaaatatggaatattaaatgattaatttacgcatatatttccataatattagtcatctaattatatattactctttgttaaaacttaaaaggcctggaattaaatcctggcttgatgtatgcatgaagtgattaattaattcatttattagttaaactcatattttctgaagacttgtttcatgctagtgggagcccccagagtatcacaagtttagtgggtaagacaccctgtgtattaagaattattcaagtgctcttgtgcagggacctacctaactaactttcacaaaatcattcaaataatctaaagttcattgtctttgtttccctttgataaagtgaggataacagtatttgtcctactacctaggaacagagttctaatgctaattaaataggataacagatactacaaagcacttcctaagcctgaaagtgctgtgttgtataaatgatttagtagttcactgcttctcaaagctgattatctactagtttgttctgcataagaaactgaaggctgcttccctggagtttcttccagggaatgctgcgttgttttcatggggtaaaccacacacatcttccttttcttctacaattttgcaaggcagttataaattgtcataatcttctctgtcaagatgagcatttcaggtgtatatacctgttttatacataatatagttttaaatatcttgcagttgccaataatatcctctgattattcctgttttaattttttaaattgagactatttttagagcagtttacatttacagaaaaatagaacagtaagtgcagagagctcccatatacccactgtcctcccacacacggcttcaagtttgttttttaatcacatgtggttgtcggaattgtacacattatcccagatgtgatctagaactaactttctgtgatgctaagtagagggagaagtcaaagatgatacccatggtgtgcagtgccattgggatgtcagtcatttactcatttcagtctccaggaaaaagtacagacgagtgagtagagaatgatttcagtttttatatattatgtttgaggcatctgtgagatacccatgaagtcaggtacatgaggtacctagtgtgagattgtggctctcaggaaagaaagctcttaacagatgaagtgatggtggagttattagtgcaaagacagctgagatccctgaaaagtggggttgagcaagagaacaaagaggacccaagagagggcatagaaaaaactgaaggaacaacagaagatggagatgtttcaagaaaaatcagagttgtatttgtttggtttggttctctgcagaggcaaaatgaggaaaagggtctttgcatttgatttggccttactggcttcagtggtcttagcagagcattaacatcacagactgaagctggttcgagagtcctgagacatcaagaaatagagacagttgctacaagtgagttcagaatttggaatttgaaaaagagaacagagttatccgtgtttgcaaatagcactgaaaatcaggaagttagaagttaactttatggccagaattttggaggatgttttatctactttcagctggactctcttttatcatcgcaggtttcttcttggcactttcctcgctagctgccagacaacatgctctgatttttactcagtcatgtattgtttttgtctccccaatactagtagaaataaacatcccatccatgtttatattgattctaggttttaatttttctgtttgaatgtatatttcatttgcttatgtgtggattatagtgtcatttatcaattataatttccattaattctggaatatttaattatattttgttaacatttgtgatatattttaactctgtatttagctccgtcaataatgtctatcctttcgacaatacaaaattctaatgatattataaattcatgcagttatacttcaaattaattggacatttaacccatgaaaaacctatatataagacagtcattgaattcaaaatacagaacattcaataaagcgttagttttaggatgctacaagtgtacgatgatacaagcgtactttgtggtattcaagcaatcttgtaaaacatgccaagcagcttaaatgagcctactaaaataaaaaatattaaatatggtaaaaaaattatttaaaaaattatttatatcaaatgttgcactaatggggtaagtaaaactttattcttttatgctatggctggattataaaataatagtagcataatataatttttcacaattataatttatataagaaaaatattttgttcaagttacagaagaattttaattgagataatattacaataaaagtgcctataccacagtcttaagtctagaaccagtcagggtttcaatccaggctttgtcatttaggagctgtgtgtccctgggcgaaccataaactctctgatcctcagtttctgcatttatataatagggctaataatggtaactacttcataggtatttgtgaattttaattacgttaatatatgtaaagtgatcggaataataattgaatatgcattacttgaatctaatctctcccctatttttgtttattgactcagtctacaagtgttccttgagtacctaatgcatatcaatcattataatatggtcttaatacttaaaatggttgcaggtgtacccttgagaaagctcacagtctggtaggtaagagttatatcaaacaattaattgctacaaggaaaaagttacagtgatattacactatgtaagagggtgtctctcctagaactttatcacacaaaaaccacccttactgaagagctatagtaaactgagaccaaagtatgaaggttttagccacctgagagggataagttccagggaatgtcccaggtagacagtagagtgtctgagcattcagaagatgcatcagaagatgatggatgaggataatgttgttaaagataaatgcactgactgaagagaaatacaggtgtgatgtgaggcaggagatggaaaagagaatgatctcatagaacccagagttcctgttaaggatagtaacttatgtaccctaaatcattttggttttgttattgttctcctactatcataaaggtgacattattagatttgtatcttttaatggagggggactttctactttattgtgtgaatttggcttaatgagcatatgtataaatcctataagtcttattatgatggttattctgactgatatggtcagagtatgatatggggaagattaattgaatggtaaaagtgggtgtggagaaatgaggaggcaatttagtaatatagaagagggatttttagcatcctggcatagaaggatggccatagaaatgaagaaaagaagatagattttagaatccctagaagatgtaattggtaaaatgtggtgataggtaggtagaaaaagagatgagtatactatgttttcaaggtttctggtttacacaaatgagataggaaatataggatgagatatagccttagctataggggagttcataagttgagcatgagacttttttttttcaaattagttcttgattactctagaacttagagcaaactatggactgtctacataaatctaggagtcataaaatagagatggaaattgaaaacatagaactggattgagttatggagaaggaaagaatatggaataacaaagaaaagcgcttaagagcacctactgccctaaggaatgcgggcatttaatgatcagttaaagaaggaggaactaataaaggaagctaaagaggaatccatgggaatgtggtgacttagatgtctaagaaagagatcagaagtttgagaagaattgagaatttcagataaacatgtggattgccatgtgttagtatatcctgctcaagggtggtatccataaattttatacagatataactgaactctgagatttttccatagtacttagaagctaagatgatttgtatctgtttagggttggagctacttagggcacatgtaacaaaagcttgaaaatataaacaagtttaggttaatggtagagatacagctgctttgatgaaccactgaatctaagttgattggtctttcatcattattctcatccatcatcttctgactaaggatagaattgaagtcagaaagcctgatagaaatgaataaagtctaagttgttggtaaaaggtgaatgattttcccatctcatcatgtctcaatcaccacaaggacactgtcttgaaagaacgttgtctctccattcagttcttgggaagaactataattaatcatgttgatcagagctggacatttgttgaaacaagttttgctagcaagctaaaatattgtacctccaaagcaagagccagtttggcttcttcctttttaactatctggcttcctgctttgtgcttcatttgcttctcctctgcctttggtgaatgatattttgcatcatgtctctctgtgagagacaaagcttgtgaagagggctcttcagacacaaaacatgctgattctgaccccttcatccagcaaatctgcatgcttagccacgcagctgggtgggtaggttcacttacctctgtgagcagttccaagacctagattcagagtgggaagatccctttcaacctcaagtctaaactacattctacaacttgacataatgaagagattatgaatggtgttcctgcctgtgtatgatcccaaatagtgagaccttgactaagttacctaacctcacgattcttcatctaaaaatgggaaatgaataacactgtcacaggttggtagtgaacattgaacaagttaatacagggaaagcatttacgcagtgcctacagcatcacacttaataaatcttagtttataaaaattattgttttatcagagagcgttttatggcagtttagagagtccttagatttatttttaattttttaaaatttttatttaaagtattttgttttattctttctcatttgattggcgatccttgaatacgtattcctcctttgctctaggggaaagagggatagtgggaagtgtggacactctgaacctctaagagcagtggaagaacaggtatcctaaaggtaactgagcagataaaaggaaaagacaggaagttggtcctggaagtatgggcagcatgaatacgtaccatgctagagtcatatagctgggaagacatggaacccaaatttgaaccaaagactcaaaaggctcctaagtcttactcttcccccaacactatttttcagttgttttcagtgcacctaagaaaattaagtggcagtcatttattaagccagaataaaaaacaaagttgatttatctgcatgaaacttgaattacatcaactagcttaatttttttgttggagtaaaaacaaagctatggaaacagatgaattcatcgcttatttaaaaaaccagctcttgaaaatttcatgtttgttatatttattgttgtagtactttgtaagttgtctatattcagttatttaactgagtatattacctattcagcctaaagaaataaaaggaatatagtattattgtgataagggagaaaatttatttatctaggtacaaggaataacatgggatgttaattttaacatgtgcattacccaactaatatagcttttgtttcctttatcacatttttccatacttcctaccctacacaatttgcctcgagtatttaaatgtggaaaaataacggggtaataaggtaacatattttttcaattaaagcgtggtaaaggattttgaattttttaataaagaattttacttttttagtattaaacaacaaaatattgagatacctaagaaggtaatataagttgaagtactttataagctttaaatagtgtatagctgtaagatgatactgctattaaaaaaataagtaatactatttatataaaattctcaaatttctcgagatatatctaaattattttcattataatagtgcatttaataatcatatcaaattacatttatatccaaagcttgttggttaaacaaatacatgtttaaaatagttgagcttgtgaaaatgaagtttggctctatttaatcttttgggatccagatgcaacttgaaaatggaaagaaatcatattaatttaaaatattgctatgtcatacatttttttaagttgattcagaaaatccaagtgccatcaaatgaaaaatacatctagattgtaactatattaatctagatatataataaggcaatgctgcttttattttgccttacaatgaatcattgctcagttatcatatattgaaacatactattggcaaaccatacaccaattcccagcagttttcactggagacagtgttacaagaggccattgaatttcacttttttgaacctccgttgctggggcattggttgctggattgttattctgttagcatgatgaactaattgacctagcagggctccctgtagaataacagcttctgcttagttcatcaggagtacaatttgttgtttcatttcctcttctagtcccattggggaaattgaattgagaaaagactacctactgggagcgttcagtgctcatgactgaataagtaactttatttatgtatttatgtatttatttatttggtactgtcttaattagcaaagaaggaatgactctattaggcaagagtcgactgtgtttttgatacaaatgaataagctccgttagcaaaacatttgattcacagagacttgtcatagtcagggccccttgcaggtgcagatcttacataaaattttaatttgctatggtagagcagttttctgttttataattgttattcattcaatgaagacattgaagacaagttaatggctgttaactggacttaaaaaaaaaacaaaaacaaaagcaaacacccataagttggaagtttggaagatagattcattgggccgcatacaaacatgaaatgtcaactttgcctcaataaagatgaattatttatctacagcagtgtccaaatgtggacttgaacagtttgtcattaaattttgaagcctttacaatttttcagttgcatcattgtttcattagtgtgtgcattcttagtcaacaacagagaacatactatctgaatgtaatgaagaatgaagtctgatgatacattttacattttttaagaagctattactagtttctattgtgtcttagcaaattcttaagtgtattaagcagatgttctaggctatgatttaaacgtcccctatattacaatctcacatattttctagaacactgttcaatttgttgcttagcctgagagtaggggaagagtagcatagtcattataaactcttgctctgaaataagatatccctgattcacatctctgctctatccctcacttgctttgtgaccctggacaagcagcttaattctccgagtttcataaggttaagttttggataatgagtgttcctataagggaagctcttggaaaagtgcctagcacataggaactgctcagtgggtgttagcagttattacatgtatttcctaataatccagtgcaaaacctggtgcaaggtgtgtgctcgaaaaagttcaccaacgaatgaatgcatgaatgaatgaacaaggggaaatcttgcccagaaaacctagaattattagaaatccttgtctgtcctacatatttaaacaaaacagcacatttctgtatagttataaaattatacccaaatgtagaaaaggctctaaatagcttggaatctgtatttatataggagaaacttaatatccacaaaatcattacagtatcttgtaaagaattgagagtttactcacaagatcgtatgagtccagatgactagaaatagcatttaaagggtctaccattaatacaatattgtgaaatactggtatttttttctggagtatgatttataacatttttatgaacctctgtaaaagattttatttgtatataattctctgatttttgaagtgagggagaaagactcttcttgtgctaagtttgtacatgttctatgccagatattctgaatttaaaaaatacatataacacatgatttctttgtccaaaaagtttataatctatctacttgggttggcagttgtgatgcataataattaggatttaacatatacactacactgcctattatatatatatatagcattaaataatgtatcacatactctaaatccatacattaggaatttaagaaaataaagaaattttcttcaaccactgagtatgtcctgcttccctttggattgtatttatgtgaaactgttgaagtaagataattgtctaattggatttcttagaattctcagaaagttttgaaatctaggaaaaaaggtgaaaacacagaatttgtattatgggagttgttttatattatactaagaaataggaggacagaaacatttttttcttttcatgattgttatttaagtaataagatgtgtgagagtgtaaagcatagtgtctggcacataataatctttgtgcttgccgttcttcactcctttataaatccatgattatcaacaggaaaacatggaggctattgtaatcaaatttaacccaaatggaaggtggtattagtagactcagtggtccatggtggccataatgaagcttccataagagatgttatttggaaaccaaccagttatttctgtttttggctaattcttcaaaaaaaaatctccatttgggttctttcttttagaggaatgtggtatttttaaattaatttaatttaaaaatttttctcaatattaggacataagatgactcgaatacatatattcatatgatagaagagtaatttttatctttttaaaatatgacagcaacaataatattcacaaacattaccttggctgttcttggtcttcttacaattagtaagaagttgggcactgtgactggatctggacaatagtatatgatgtgtgtcacttttgagctaattcagcccttgtatgatactacagtctctttccctgccttaaggaaattattatcttctcaataatggtcccaggtcaatagatttacacaggtaaacaactgaatcttcctctttatctcagacctacaaaaaaattaattacatgtagattgaatgttgaaagatgaaagaccaaacaataatatttcttgcagatatcatagaatagtttccaaatccttggttaggcattattgttttttatataagacatgtgaaacatcaattataaatgaaaagattgagaaactcaactttattaaagtttaaaaacttatcaacgatactatttcctgaataggagtgggagaagggatttgtaatatatgtaaccactgaaggatttacatacagattctctatctttaaaacctcttacaaatcaataagataaaagcaaataacccaataaaaacgaaagagaggaaccaaattattgaataggcactcaaaatgagaatatacaaatggctcataaatacattaaaaagtgctcaacattattatccatcaggaaaataattaaaaccatagtgacataccatcacttatctattactatgactattaaaactttcttaaaaaataaactgacagcaccagtgttagaaaagacaatacaactacaaggactctcaaacattgccactgggggcataaatcagtacaattagtatggaaaactgttttgtagtatatactaaaattaaacttattcattccctatggtctagcaatgccacttctaggtatacagtgaacaaaagcatcaatatttgtatatcaaacaatgtactggatgttcattacggtggtattgtttaaagcccagatggaaacaatgtaactgtcctatcaacaatgaaatacaaaaaaataaacgagaatattcgaacaatggattatcatataacaataaacaaatattgctacatacagcaacacaaagtcttccagcataatgttgaacaaaaaaatatccaggcacaaaatggcttcctttatataaattttatttcttcaaagttcaaaaatggcagaactaatctgtaataacatcaaagttgctttttcctttagggagataaatgactgaaaagagttataggggagggagttgctagtaatgttttgttttcttgctgcaaaaacacagatgagtccattttgttaagcttcattgagctgtatatgtatgatttgtgcacttttaggtttgtttattacactgttctaaaattcaacacagtctctaagcaacttatttaaaacagctcttttagtaactatactagaaacagaaacaccggtcaatataatctgggaaaaataattatttttcagttcatgaagaacaaaactagactaacaaatgttctagaaacgcctgccttttgttatttatccttgacttaccaaatgatatcttccccctccctggccctgccatctcttcgactaccctccttcagcgttgctacttggcaggcatttgtgaggaacttgactttggagtctcagtagcttagtcccaaacaagccagcacaacatcagcaaactcaattggcaggaacataaaagtatcttcagaaggccaagggatataatgtgaaatctctgtttgcctaccttttttgtttgagttaagctaaatggaagtgatttcagcaaaatatgagatgtctcaggcttttgattgaattctggatgtggaagtagctagggaaaactaaaaatttttttggaaagttcaagcccctaagtttccaatgaaaaatttgcatagtggaggaaagccaaggaccaaagataatatctactgcactgtgaaaggcctattctgtgatcaaaagcaaaaataaaacaaaacactttgattggcagtgctcaagataaccaagtcttttcaagcagatgctgtgataggggaacccatatagaaaagcagagaaaaaatgcgagaaccgtggtgatcagcaactattgttatctccacctgcatcaaaatagtgataaatgtaagtaaattataaagttccatacaaaatacagtgagttgtatgcttaatattaacgggttttactcatttgtttaacagaggcttattaaacagttttttcatctcagcgattagctgggcttgtaatatccagaccatcagacatctagctccaaggactcataaccagatgataggagaaagaagctgagattataatactgcgataaaaacatttatataaaaatgtagttattccaccagaagaatgtaaaccacagcccctaagcccttgccaaaccccttctcagaccttgaccttccattaatttgtctgtttgaaccctaggattttgcacattttgattttttgttctaggtgaaagcttgagagttccttgcctctactatgcccagatctcagcccaaagccatccctgatcccctttcccctgcaggacgaaatttcagtttgctgactctgctgtgctcaaagaaccttcgttttttgtgattatgtgcttatttttagtttatttttttacctccttctagcgctactggattataagttactttgggatcaaggccatttctatctcactcattgtggaaacccagcttctatcgctctaatagtccttgagtaaatgatgagtgagctgcagtctgagaagcctaggggacagaatgactcagctgcttggaggaaccaagaaaagcttggaacagaacagagtttgcatcgctgtggctcatggtgttgctctataattacttaagtgacagttttcttatacagacactttgtcctagacaatatgtaaatggaaagaaagaataccatctacttctaaattaacagctcctggggctgcttctcccacccccacctcccatatgcacttgtgctcatatgcatttgcatgtaatttctgtagtaccacagatctgctaaagcccatcagagactgcagctcacgaaagctgccatgtttttccttttaatttccaacttttgttttaagtttggggtaccatgtgcaggatgtgcaggttggttacataaatgccatggtggtttgctgcagagatcatcccatcatctagatattaagcccagtatccattagctagtcttcctgatgctctccttcctctcacttctcgccctacaacaggcccctgtgtgtgttgttccccaccatgtgtccatgtgttctcctcattcagctcccacttataaatgagaacatgcactatttagttttctgttcctgtgttagtttgctgaggataatggcttctggctccatccatgtccctaaaaggacatgatctcattcccttttatgactgcatagtattccatggtgtatatgtaccacattttctttatccagtttatcattgatgggcatttaggtcgattccatgtctttgttagtgtgaatagggcttcagtgaatatacatgtgcatgtatctttataatagaatgatttatattcctttgactatatacccagtcatgggatttctgggtcaaatggtatttctgcctctaggtttttgaggaattaccacactgtgttccacaatggttgaactaatttacattcccatcaacaatgtaaaaccattcctttttctccacaacctcgccagcacctgtgttttttaactttttaataatagctattcttactggtgtgagatgatatctcattgtggttctaatttgcatttctctaatgatcagtgacgttggattttttttcatatgtttgctggccgcatgtatgtcttcttttgagaagtgtctattcatgtcctttgaccactttttaatggggttgttttactcttgtaagtttttttaagttatttgtagatgctgggtattagacctttgtcagataaatggattgcaaaagatttctcccattgagtaggttgtctgttcactctgttgatagtttattttgctgtgcagaagctctttagttgaattagatcccatttgtcaagttttgcttttgttgcaattgcttttggcatcttcgtcatgaaatctttgcctgtgcctatgtcccaaatggtattgcctagattttctattagggtttttatagttttgcgtttcacatttaagtcttggttttttttcttttctttcttttctttttttttttttttttttttttgagacagagtcttgctctgtcacccaggctggagtgcagtggcgcaatcttggttcactgcaacctccgcctcccaggttcaagcgattctactgcctcagcctcccaagtagctgggattacaggtgcctgccaccatgcccagctaattttttttttttgtattgttagtagagatggggtttcaccatgttggccaggctggtctcgaactcctgactaggtgatccgcccacctcggcctctcaaagtgctgggattacaggtgtgagccactgcacctggctcacatttaagtctttaatccatcttgagtttatttttgtatgtggtgtaaggaaggggtccagtttcaattttctacatgtggctagcctgctctcccagtaccatttattaaatagggaattctttccccactgcttgtttttctcaggtttgttaaagatcagatggttgtaggtgtgcagtcttatttctgggttctgtattctgttcccttggtcttggagtctgttcttataccagtatcatgctgttttggttactatagccttgtataatttgaagctgggtagtgtgatgcctccagctttattcattttgcttaggattgttgtgactatagggctctttttttggttccatatgaattttaaagtatttttttctaattctgtaaagaatgtcaatggtagtttaataggaatagcattaaatttataaattgcttttggcagtatggccattttcatgatattgattcttcctatccatgagcatggaatgtttatttgtttgtttgtttcatctctgatttctttgagcagtggtttgtagttctctttgaagaagtccttcacttcccttgttaactgtagtcctaggtattttattctttttgtgaaaaagcctgatgttttgaagcactggcttcctcattttttgtgtgcccagacacagcttgtcgaggcaccacattcagcttctatgtacctttaattaactagcaatattagtagataacacttactatgcatctagcatattgtttcatttaacaatggtaaccaacttatcataagagaggtccacttatcttcccagtatatagatgaggacattgcactagagagattaataacttggcaaacacccacagcttttaaggattggagctggacttcaaagccagggggtctggcttctgggtccttgctctcatccaaacctctaaactgacactctagaatcttgctgcatttcaggctttgtgtcttactaggaaataagtatgattatattcattttatagtcaaagaaacttgaactcagcaaggtccagtgacttgttttaggtcacttacatattagtctgtgatagagcttcaagataacccaggtgaatcttactacaaaatccatgatctttacactacattagaattcaaagcatctggcacatagtaggtgctcatctctgaaaaggcaaagctggaaaaaggcaaatgcagggtggattgagccaatatgttttaagatgtttggttttagtgtgtcattttgacacaaggagtttgaaaactcttcggtgtgcactcccttgccagcgcaggaaagtgaggaagagaggacagccgcataagaggagagtgtgggaaggcaagaagctaccctactgcaaatggagagttgtgaggaaccatcattaatgttctttcatacaactgagagttgtgagaaaccatcattaatattctttcgttttatactattttggatatgggctttggaagacaatattttcagggttattatgactcagacccagtttgtgccatggccaaatgcagggatgcacacacacttacatgtctgcatttatatttaactcttgaaagatggtcaaaaagatggtcattttcagcttggttaattaaaaaaaaaaagaatgctcacgttcttgatttttcaatgtttttatcaagaacaaatttgctgactcttgattctcacctctactatacagtaggtttgatgtatagctgaataaaatgcaatatttgctatatgattgatttattctcttaactcattaagtgtagtttagtgtaaattaatcatcttataagagaaattgtttttccaacaacaatttactgcatattttatttttatcctcaacctatatcagaactgctgatttaatataaaagaaaatccaaattaattgttttgtatgctatgataaaatctttcatatttatactgtaaactaacagagtagataggcaaatactattttgtcatgcaagcatcattttatttcagatatctgaggcctgataagttaccttattactcataatttttaaataaaatttttaaataaaaactttattgatatggaattcatataacataaaaatcatgcttttaacttatacaatttagcgattttatattttcatagagttatgtaatcatcaccactatctaattttaagactattttccataaccccaaaaagaaatcttcagcccattagcaatcattattaaaagacaattatttttctatggaattgtcttgggacctttaggaaaatcaatcatgaatgtaagggcttatttctgtactatcactttcttcttctttttcaagtttgttttgtcaattctggatcttttgaatttacatgtgaactttaggattaagattgtcaatttctgcaaaagcatcagtttacattttaatagtgattatattgaaactgtaaatcagtttgagtagtattggtattgtaataatggtaaatatcctgattcatgaaaatgaatgttttccatttatttactttttttctaagtgctgcatccagtgttttgctttctctgctatgattttgttttcattcaccttaaagtattacataattttcttttgttctcttcccttaaatcactgcttatttaagtatgttgttgaatttcacatatttgtgaatttcccaaattttcctttgttatttatttctaattttatttcattgtgttaaaataacatatttcaatattatttcaattcttttaaattgagacttgttccggagatgttccaggtgcatatggaattaatgtgtatttttattgctgttgcgtaaagtattctatagatgtctgttaggtttagttgatttatagtgttgtttgagtttctattttgttactgattttctgtccaggtgttccattcatagttgaaagttggctttgaagtctccaactataatttataaattgtttatctctcatttcaagtgtggccactcttgctttttattttggagctctgtttttacgtgtcatgttaatgattttcatgtctgcctaatatattgatcattttctaattatgaaatatacttctttttctattaacagattttttcctattactccagctttcctatgggtactctttacacaataggtatttttccatccttttattttcaatctatttgtgtttttgaatttgaagttagtatctttatatggcatctaggtatatcatgtttttgttttgtttttccattctgtgaagctctgccttttgatttcattatttaattcatgtactttacttagtaaagtaatatttggtccatttaattactgacaaattaggatttatgtcagtcattttgtaatgaatttgtcatgttttgctatttgaatttgttttccatatgttttatgtgtttttctctcttattgcttccatagtcttttctaatgtaaaatatgtattttctaaggtgcaattttaattcccttgttatgaaatttgtttttatatttgtttattttgctttgtttgattttctagcttctgctctgcagattacaattaacctcttcatttataataattgggtttgttaaattaattaaataccaacttgatttcatttgtatacaaaacctgttccaatacagcttgtgtccccctagctactttatgctgtcattgttatacagattacatccttacccatcctaggtctaacaaggcaacttgtaactgttgctttatgcagttgttttttaaattagatgaaaaaaagttgtgaaaatatatttatactatcttttatatttacctatacagttacctctctattttttcatgtgatttgaattaccctctagtgtccttttatttcagcctgaatgactccttatagtatttctcttacagcacatctactagcaacaccttttttaaaaatttttttgttttgttaaatatggaaatatccaagcttctccctcaatgttttggaggatagtatttttctgaatgtagaatccttgcatgacatcttccctcccacccttgaagaatttcaaatatgttatttcattgccttttgacctccatggtttcggatgagaagtaaactattaatattcttgaagatcccttgtgaatgatggtccgcttttttcttactgctttcaagagcctctccttgcctttgtctttcagcagattgtctatgatgggtctgtgtgtggacttcattgatttcatcttacttggagtttgttgagcttcttggatgtatagatttatatttttcatcaaattttggaagttttcagccagtatttatttaaatatttttattctattttttcctctcctctacttactgaattccctttatgcatatttttgctcagtaatggtgttcagcagatctcaaagattaatgaattttgactgaatatttatataagtgtgcagtggaagaaggaaatattttgtttcagataataaaaagtctttatactggctgtgcgcggtggcccgcgcctgtaatcccagcactttgggaggccgaggcgggcggatcacgaggtcaggagacagagaccatcctggctaacacggtgaaaccccgtctctactaaaaatacaaaaaattagctgggcgtggtggcgggcgcctgtagtcccagctactcaggaggctgaggcaggagaattgtgtgaagccaggaggcggagcttgcagtaagcccagatcgcaccactgcgctccagcctgggtgacagagggagactccgtctcaaaaaaaaaaaaaaaaaaaaaaaggctttataaatatttagaatgctgggaggtacagcttggagaagtgaatatttaatgttaaaatgtgtcgttattataattatagcagatataattttgatcacttaactaattttttcaatattaccaaatttaattctttacataggaataattacagaagctttattaatgggttaagatccataaggcaatttgtaaataaacctatttgtctcaaagttccaggttgctttactacagctttattatagctatcaatatgttttggctgagagcagggtcagtgcactctttccagagagcatgaaagcttgaaccttagtagttcatatgtagagtgattctgtattcccattttatagatgaggaaactgaagctcaaagagatttaacatttttaacataatttttgttatattatcaaagatacataaaattatgttccagactggtagattataaatagtttgtgagcggggtctttgatttattaaattcttatcctcagttccaagaacataatagatactcagttagtgatgacacagtattagaatcaaccaattttacaatatatcctggccattgttgaggcatttatttcctgtactctatagattttatgtgtataaatctttggaaaatgtatcaacatgatatttgtatattgaaaatgtcactcttgaatgtattattgtcattctttctggattcgtccactagggctaccatagcaaaataccacagactgggaagcttcaagaacagcatttattttctcatagttctggaggctggaaatccaagttcaaggcaccagcagatttggtttgacatcgggttcctgactttggcttgcagatggctgtcttcttgctgtgtcctcacatggccttttctctgtgcaagcactctataccattcctattggattagggccacatacttattatctcattacttattatctcatttaatgtagttacctccttaaaggtcctatcaccaaatacatttacgctggaggtgagaacttcaacatatgaattttggggagacacaatttaatccataaaaccctcttttgtgtaatgattctgagatactgagaaaaatgctccatttcaggtatttttaaatgaaaaaaaaaatcgtatcaactcctgccctttaactttcaaagttaaaattcatgttagatgattatttgttttaaaagtgcttactctggtgtgctttttaaaagactataaatcccattaataaagtcgaacagaagcttgaaaacaattaagaaatttaagaatgagctaaattgttctcacaaaaagaggaaaactacaattcctgctgaacaagtctttcattcagttcttcattcaattcacattagcctcaattggaaaaatgtccctgttcagttaaacaagttaagcctgatcttaagtgtatctgacttgccttctatgttcttccagccacaggaaattcctccatgccaattttttaaaactgctatcaaatcttttttttttttttttcactcaagtgcgacacatttaaatgtgaccacaggaacaaatggaaagagattgaagccttgacttgaaatgtgagctttcctctttactagtcagtaaggtattgagaaagttacttgacctcatccttcattaccttgtctctagaattaggagatcagcatgtatggtgatcatggaaattaaataaaattatatgtcagggcctattgcatttattgtctgactcatcctaatccccttattcctttcttagtgtttctttgtttgttgatttatttttgtccatagtctcatgatttggagatagggctccagctttctctgctaatgtatttcctacccctctcttcctctgtcagtgactggagaactatcttcttctgacatgcccagctagcttctacttcaggactttatatgcctgcttcccgcaatcatatatatatgtgtgtgtgtatatatatatatatatatatacgtatatatatgtgtgtgtacatatacgtatatatacatatacatatatagatatgtgtgtgtgtatatatatatatgtatatatatagagtcttgctctgtcaccaggctggagtgcagtggtgcgatctcagctcactgtagcctctgcctcctaagttcaagctattcccctgcttcagcctcccgagtagctgggactataggcgcaccaccacgcccagctaatttttttacttttagtagagaagagctttcactatgttggccaggatggtctcgatctcttgagcttgtgatccgcccgcctcagcctcccaaagtgctgggattacagcctgcttcccacaatcttaaccagtcttgtctcatcttcacatagccaactccttcttatccctttgatgtgtacaaaaatcacttcttcttgtggcccttataatcactcacatcctaaatggcatatgtgttcctactatgctccactgtagcccataactatctttcaccttgttaaattttcagcactttccactgtatgaaatgatcttaaggggttgtcctgtctctcctatagtagagtgtaccactggaagaggcagagacattttctgtcttaatgttggtatgtagtggggtctgaccatcaatatcagttgaattggcatgggaatggatgactctgtacataggaggccaaacaaataaaaattttaaaaccgcttatctgacaggatcacgcttttttcacttcggctgttgttagttttaattctctgaagttatacatggttagataaaatggtctatgaaagtcctgggtggtgatgggactagagacaaggattcaaaatgtattatagcaaatttatgtgtagaaaaaaacacgtggttaattaagacttgctttctgtcattttatgaaggtatctatgtaaggtcctagttttctccattatacatagctgaaagaaacaccagtaatgaaacgtttttgtattattctcactccaaaagcctagttatactgagggcggccaatagatctactatgggatacaatgaatatttaatttactttgatgaaaaggtgtcataagagcctttgacaacccacagtgaaaacttgaggatgattttattaactcaaacccgatagcatatgttgtgcaaactaagacatcaaagactttttaaattaatacctgggaatttcttgggagaagtaactgcatattaggattgagaacaactctaagttgtcacatattgaaatttgtttttaattactgaaaagtcattttctcttatttctggctcgggtaaatagtaggaaaaataacacacacatacacatacacaaatgatatcaaattaaaagagagaaaacaaatgtgaaaggattatggtgtgaactgtttgctttccagcatattaactgtacccatgaactctcatctcccgccccacagaaaaaaactaattattggaattttttagtgaacaggaaggatatcagagtacgatactttctgtttcccttaaatgcataccattttctctattttcatagtttaccagtttcccagtagatggcaccattgtgactcacaatgttgctccaccttgtaaggaagtattatacacactttcaatttcaaaacatttgtaaatagtgcagtatagtaacacttgcggtggtgtcttagaacacaaatacttctacagtatctagaagacatgtcaactgttgaaagccaataaatgtcacaagaacccccgtaattcctttgtatatgtgtgatttcatatcttataatttttatacatttaaattattttaataaaaatgtgcttacatacatgtacacacatatgtgtatgtatgcttataaatgtctaaaactgtataattatttaatgatttacttactactcttactatttctttctacctggattaatgtgacaagccactcagagaaactgaaaattcccatgggcttctccagttgttcttgggaaaaaggagactagaacagtgatttcagatctggaatacactggactccaacctcagattttctctttgctgcctgtattacctaaagcaattgacataacctctctgatattcaattttcccacctttaaaatggggaagatggcatatacctggctgtgttgctgttaagggtaagttttaagctgtgtgtgtgtgtgtgtgtgtgtgtgtgtgtgtgtgtgtgtgttgcaaaaataaatacagtgactgttatagagtagaagttcaaaaatggtggctgcattccgattacagcttgcattaaagttgaatattaagaacaggagagatcgatgatggtgtgttttgtaaccttcacacggttttctatatcataggatgagtcctagctttcagagatttccttgcgcctatgtctaccctttcttttggtcctagaaaaggtcacagatttaaagtaagtcaatgtggaacattaacatggctcatgcaggttctgtgcagctgtctctatgggttcttgaaataaaatagggccaaaccaggcacttcaaatggtagatttgaacaataaatgataaccactgtctctaatatccaaatcattccctactcatccttctttaggctcatagttcattgcactgtcttcttaaataactacccgaacacaactccacttttctcacttctaatgcgtacatttttagcaataggttttggttagggtcttctctgtccacatactacaactgtgagtacatgactgacccacacttttaacttggtgcttttggattcaggcagatgtttagttccaagaagcctttgagaatcatgttgtacttacagaagcactcactatgcttccttttccaagtgattagtctttcactattaattcattcaacaaatattgatgcaacactttgtatgccagttactatgcagacactaagttgtgccctcatggtccttcaactttacctgaaaataatatattttatttatttaaccaatattaggtatcaagtgttttacaaacattgcctaattttatccttgtagaaccctaggaactagaggccatagattaaagatgtggaaactaagacacagagaataagacatttacagaaaaagaagtgaaggaaggagggaaggaaaaggagagagaaagggagggagagaaagaaaaaagggaggaagaaagggaggaagagattcaaatgttgacaccctaacctccaatgcagtggtatttagaggggggtacttgggaggcaatttgatttagatgaggtaatgggccaggggctctcatgatgggatcgatgtctttataagaggagacaccagagagcttgttctttctgtctgctgtgtgaggatacagcaagaagaaagccaggaagaaagcccttgccagaaacagatcatgctggcaccctaatcttggacttcttagcctccagaactatgagagaataaatttctgttcttaaagccacctagtctgtggtattttctgatggcatccctagcaagttaaaacaccattttttgattttctgaaactggtacctggaggtagaatggagggaattaaaagaaaaggtaattagtagtgtcagcattttagcccagatattaaaatggggatgaccttcagtttcctaaatttgatgaaggatttggtgaaggatgagggatgtcattattgaaaaatatgtatcagactttcgccttttccaagaagtcagtcacagctttcagatcccaggtatgtttgaaagtgactttagtctgatcttttcatgccacttagaattcccaggcttgccagtggaacattttgtagtaacatttaaaaatataaacttttcatttcttgcctgcagtggagagagctgattcacgatgagttcctctgtccctcccttcaccatatgtctcttcttcattgttgatttcctgttgacattaaaaggagcaacatatgaaggagttagaaggaaagctttaaatttaacgataaacttttttgaaagcatggatcagattttcttacaaagccatttaaaatgcattgtaaatcatttctttcatattttgtagagacttgttttggaagtatcgatattcccttctccccagcccccaaaagattaagaaaaatataaatagatttatttttacaatgtaatgagatgagagggatcctgtgagcaagctgataagtcttgcaattcactaacatagcccatgaaatccagctctgatgtcaagaggctctaagcattttgcaattcttaacggaatgttttctttgcctccctccttccctttctccatttgacagcacctgtgcatgtgcatgcaagattgcttttcagatctatgctttggttttttgttcatttttgtcagaaaagtcagcctatgcttattagggatctacaggaattgtttccacatggttctaatggatgcatggacggaacacctccacaacatgttgctgttggcctggtgctctgtcactaccaagatttcagagttcatttcttggctcctttttgttcttcctcgatccaagttcacacttcataatacgttttaattgtcatctcaatgagatgactcaaatttatatattgatatatctgtatcacaaaaaaattgcaaattgcgtgcattgtcaatgtgaattatagatagtatgctatgaaaacaaaaatattttctaatctgtctgacttttagtagagaagtcaagatgagatcataattaatccaggcttgaattaacatagctggaatagttaacatgggcatagtccctcatctgtctttggctatttgggggaaaagaaatacatgttaaagtgaaaattagtggaggaacttttaattagtcatacatttttactcagtttcatacacaagaatattcattttggccataggaaattgccactatttgatcattttgattgaccaaaaaaagctggcaatttcaaatgatgcaatacaggtcaccatcactgcttccaggaagcttacatcctaatgttaacaggtaaataacgaaataattaagatggctttagtgtaatgagaggcagtgggcagaagggggcatgagaggctctttcagatggtctgatcagggcaagtctctctgagaagacatttgcacagtggcctgaatgagatggagccagactgccataaaggtgactttacatctgggagatctgaggcagcaacgaggcaggatttttgagcagcagaaaggaggccagcatcaatgaaggaaagaagggtggaaaatgagaatggaaatagaggtcggagtgaagtggatgtgcagaatactcaatatcattctgatttttttccccatgtggcactattaactttagccactctatttaaaattgcttattgtggtggggggtgggaggaggtggttagaaaatgtatgtttaacctattcacttgcctttatttcttgttccttaagttttttaatgctttctatgacatcgctatcccaatctctactatgcttgtgtcttctggtttacccccatgtttctttcatgccttctcccagaggagtgactcacagtttgcatatactagacccaaatttttagactacagccaaagtaaatccacgtacagacataggggaaacactgagattggggatgatcttattttgtttaatttctagaaaaccaagttaattgagataaaggaggcatatttaaaaaccagaaaaggagacttaggacaatggaaagatttaaatagatacccttagtgaacataattgaaatactcattatttacattttctgcaacatccccgaatatttaccaaagtaaagaacttattaaaaagtatactataatttataatttcaggaaattataaattataatttataattttagtgtgactaaattagaatttgagaaatacaaagtttaacatgtttacacaaatttgtcgtttaggatttaaattatatttcaaggtggaagaagagagtgctcctgattacaaatggagaagtggtagaattctcactgaccacaagaggtctgcctttgattctcacaatttcacatgggacctttctcttaaaccttcagtactatgattggcatttaagggtcagacagtaaacatttgtataccgaatgacggaatcaaatattgaaggtagaactcataaacataatgcaaatataaatgttatatgttaaaattatctttatgagtaaggaaaattctaagcttactctgtatttacaccactaagaatggatgattatgagttcatttaaatgtttgagttttaagtgtcactttgcattacatgtgtttccttaaaggaatgtaattttggctcatgtgatcaacttgatatacgaatttcatatggttaaagaatctattggcaatctctctcttcattggtttacttttaaagattgattcttctagaaaagggaatattttagattgcttcataaaattagtaaattaaatgtgtaaatgaaaccatttgttcattgtcatgttactcagagttggcatagaacatacgtggaactaatgtttttattggcacacttttccatcaactactgccaccttccaggaatgttaaattgatcaagttagtacaaactaaccataaaacacttttatctgcttatcaatttcaaagcaccttaacttcatgaaaatgacaaagttttattgttctctgacaggtcttctttctgaattagattacttacccatcataatacctatggaattccagaataaaattctagtgtagaaaaaatgtttaaagtaatttgagaaaatacatcaagaagttcaaatgattcaaaaagcccatgagtttttccataaacttcaaaaataccaggcatgttataacatctcatacaataaaatttcacatgtatgggtttttctcaaatactgtagtaaccatttattcacagaacatacatgtcattttctatttgtcgtctaatttttttaaaatgcttagatttgacaatcaaaatacagaaatctagcatgattccatagaaatctattttctagttgaaattgttttaatgccaagtgtgtcactaagaaacaaagtcaatgtgcacatctgcttttgggcatttgtatatttttataaacagtcacagaagcatttgttaacattctgtgagaggcccccctgctttcagagatttaccaggtgttcattaccttttgttttcatctctatatatcccttagtggatatttctgtatttatcaatccacctcagtaccgtggtaactcaaattttaaagtaacaatgaatgagactttactaatatcagatttgcaagtccaaataaagtgtgtctatatatttttggtttacatatttattctttctaaatatttcagttgattgataaggcataatttgtctcatgaaaacccttgtctttttcccaaaggatggtgtttgcttattttccctgaacttttggtatgttttaaacagtgtttgaagtttattatgagtgctcatgaagttttagtttagctgtagcaatttctggattgtttttgaccttcagactttgtggatacaggcaaaccttatttttttaattaatgactttgtatttaaacaataagttttaattttttcacaaagttttatgctttgtcctattttgttgtatttttgcagagttattgttactgttttgtttaaggttttttaaatgtcatttttaaaaaactcattgtccacattccagcctgggagatagagcgagacactatcaaaaaaataaataaataaacaaataaaaccattgtccatttctcctgagctttcaccaagtctttttttctataaataccttccaagtttctaatggctattatttatatgaatgaaatagtctcagaaaaaataagtttatacacgtgtgtggtgtatatctactgtagagaacaaggatcccgtttaaagaaatgtcatattgattagatacaattttaacttgctggaaattactttctaaaaatattattttccaaatcttcctgtccataaatccgtttgtaaagggaaaagccactcttaatacatagaaattccttttagtgagttcaactttaagcccctaggaaatgctttagtctttcaaatatccaaaaagttaacagattttatatgaacactttacatgagaaagtggtacttttgctgaaaacttaaagtagtaaatggagaaaactcaagtgtagcattatttccagctgctgcagattccatgctttttcatatgtccctttctctgcctgcctctccctcctatgccaatcctttgtatgaccatgagtttttcaagactcttctgtgctatccctgacaattcagtttgggatttgctgtcaccttaggagcttctctgtaaacctgtgatttttttcctattagactaatgtgtgaatgagtgttttgctcagtgctcccttatagactgtgagcttcttgagaacagggttgctccttcttcaccattgcatcctcagtgtgtagtgtggtacctaacacatggcagctgactttggcttaaccaacacatgcttgaatgaagcagctccaaacctggaatgcggaggcagtagggaaggaaaggatatcaccaggactgctggcagatgagcacagagttgagtacaactttcactgtgtaggaggcagcatagaaggggaagatttataaatgatgtatacaaaaacaaattcaaagctagtaaaagaatgagtggagaggctggggaatcagattctttagaaaatagggagttttgtataagaaaaggtggtaggggaaaaacagttttgcaaaatagtcatatttcactagatttagcagtgtgttatccaatcacagatgacctgaaaagatgcactgtgtaagatgctattaatgagaaaggatctagaggttgacaggtacggccatttgcatgctgatgataactaaaattgtaaggaacacatatttagagtagctttaggttttggaaattgattgaagagggacagaaaaagaaggagaaccttaaaccgtaacttaagaaatgagagctgggatctacagagcaggaaatgatacttggctgaaaagctacagatgcataataaaaagattacctgttatttgataatgatgataaaaaaatacaatgataagtagtgcatatgggctgggcttatattctttcatttaaaccccaaaacaactgtctggggaagatttcattgtttttcccagagaaataacagttacagagaggcaggtaaattgcccagggtctcagaactggtaaatttaagagttaggagtagagtccaggtagaggcactccaggatctgaatcttacctgccctctatagtctaagctttaaccaaacactatgtaacatttatggtatagctgtcctgagcttaagaagtatgtttatctcatttgatccttagaaaatctgcaagataagcagacttcaatcctcaattgaaaggcaaagacaggcttaaagaaaacagagattttccctgagaatccacagcctgtaaatggttgtgatccggcctgaaccaatagcttttagttttaataacatcacaggttctgtgaaaccatgctacttccttagatggtgctccttcaggaaaaggatatcaatgttggtatttttatataaaacattaagagtatgtgtttctgttaatgtacatatacatgtcctgtagcctgttagaacccatttttttcattttcaaaggtcataggaaaaattatattcttacacaataagtctgtacatccacagaatcaaagatatttggtcaaaagtttgtcattatggattctaaaagttgaaagcatatggctgcattttaaaaacctatctatatgatgtgcttatgagtatggtattttgtgtccaaagttaattaataacggctgcaggccagtgttcttgtaggagctctcattttttccaacattgctggtgtctttgaacaagtgaagtgaagccatccagggaaagctatgaatttgcattctttttttttttttttttgaaacctttctaacaatggctgataatcactactgtcaatagtcttctaaaaacttcccagtaatgattagatactatgaatagattattgctttttctcttcaggtctttttcccccaactacatatagaatgttattgaaattcatgtgtcttaatcagttgttctctatgctttttaccatgcctctcttcatttctaagtcttctgacctaaattacaaacctgaaggactgagaagagaagaaaacccattttgagttcctaccctgtgatccatactgtgctaattacttctcactcatctcatccacactaccacaatgcaaagtcagcacgttcataattgttcacagcaaagagaaaactgaggactaagtctcacagggagtaaaagaagtagatttaaacccatgtttgactcttaatgtcatgtgtttgatctccgtacttacagctcttggattcaaattttagtatgtgtttttaaagtccatattgtaaatgtaaccatgatcagaagtaattactattttgcagagcacacacacatgtacacagaatatcaaacataaatatacagagtaaaagaaatgcccgcatgcctgccactcagggcgagatggagccctgccatcatgccacatgagtcccctggtgccttttctgtcatacccgctcttgtctacctaggggaaaatactatcttgactcatggtagtcacttacttgcttttcttttcctcaaaatgtgttttgaggttttttgttattgtgaactaagaaaacgtagttgtatttgtgtgaggggaattgatactcaataggaagatatgccgagatatacttattatatattgtttgctgttctcacactaaaaaggttgggttctataatttggactcaaaagaccatttctaggcctttgagtgcccctaagtggccataatagaaaatacagtattttacaactcttggatgatctctccttccatctaacagctagactttccactgggttcctggcctgacttctgtagtattctgcatcgttttttccattaaacaagggcttccaggactataatttgactctgctaatggaagggcatttgtacagtattaattttaaatgggaaattgctgacacgttaaagtggcatctgtcctgctccccacttgaactccgctttagccctggtcactgcagttgtcagtatcaattggggattaggagggcctgtggcctgagagctgctggccagcaaatgacatcacttttcctccatactcacagagctttgtgtcttaggaagtaagtccatttgctgtggttttgttatgagctgtcacgtcctctatggcacagatggacgtttcgactttgactttcttttgaagctgcttcatggggatcaggctgcctcttaaacacatgaagtttgtggacatatcctgggcacacagaggtgcttttcaaaatagacggaaagtaatttaatatcattaaaagacttgttctcggtgcgagtttatcggttcctctgcttgattcataatcaaggcagaaattatttttttcatatgtttcaatgaagtttcctatgcaatcccaatttttgtaaatgttaaaatgtggattataatttaagtccttattctatatttggaaagacactgtcttttctaacggtaaatttagttcattcacatttccagcaaatatttatggaagaccctattctatttcacagttattgacataaatgaagcaacaagttttctgtcttcttggctcttaacatttgatgatggagaacctggaagtaatgattacgtacacaaataaatttttaagaggcaaatgagatcatttcagataacaggaagtaacaggaagtaaataaaagagggtcatgggatggagtgggaaaaggggagagctatttcagatgggaggatcagagacagcctctttgagaattgagtatttcagctgagtcccaaatgcagagaaggaacaaagaatcaactgcatttgagagagagaaatcaggaaatggaaaatccctgtgccataaatttatattgttgtatctgagtaacagaaatagcagtgagtgaagaagagggtagcaagaaatgaagctggagggtgaagaggaaccaggtctactcgatctctttaggccatgcttggatttcatctgctggcagaggacatcagtggagagtattaaaatcaatctatgatgttctaaataaataaggataacaaattatattttcatttagtgctttttaataaaaactaaaattaagctaaccaggaaaagtttatatgagtttttttacaattgtatagaacataagatgttggctgtatcatactgaaaaaaacacagactaagcagtccaggaagtacattgtaagaattactatttttagattagtatacatgttttaaaaattctttttttcttattgcttttcacatgttccgtgttgtcatatattacagtaataattttcagatttagggtatatcttacaagctagaccattggagttgcaggctcatgcttagctatgtgaatttggtcctaacataattacttgctattatgcccttgactttcttgagggatattctaagatgctgctgggacatttactcttgtatttatgtagaaatgtttttgaagacattatgcactgttttctcatgtggcctctcaggcagatgcactctctactgcagcgtcagggaaaaaaatgtgtttttcctggatagctggtatgttttaatatcaaagacagaacatgttttctctttgccaagaacacaactaaatttatagttcacctcttacttgggacaaggcttactgtgaatgaataacccttaaccttcaccacaagttacttacctatttatttatgtatcctgttgtataaaacacatttccttaaactacctagaatcatttctgcatccaataacacattgtataaataccatacaacttgctcatcctcccgcccatggggcctcgtattctcattacagtttactgctaacaatgacatcacactttctataggcctttgccttccttaaagcagcaggccatgtgtatcccaggagtgatacacacttcctttttaccacaggctctacattgagatccatatctacatgtataccatcgacacacacgcttgacactcactaactctttcctgtatgccaagtaactgtccagaagaaacccaactttctgtgtcttaacagactgtttggttgctaaagatggcgacagatcaaaatagaagcacttagtatttgaaccgtgttacgttggcagcctgagatccgatctaaggaatctacactttcctcatgtttgtaatatttttctcaggccccagaaataatgttaatgaatgggttttcctctaactcatatcgtatcttcttcaaggtcgtttctaaaacaatactttcttttactatcagaaacaaataatgcaataaggagacacttttactaatggaaaaaagttgactttacatgtcaagaacatagacttttttggaaggggatggagtaggaaggcaaggtagactaggaaaattagatgctaggaggtaacagtgtgcctctatatttaaagtaaatatttgtgttttatttttatttttatttttattttttttaaagacagagcagctatccccagagcagcctgcctggcaaaagcaggaatggaagggctgaacgcatcttttatggaagtcagataaatttcatgctctttaacatcgactctgactgcaggcctttcgctgcagtctggctccttccccagtgggaacaaaaaaggaaaagtgattaaagttccctcagtaatagacagcaggaggcagtggtcttggcatcttctacagagacagagagagagtgctttaacaagacttgcgagagttctttgaagaaaagaagttaagactggaagggctggtcgaggtccgctgtaacatttgttcatttcctctacttcatatagcttatttgacttcttggaatagcgtcaccctcttcgttaaaatgtccctgataaaaggaggaaagtgaagttgagctcctggccggggccagggttcagcatgttctactgtgagtaggagtgtttggaacttgattattgtaagacattccaactgatacaaatgataactaaatctctctctctctctttctctttctctgtgtgtgtttgtgtgtgtgtgtgtaaatctctcactctctgtgtgtgtgtgtgcttgtgtgtgtgagagagagagagacagacagacacacaaaatgtgaatgaatgaaggaaggaaggaaggaaggaatacaggagagaaatttttctgtatgttaggtggctgcgattttggctggccaaaactgccttttgccttcggtgaactggctagagctgctcactacaacccctccccatcccctaggacaaaaccactggacctttctctctttttgtctctctctttaaaaagacagaaaggaaaataaggtttgcaatcagtattcagacattcttatgactaataggattaggggcgttacgaagggatttgaacaagataattagtttactgcttagtccacagtgaagcaagaaaaatacttctgagaaaaggcagacaaaataggtcagaaaatgtgtgggaaatgaggtaagacctctcaacaaggaccacgatcaactggaatattatgaaaggactcctgagccttcattcatagctgcagactgtctgcctttttttttttttttttaatacttggccaccagaggtgtgaagcaaagtgacttacttaattttagagttaataggtgttgttcctggaccctgagtatcctgttccaagtgcataaatgctgccttcaaagtatttctcacaacgtgatgtaaggggaatgttttggaaaatctgaagagctcttatcgggcattttacaagctggaaaaaattatacaattaggagaactctttaaaaactaaaattttcttgaatagattcattactttaattgcaaaaataaatcttgaaaacataaatgtgaggggtgtgttctttgcttaattaaagtacttaagtgtttgtgctctaatttgcacagttttcactgcggtagaatatgcttaagaagaatcatttgaattttaaaaattcacaaagatgatatttttttccttcatagccacattacattctcacacttcctcctccacttcctaaaagctagtgctgtcaactgtactgttgctatctgtgagttaaggtatgcttccaaaggaatgctagaaaaaaaaaataccttcaaactctgtgtatgtgtataccacatactttatttagttagcttctgaatcttacagcaaccaccagccagatgaaagccactagaagctgttagaatgcctttggcttggtatgggcactgtgttgacttaagactggtagaggaaacagtcggcatttctgcctaatgaactaccgagtgacacaacagaggtggcctttcattatctatctgtgggtgaaaggttaactgacaagagaacttgttagacacaaaagcaattaaaccctataataacatattgttaacatatgacataatgattaacttaaataaagaagcccagatacatgttttcagattcccggagtgtggtgtgtttatattcctgtctcccatttagaatggtaggctgcacagtgttggacaagatacattgcatattcttttcatgtcacaataaaacgtcatgttattttccttctgtaaatatacgaagctattttttgccattgtatcctgagactgtggtttagttttaggaaacagtttgaaactaacctcttaaaaagggaatagtaattcagggccatgttctgttggtgggcaagttactccctgaacaaaggtgcccaaccagccagtgagtttttaactctggttttccctctgtttgcagaatcatctttgcaatttatctgcctcttcgtaattaactcacacatgctctatatactatggtggattttaagttataggtactcatctttaattactgtgagtgatacatacgtttagagggtcaagttccctaaaagactaattctgacccccccaaatctttctattaatagatggttttagaaagatttttttaaagcttcacttagtgaagactcaggacataaaatttgcttatctaaaattttaattgaattaaaaggttctagactccctttaggataaagctttgtgtcccatttggagaaatactaatatgaataacagtgtttctgatctccagggaatggccgtcatcgggggaaggcaggtaccgaccctaaagggtatgacacagcacaggttgggatgcatgcagggagtgggaagaagtgaaatacgaaaatggggaaggaggctgggcgtggaggctcacacctgtaatcccagcactttgggaggccaaggccagcagatcacgtgaggtcgggagtttgagaccagcctgaccaacatggagaaccctatctctactaaaaatacaaaattagctgggcgtggtggcgcatgcctgtaatcccagctactcaggaggctgaggcaggagaatcacttgaacccgggaggcagaggttgtggtgagccaagatcgcaccactgcacctccagcttgggcaacaagagcgaaactctgtctcaaaaaaagaaaaagaagaagaaaatggggaagggatggcttttatagtgtctcaggaaaattgcacttcaccattaaaacaagaaaagagtcttacgactacaggtagatgagcagaaaatgttgaggggtatggggacagtggaaagtattttcagtaaatggttggaatggatcatagatggaaactggcaagatataagtggaaacgtaggtagatgttttaattgggggctgaaccatagagatttgaagaaataaataggaactagaaagtctgtttagaaagctaatatggtagcccaggggaaatgtgataaggcctgaccaagaggagtgatggttgaaatgcaaagaaatgtatgaaagcaaggtgcatgtcaaagttatctaaattccaaaaattgagaacatatggcatatagaattatcttccacatatttgcttaccactgtaccatgagaatatttccatattattcattatttatagaattattaatttagttactgatggtactgaactacaatctacatatcctatcttctattagtggacatttaacttgttttatacatttattaaaataaaaagtttttttgctcataaaaatgtttggcaacattgctccttattttcttgggctaaattcctgagatcattcattcactttttcactcattagttgtgagaaagtgctgtatgtgcaaccttttgctagggaaaggattataaatgctctctggagtgtaggtggctacaatttctagttggtatgacaaccagtggtccttgcacacagcagatattgattgatcccctgcattcaaggcactatccttaactccactgggagaaaaattaaaaacatatggtcttggacttcaaggagtttgcagtttaataagacagtacaatttaataataaaatgagtatggctaagagaatacatgcttaaggcttttgagattagtgttaaaaaaactgtaattaaatgagtgtagttcaaaggatagtgctgtaagattttagagaagggactaaacatcatggactggagtggttgagaagggccacattgaattggctctggaaaaaacagacatgccttcatttagtacaggacaggaaatttcgtttagtgcaggcgaaggaaatttcatatgaaaagaacatgaataaaatcttaagaaattttcctagaaagtttttatttgaagaataacagggtgttgactctagctagatcagagcattccaaatgaagtcataggtgtaagcaaataggtaaaaatggattgtggcatgcctagaaggtcaggctaaatgttaactttatcctgtcatgaaaagtcgaccaatgtagatattgtgcagataaatttaacttgcatttgtgggatgactaggagtacatgtgaggatttataaaggtctgaattatagagtgaattaaagagttgaatacaagatagtttttgaatgagtgagtgaatgagctgatgtttactgagtgcctgccttgtaccaggctatgtgccatgcttcttacaaagtataatgcactcagttgaacttagtcaattttgttaccttggaatcttcttgaatttggtaaacatccaaaagacaaaagtccagatgttgtaagacttcagttaagtagattatcagaaacaattattttccagagtaaaggattaagaatcaaaataataagattactctccttgcacaaaatctgcagtaacttcccccaaagtcacactacctctttaaacatacaatctaagtaaaaactatatgcttgttaggcaaacagtgcttcagtacatgtacctagcctgcttccttctaccgtatttccatggctaggcctctaatgtatagaaaatctggagtcatcccaggtgagggccaccaggccatgtgttttccggaatttcctagatttgaggatgctctaaattttaagaccactgtaatatgaaatctgtaagcatcaaaacttattacccagagtggcttgcttactggaaaatgttgcactttttagggtatttgtcttcgattttatcaacataaaacatcaaattaattcaaatcacgtatttagattgaggtctacaaactgtaacctaaagtgaaatccagcctttttcctggatttgtaaataaagttaaattggaacacagcaacagtaatttcttcatgagtagttgatgactgctttcaaggtacaaccatgaagcggagaaattgctacaaaaatatggcctgcaaagcctagcatatttactgtctggcccttttcagaaaaactttgctgacctttgatttaggggcaagataattttgttgcactcttttggtcatgatcaataatacttaaattgatgagtaacagcctcctttgtaaaactaggcaaagtccaaaaattagagggaatggaaaatgcaaactattcaatcaccacagagttagttacaaggattaatgagataacatatgtaaaacatttagaaaattgcttggaatgcagtaagcacttaataaatgtaagcattttgtctcattcacttagtgatctcatataatttcttgatttttaattctgtaatgactcccaaatttatctttagtcaggacctgctctctaaaatccagactcatataccattgcctcccccgcatctccatttggatgtctgctcggcagaatctccatcttaacatgtgcaaaactgaatttctggtgccatctcccaagctggcttctcctgcaaatttccttctcatgaatgtcatcctctccttgttgaaggcaaaaaactaggagtcaggtcagatgcagtggctcacacctgtattcttaacactttaggaggccaaggcctgaggatcacttgagcccaggagtttgagaccagcctgggcaacatagggagaccctgtctctacaaaaaaattaaaaattatctgtgtgtcgatgtgtgcctctggggtcccagcacccagagaagctggggtgggaggatcacctaagccaggaaggtagaggctgcagtgagccatgatcacagcactgcatcccagcctgggtgacagagtgagaccttatcttataaaaacccaaaacaggccgagcgtggtggctcatgcctgtaatcccagcactttgggatgctgaggcgggcggatcacgaggtcaggagatcgagactatcctggctaacatggtgaaaccctgtctctactgaaaaatacaaaaaaaattagctgggcatggtggcgggcacctgtagtcccagctacttgggaggttgaggcaggagaatggcgtgaacccaagaggcagagcttgcagtgagctgagatcacgccactgcactccagcctgggtgacagagcgagactccgtctcaaaaaaaaaaaaaaaaaaaaaagtaaaaactaagagttatccttgactcccctctttacctcataccccatgcccaattctgaagctagtcctgaatactctacattcacaatatatccagaatcatttctcaacatctccattgcctgattcaagctacctacagcactcaccccgtttctggaatactctcttttctggtctttctacttccaatttacctcccttcttatgattctccaaacagtatccagggtgatcctgtttaaaacataagttagaccatgttaccactctgctcataactttgcagttgcctctgtattagtccattttcatggtgttgataaagacatatccaacactgggcaatttacacaagaaaggtttattggacttacagttccacatggctggggaggcctcacaatcatggcagaaggcaaggaggagtaagtcacatcttacgtgaatggccacaggcaaagagagagtttgtgtggcgaaattcccatttttaaaaccatcagatctcgtgagacccattcacaatcatgaaaacagtacaggaaagacccactcccatgattcaatcatctcccactggttccctcccataacacatgggaattatgggagctacaagatgagatttgggtggggacacagagccaaaccatatcagccttcaagcagcctactggctcccacaccagcccttaccttgatcttggctcccacagtctccctgaattccccctctgatttcatttcctgctgttaactctctgatctctctgttcaacaacacttgccccctttctgttatcacaacatgtcaggaatatttccaccctggggcctttgcactggccattcgttctgtctagaatattcttccctatgcaatgtgctacctacttaatgcggtttatgtgtcattttccagatgtcatcactgctgacaagtctatataaaattatattccttcaaccccttattttatattcaccttccctgtgtttctctccatagtttcttattgtctgacatactatattgtttacttatctgctgttgtctctcttctctcattagaatgttagctctgtaagggcaagtcttaacagctatttccccaaaaaatagagcagggcgttgcacatgaaatgtacttaataaatatttcttggatgagttattatttcctttgtcattttcaggaagctttaattgaacatttactatgttttaaacacagttccgaggtattaattatatcttacatgtaagacacatagaggtgaaatgccttggtctaggccattgtattactttgctagacgttccataacaaagcacaataagctttgtaacttaaacaaaagaaatttattgtctcacagttctggagtctgaagtccaagatcaaggtgtccacagggttgtctccttctgagggcttggaggaggactctgtcctatgcctctctcttagctgctggtggtttgccagcaatctgtggtcttccttggctcatagaaaaataatttcaatttctgccttcatcttcatgtgatgttctgtctgtggtatctggctctgtgtccgaattatcccattttataaggacaccgataatatcggattaaggcccaccctaatgaccttgttttgacttgattacttctgcaaagacccatttaaataaggagatacggggagagcaagtcaagtgatgtgaattgggaggtgtgaggggagcacaattccatttatcatagccattgacttcattaatggtaggcctttgattcaaacttggattctaaaactcacaatctactaatatctgaacccgtacaaagatttagtaatatgtattaagtgcctgctttgtgctgtgaactccgttaagaaccatagataaatagagttcagctcctgcccttgaggaactcaccacatagcaggagaaaaagacatcatagagttaagacctattgacttaaaagcacacagaaagcagatcacttgccatttttaattatataaagttttccatctattaggtttattttgccaaagccttctaatgaaatagttacaccatttaatttaaatttcagtggggttgccagaagtgcaattaattgttaaaagttccaactatgaaattttgctttggaaagcagtctgccgtatctttatataccattaaatttgatcatatgcttgtcattctggcagaacatcttgatatacttgaagaaacatagttaggggaaataaaaaaaaaattgttggtactacactgtagggtttccaaatacaaatgttagcatgattgggttataccaattcatcattacgttgcatttccctggagttgaaactacatctgggcttggcagggatgcattatcaccagtcagagtggggaccatgtgtcagtctctcaaagaagatatatggtcttgtgtaccattaggattggatatgcttatgttgcagactttaaatcaacttctgaatcctttctacagatgttgactgctgcaggtctgtaaatagcacagtatattctgaacttcagctgatatatacggccctaaaaaaaaagcaacactgagatacacggcaatagaaaacaacgcaatgaataaaaatgggacagctccaaatttgctgaaataatctcatctgtttaatgacattgtttaaacaaaattacctctgaatttgaagttgccattttctcagatcagtgtggaattgtagtaattttaaaattctagaagtttcttttgtaacctttattatttgatatgtattggatttatttgtaagatgtcaatagattccatttcttaaatatccaactagaaagcatttaattgttcttttaacatttgcgagtgtggtgggcataatttttaagagactcacctattgaggagtcatcgtacccaaacactgatgaccaggcctttacaaagcattttggcctttatttacattctgggtacaagatttttcactgcaattaaaactataaccccaacttcactgaattatctttctgttaccaagactttttattcagagccacaacgggattaaatgaaaatgaccgaagcctccaaaaaaaaaaaaaattccttcataaacagcaaacttttaactaatacacaatgtgcttttaatactgactttaaatcctccctcaaccaggaactcgtgaaaacatgtggtcagtgtggcaaaagggaactgctgggtcctgatttagttgacattctctttttttacaacctggattttatatcattcactgatgcctttctttaagctcatacatttcgtgcttgtggcacaggatactgttttcttaacatcaaatctttatggcactggcaaaaaattttcaatctcctacttaaatttggttcaactacacagtttcactatagccaacagtttgtctggataagcttgcttgcccccagtgtggatttgctgcaaaataatgactgcattaagctgaggaacgtgttccctcatccaatctctctctctctctctcgcccccccccacttctgtctctctctctctctctctctctctctctgtctctacccagccatcccagatccaacccgcacttgcaaaaatacatacatacacacagtatgcaaacacatacccatagtcagcaccctttctgtctttctgagttaaggctgtgatggcccttggggtttgctcggaaacagtcacttccaagatccagaaaggctttgtaaacatgggtcctacctgcacacaagtcagactgtgatcattcccttgtagattatcaaacattccatctactatacagcagcccagaactttatactttaaccattttattctcactctatgaggtctataaagtatttttactggggaaaaaacattatctatgtaattatcatgacctatgcaaaatttagcctaataagagagcccaacacatatttttttaaagtaattttaataaaacaagaatatggtagctacaataaaaaacatttaatcaaggtatgaatagattgctgtgtgagaacagaaagaaaaatataaatgttatagttgggggtaggagaggaaaaaggttggggaaaggcaaactgggttcaaatgagatcttggtgagtttctgtttctccaccaatggagaacagattgcggtggtgggcaggaaggcaagggagtgtgtacaaggctccttgccaggtgagggaggcagagtgcgtttagaaagggggactggttggccgggcgcggtggctcacgcctgtaatcccagcactttggaaggccgaggcgggcggatcatgaggtcaggagatcgagaccatcctggctaacatggtgaaaccctgtccctactaaaaatacacacaaaaaaattagctaggtgtggtggcgggcgcctgtagtcccagctacttgggaagctgaggcgggagaatggtgtgagcccaggaggcggagcttgcagtgagctgagatcgcgccactgcgctccagcctgggcgacagagggagactctgtctcaaaaaaaaaaaaaaaaaaaaggggggggagggaccgattttatgaaggttatggaacaaggaggaagctatgatgtgaaactcggaaaggagcgaattgtagactttgaaagcagcataggaatgtcgtgatgttactctcagtgagtaacatggaggatgagttggagagggtgtggactggagcagagttttcgtgttcggtgatgagatttaccttgagagtaaagacgaaagactgggaggccttgctctattgccagcaaactctatggaattttcctttcagttggaaggctaaagtttcacatctacttaatatgtttctacggagtgtttagatgtgttttagattgagagtttttcagatgaggaagatgactaagtaaaataaatgaaagagaaaattttgctatttcatagtgaaatagaaaagggcttttttcccccttttgctagtagtttaaaagtgacgagaataagtcacatgaatacaaatcttaaaactgaatagaattttgtttctcataggtcatatcatgcctgggaaatctccaagttctttatggcaatatatcagggaatgcagtgacattttcagcatatactgttgccattatttgtgtgtgcatatgtgtagctttggtgattagaaagtcttttattaaaagatgaagtgtggggtatggcacaaaggatttactttgcctcataaaaaggctactggaattttgacttacattttactgtgtgcagacacaagcagactggatttaatttctttccacatgagagatagctaacttcttggaacaggcacaggcttacaatatttctctgggacaaaaccttgaggactaaaagttcaagggattggtgctttaggggacaaggcatggaaatgatacattttctcataaactttaaattcattttggcccaagcagataacttttagctcagggcacttgggtttattagtcattcattcattcatcacaagtttattgaaccatagctgaagtatcaagtcaccagctattagcagaggagaaaatctaaaaaaaaaaaaaaaaaaaaaaaaaaagagtaatttggaactagaccaggaatggctttataacaatgattaccttgtatggattgaacacttactaagtaccaagcggtcttaggtgctggaaatatttattttagaaattatcctggaatgtttgagcttaactatagccttgaaagtaaatgagataacttaataacttctgaagagcctcatcatgtaataatttccctggagaagaagaacaagatgttagattgaaatggaccactcagcatggcgtaagaaccaggagacacagccagagattcaaggaggagaaaggagtcaaaatgacagatgctggattgaaaagtctactggtttggcaggtacaataccatttgactagaaaggagaaaagaaatacgagttaaacaaatgctggaaggggtatgtattaatatgcactcaaaggatgttatccttggagaggagggtacctgggacaaagattactgtggatattatagatactaatacagaggtggaaagaaggaaaggctccttcctagagggtttccattttctgagttgagaagacagacttaactttcctagactcgaggctaagcatagattgggacgcttgaaaagaatgataaaatgaagcattgccaccaattgccattgtggcaaatggaaacggataaaaataggctcatttaaggagaattattggggcccagctgaaagtgaacaccctaatgtgtaagaatgtcatcttgttttatttgtattctcctgttttgttgaaggttgtttcttaaaaaaaaaaaaattcaacttaattgatattcaggtgtaactgtcttgtgggttttactgtagttgtggtaggtttcctaataagtgaaattccttgtctccaggcttaggggtcacacaaacctatgttaaaatcctgtcaaaagcagtaacttgggaagcttcatcaactgtaaacagagaacattttgaccgtatcacagtattcattttagaattagtagtaatgcagcagtggatagcccagtgcagtatcggtgcaataaatccttgctattgccactgtcatttttataactttcttttaaaaacatagtgcttgcttttaaattccatttttaagataaaaattctttaaagttttcttggcctgccagtttcacaattctccacctctacctcccactgcattgcaacaccatttaattgtcagatccacctattccaggaagctttctcaaatacttcagggctacagatctctgcatgtgctgcccaatgcctttttctctgttacatactttgcgacttaattgcattctgtctagaaaccctaacccatactttctttgtatttataataatatcagaccttttatttgtatacataataagtgtcttctcaatatctcatgcatcaaatggagccgcaatggggtgattcagctgagccctagctgcactgatcagtcctgtcctgctaacaatcatgtcagtttctgccattcccctcacccctctcctggccattaattcagagaggtctgcacccaaccctgttattaaattatctgctattaaaatgataaattggtttctacttcagtaattgaatgtgcttgcagactattctttccagtcttgtttttatattaatgtgttaccttaaatggagatgtttcttacatgagcatcatattttcaagaattcattattttatgaatttggatccatttaaaaagaatcttaagtgatctttaaaaatcaaatgaattttccacaaatacaaactctgtagggatgctcattaaagaagacgtttaaaaggatatatagagggtcagaaaactgaacgagaattaggcctgtctcctctttgttagacattgtcatttctgcttcagagtattgtttttatgctgtaatcagactcagtttttgctgttatttcttgatccccagcacactttaatacagaggatctattagggctccctactttaggaaccagataaaagcatgtatctaatcttgtgggtatgtgcatgtatatttttccaagaaagtgtccacagatttcaagagtatccaagggttctaagctctcttttttctcttaaaatataagaaacattgcggtagtggaaaggactttttgattctataacattaagctcaaatacaagttttaccaattactacctctgcaactttggacaaatgaagcgactctcttaattatggtttccttgagttcctgagcgtgtcaagtgggctaaaagcggcaaagtatgcaaagccctggcccacagtggatgcataatacatgttactgaggcttcttccttcttgcctaaaagtcatcattcctaccaaagcactgttcatttcctcttgttcattctccatcagagatagaaaccagctgttcccatctctgtgcacaacaactgtctgtgtgcttaaagtacttaagcacacccttgcccccttaactacgggttaattcctttgacctttcttcgaagacagttgtcagatgggaattttctcagtggtttgcccacttaaggcagtttgtctctggaggcaagctgttgaagagggaagctgagaattgttaacaacagagctcagccatgagcttgatttcttctatttttccatgggagcccatattatctctactttgcggtaagggatcagctcaatgtgatgttatatggttcccatccggcctgaacaccacttccacataaaaatggggagtaagtctgagaaatcaccactttttaaacgacagatgatgtagaaaaaagagagaagcagcaatagtaggggaagcttagagaaagtgtttggaattgtatccagattttctagtgtctgtagccaagaaaagccaaaaatcagtatttgagactaacttttcagatgtctcttcccttactatcaaaatgagtcaggcagtgtttaaaagcacaggcttggcaatttcaaaattgcaaattaaggagaaataaaagaaaatatgcatcactgaaaaataaatggctatgtcagagaacatccctctgcatatctctctgttcaaataattaactaagttttaggtacagaatattgcaatcctgagttcaagaccagctattcacattattaactattaactctatgtacagacggataataggaaacttcatcaaaatagatagatgttcagaaaatcccatgtaccccaacttctctgtgttgtagcaaatgagataatgtaaatgatattatatgtttatgaatgaaatgaaattatatttttgtttaggatctgatttattgtgaatattttcactgaacaaaggcagcagagaaagtgaaaggcacaatctaggaatccgtgctatatgtggattgtgagcaggatagaaacgtcacagaagagtggccctgatcaatgcttgcctcgagggtgtaccttgcagaagggagagcgattcttcagcagaccatcctttggatggaaaacatcaaccctcttccttgttagtcacacattatccataagattctgacttcctcaggcaattaataatgaaaacccctaaatctcttggcaacaactttcaagcctaacagttttctttgtcagatgggaaggaagcaggatctgcgaggaccagggcagacagtgaggaattcctgaggctggtgagcaagggacaaggatcacacagatgcattgccttcctagaggaggcagaggttctcactgggctctgcagtgatcagttgtgagggacgccctgagttataatagcaggagtagctttatttcaaaagaggccattgttgaaagtctgttcaaggttacacttattctaacattgctctcctttgaattttaacgtctttttttgatacaaggagaaaaagatgaagttaaaaagtaagaagttatcacaggagcaggctgtagcctgtgtttcatgtaaggaaaacggttgcaaactgtttgagaaggtcatgagacctgcagcctgtctgcaggagaggggatggagtggaagagctcggcatccatattgtctgcgtttgtcaaggcctggctaggttgaagtttcagaaaaaaagtaaaacctaaaagaaccgctctctgtttctcctaaacacacggacacacgcaagtgcccacatgaaaacagtcagtgaatgcaaaagtaattgctttgtgttagcaataaattgagaatcattggagtttttcagctactttactcattggatatttgaggagaaaaaaggaaatgaaaagtagtgttaagaggtattcacagattttcctcagtagaaagatgtggaaactgaatctgaagaaagagaaaagattggttaaaaagaaatggatacttcataggctaggattttaccaagcttgtatctacatggtaatacttggagctcaaaaagtccatgtgtcagtctatttctaactacttaactgtcgttcattgtgtttttgaaacacttaaggaatatatttatttcctaatccttcgagatattaactcatactgatatgctaataatgccctagtttaaaggtactaaatatactgattgtgtgtttaaaagcctgcacttttatatgacccaatggtaatttaaagcatcccaaggtaatattattattatttatgagtttatttttttttgagacagagcctcgctctgtcactcaggccggagtgcagtgcaccaggctggagggcagcagcgcgatcttggctcactgcaaactgtgcttccaggttcaagtgattcttgtgcctcagcctcccaagtggctgggattaccaacatgagcaactacacccagccaatttttgtatttttagtagagatggggttttgccatgttggagaggttggtcttgaattcccgacctcaggtgatccacccacctcagcctcccagagtgctgggattacaggcatgagccactgcagctggccccaaagtattattattatttatttattttattttgtgagacagggtcttgctctgttgccaggctggagtgcagtggcgtgatcttcgctcactgcaacctccacctcccaagttcaagtgattctcctgcttcagcctcccgagtagctgggattacaggcgcacaccaccacacccagctaatttttgtatttttagtagagacagggtttcaccatgttagccaggatggtctcgatctcttgacctcgtgatccacctgcctcagactcccaaagggctgggattacaggcgtgggccacagcgcctggccccaaagtattatttttaagagttacttctacttcaagagtgacaggaaaaaatattccaatcatttctagagggacttacatttttctctattgaattgtgaatgtttgttgcttttcttgaaaattaattttttgttatactattatttcaatattattaaataaataattatactactaccaattaaaaacaattaaatcaattgttttcaattaaagtgattaattttactatgaaaagagtaatagttatatgctcagggactggaagaaatccaggtaggattatttggaaacttagtttcatttttctatttatgcttaccattttttacttatggggacactttgcccatgggaaattattgaatgttttaattgagttagattatttaaaaactggagacaatgtattggttttgttctattccattgttgtttaattgacagagaaaaaacagggtttttgttttgtttcgttttgatttttatgagggagtctcactctgtcgcatagactggagtgcagtggtgcaatctcggctcactgcaacctccgcctcccaggttcaagtgattctcctgcctcagcctcctgagcagctgggattacaggcacacaccaccacgcccagctaatttttgtatttttagtagagacagggtttcaccatgttggtcaggctggtctcaaactcctgacctcgtgatccacccacctcggcctctcaaagtgctgggattacacgcgtgagccaccgcacccggccaaaaaaacattttttttatttttatttgcttaaaaaaatagaacatcaacagtataagtattaactagactattgaggaattaaaactaactgataattagaaactttatggggaaaactcaagaggtatgaaagctggagtacttacattaaaaagtaatactgttgaaactattcgatttataacagttgcaaggaaaattaaaatacagtgtgtaatccactgcaatgatttcaagattgacagctcagtgttttttttttcccagattactgaaaacattatttaaaacatctaacttggcaagagtatagttagtaactaagaacctgcattctttttttcagtgtcattaactttagtttcctagttaaaggaagattacctttgataatgttatgaacttgatcaaaatatagttgaataactttgaatcttcatggtattttgatgatgcttcttttatcttcagacaatcattagagaatcaagcacatttctgtctctccatagtaaaatgagaacagtgttgcatatcctctctaaagctgtgacaagaatgagtattaaatcctattccaactgccttagccatgtggatgccctatggtttggggctacatttttttattgggacattaaaaacagtttttcttatattggaattttgtattttgtcacattatagatatttgcagttccattccattttattccacatgcatttccaatggtatataactttaatatcagaaaaagtcaatccatgattaccattgaagtagaagggacccttacgttctgccagagaacacatgactcactccagatggacaagaccatatcctatttttaaagatctactctactgaaaaactttacctagcaatatttctgatgaaggaaaacttcaatccaactgggtacactatttttaactatgcaggtaatacaaatagtatatctttccaccctcttccaattttagacagcttttctgtgagtcaaaatgctatgaagaattgcataaggtatttattcattaggtgtatttggaaaagccatagtgtaaatccaacacttggtttggagttatatcccttcgtatgtaacacaatgaaagttgtgttgtggtactttacagttaagatctagtcggtcccagcatctgtatccatgtttaggatgaaaaagttaacttgagtaacaaagtaaaaagaaaaaggagaccctaatatctggctcagaatgatctatcttacaacaaatgacaatatgcaaattcagtcaaagcagaaggataagaactttataatatgcaggtttgtgggtatgtctacagccacattgtttttaaacctccactaaggactttatttttcttcaatattataagtcacccagcagccctagccaaggacagaggtcactgttgtcccagttccagctctgatgctctctgagcatcatctccgttacaccttcctgaagttcattccactgtcagtagctgtcactcagtcacacttagtgatgtgaccgatgtgacattttccatgggggataaataaaaactttacatttccctccccaatgttaatgttatgacttctttggagttaatcgactgacttctttttccttcaactttcagtcagttcctactaattccttaaaggatgtctcctttgttccagctaatgcagctaaaaggaatgctataagtcagaaaaggctatattgaattcttttaagatataaaaaaatttccaacccttataaaatgaaatgtattcatatgttgttggttaatttcctactaatgcacacataacatatatgttggagttatttcatcagtgaatatctctcaaaaagatatactgagacagagaactctgttcaaatatgagccttgaatctactggggctaattatcagtgtagaatggctaagtagaatttttgcatatatcattttatgcagtacctttgtaacaaattgatttaagtgcctttttggaacagtagttgggcagaattgatttggtgtctaggagattgacttacacagcaaaactgtgtctaggtttattctggcatctaaatcgagtttcaagcaagtggaagggttggtggtgctggaatgcagttctccaccaatttatattgtgaagtgctatgacatacattattaaaagagattcagtgtaagtatgatgagttaaaatacccattgacagctggcaaaacaaccaaagcatttgcgttacgttaaaaatgttaaaagtaaattttgtctcattgaaatcatatgatctgacatggtcaaggtagaattgatgagatgttttaattgcaaaactttttgttccacaagataaagaagcatttgtgcaaagtggataaatagggatggtgtgttaaatgtgcatattcaatggatttgtactttcttctcattcaaactccaagcatctttttaagccagagcaaatccagcctgtgtcattttgtttagcttcctgagggcagggactttgttctgtctactggcatctccctatacttgttaaatgcttggggcaaatgtgttcatctttctaagcttccatttcctcgtctgtgtgttggagaatcgattacttcttcttagtgttgtgaatattaaatgaataataggtgtaaagcatttaaaaatgtctgagaatagaagcaccttcctactaattatatcagagaaataaaatggacagtttcaaaactctctgctttaaaaaccgtcctcttattccttcttttgcacaagttgttctttgttgtatgttctgcatctgctatcttttttcctcttattccgttcctctctcacttagtccccctttctccccatcaccctttctttctcttttgtcttttgtttcctaggatatggcctgggtatggaaagaaacccttctctttctttcttactccaacacagctttcagccatttctttgatttttcatattgtgttgaatgctctctgcacttcagccattttccttctgcccatcaaggtggtgtgcttgggagagcaggcagcctgcattgagaagcactctctgctgctgtgggaaccgaggcctttctgctgacagagcaggtggcagggatgctggaattgcaggtgctcacccccaagacctctattcatgagggcccacccagggtagcccaccaaatttaaaaccagaagttgcctttcagcttttatatctgtgcccaactctcttttacatacagttcagaaattatgatatcatgaaaatgtgacttcagttccctcaaaatatctgctagctgcataatcaagggtggtttgtgcattttgtggaaagattagcttaagattgcctttcaaaaattataatatgactttttgcattcagaacattatgatacatccggatatgggttttgaacctattatccttctttgtaattcagaaactgtatatgatggatttaaattttctgaatttaagatgtatcttaaaatagcttaatgcttactgggattgtttaaagtatttattgataatgacagcaatataattcacaaatactatgtttaactgtgaaaaagcgttttctattttatcttaaattgtactttgatagatataattggtgtgtaaaattttacctaaattttaatgcatctcccaaaacgttatttgttggtatgtatttccacattaaaatggtaatatgtaacatttattgaatgttattaatatgtgtaaggccctgtgcttaatatctcatataattttcccagcagccctatgaaatgtgttctaaatgttagtcttaatttatagattaggaaattgaagcttagagaagtttaaaagagaaagaaaaactggctcaaggtcataacactaataaatgacacaactgggatgaaattcttatataattaaagcaaaggcccagtcctcaagttatccccaaagtagagggagcaaacagaaatatgcagtattgcacacaggcttggcaagtctagcatctgtcaggcacttattctatgctgagcacttcaccaagcattgtacaagctctagtcgaacatgaggtaggcagttttattatgcccgttttacacatgaagaggtataggtacggagaggttgaatggcttggccagaaagtggcagagccagatgtggattcaggcactctggtttgagtggcatggatcttaaacccacactgtactctctttgttcacaggaaggcatacgatcttaagtcacattgaattaacattgaaatgtactaatttccacccttcataactgtgcttcccctttagttttttagaaatagcttccctgtagggaattctaaaggatagaaagcattgatggtgaacacttctcccaaggcttcaaacctctccccagtcttccctgagtttcatgctgcataacctgtgtggtacctgattattctatgcaagactgtactacgtataactagtctttctcttgaatgaatacaaatatctctcttttatgtgaaactcatttttttctaacacatactgttattaggatcttcaaatacatgaaaataattcttttccctgatatatattatttacctggatataggaacaaaaagagtttcattaagtaaatatacttttaatcaaattaggaatttaatctgtaatgacatttacaagttggcatactcatttaccgtccacatttacatttctttgcttttctaaagttaaaatctggcaaatactcatttatcattactcagtagtttccaaagtactccatggaagtacagatttatgatatttctcagtcagactctaagagaggttaaaccatgaaggaaaataaaattaccagtaattaaatttacaggcaggtttgccatctaaagcaaatttattgcttcacagtgaaacatagtttagacactttcacataaagtgaatccatttttacatgatataggtattatacattgctgtttcaatttatataattaaaattatatcattgcactctaaggttaatgggatactcaactggaaaccatacgtcgtgggcaataaaatagcagcattgcagtattggctcttttgttaaaagctgatgcaatatttcaacaccattacattctaccttttaaaaatctttagaacaaataagaagcaaagacatgccaatttaaaaaaaaaatgctctttttctctgtctttctctctattccccactccacttcttgtcaaacatatagaaacacatacatgtttaggatatatacattatatattatggaaaatgtacattcagctctgttattagcatggatacacatatgtggtgatagacatgacaggaaaatacatcaatacccattttgaaaacagttttttctcaaattcaaaacaaattaaaaggtgttcctatagtctgttcaaattctagcatgatcaaaagaatgtatcatgcattgcagagctgttgtgggtatatggaggtagaattaagggaagaacaatataatctaatgtctagaggtgaaccagaacagacaagacttctaagagaagtgtggtatctaaaaagggttgagacatccaaagtagtaggcattctttgatagccatgctctaataaatggactcttattacactaagaaatattagaccaaatacaaaagagctgcaaaggaaccaaagagaatagtaaatatgctagtccccaacagagatagatattgattttaaaattgctttacagagtctgctgcattcatcagccaagaaataaacaaaaatgtgttatatttatacaatggaatattattgagcgataaaaataaatggagtacagatacatgctacaacctgggggttagaaaagggagaactgctaatgagtacacagcttttttgggggggtaatgaaaatgtcctgagattatggtgatggttgcacaactgcataaataatctaaaaaactatgaattgtacagtttacacaggtaaactttttggtatgttaattatatctcaataaagctgataaagtcatttgcaatattttctgtctctcggccattttcttgtgaagatttgatgttttacagttttatttatgaagtctttatttctaggcattttttcaactgaagttgaacacattttttatcatgatcaagaatcatattttagttgaagtctgtaaattctagaaggaagtcatagtgattggctatatttatagaccacttttacaaagtcagaattgagtatatacatcgacatgaaaaacctgggttcaggggacagaaaacaacaagccttgctgttctcaaacagttagatgttgtgctctagttgttcttgcacaaagattcctaaatcctttgttataataggtcttgtgaatgaagggtcctcttaatttttgctcttattaactgaaaacttcttagtcctctagtcagtgttttagaatcccaacacaacctctttttttccttctaattgttaaatgcagcaaacactattttcttagccctcatccccagcaatgtcacccataacctttgtctcttctttccattgtggtctcctttttagaaataattgtccatttcttcttaccagaccatccccatcactgtccctaagagccagcttaatgccctcctctttgaaaagcacttcctgatttgcatgccacctcactcttgttaaatcccattattttatttacacatgcattccatgcatgtcatcctgggttgatgtctgctctttactcacatatgcatggctgatcttcctcagtatattgcagtcattttgatgagaaaaataggatcacattttttatgtgtcttcataaatgagtaatgcaattcctgacacaaagtcatggagtcaggtgttcaggaaatgattatttcctggttagtatccatgctatgttgactaaatatgaaactcacatatatccctggacacagtattgagagaataaaaggattttaaagtccatcagccaagactgagactgagactatagtttaggctgaataaaggctttcaaagactgtttaccacttaaaattcacggtatttatattaacttacattaacacaactttgacatcacctttatcttacctgatttcattaaagatatttggatcatgaaaaaaaatatctctaccctatcttagggaaccaaagagcaagtcatcattgttttaatttgccaaagtattagatgacattttcatataatattccctaagaaagacaccaagtacctggtaaataggtaattttcttgagaattgtaatgtccataagtataataccaattttctaatcattgatgggcattttaatttcatgttttattgaccacaaccaggcatagcattaggatacaatgatgaattttgcactgttcctagggaaatttcagctcttatgggatatgtcaacaaggcagctaatgattacaatccagtatgctatcagttgagtataatattctaccagggtgcaaggaaggaagactactccagtattaacacatttcaaagaaaattgctagaaaaaagaatgttcaagccccgccccagaggatgagtaggaggattaaccaattaaaagacatcatgtgaatattccaagcagagagagaagcatgtgcaaacccttggcaagaaaaaatgtatagatactaaagatattatatatataaatttaaactctattgcaaggtcttttttgatgatcatctgctgtccccaacacttcaagcagtaacagagtacatttccccctttattatttcaaaactttctatattttcttagtgatttttattttaatcagtgcagtggcataatgatcactttacctatctacttttcctttctggatctgaacttcttgagagcagagactatgctatttttaacttttcatttctaagtgtgttcggcacatactgccttcataaataattcttgaagtgagctaaattgaatgaatggaagtgcagaaagtaagatgggccagtgcctttttgtgctctgatgaagcacttcatagcttcacaaggaatagatcggagcatttgatcttcatgggaaccatgacacaacagtgcttggtattattttttcctagttagagaaaatgaaacatgagtcaaagaatctcagtaacttgactaagatcacttggtcaccagttttaatttttgtggaatggagccaaggatttctattcaaaattacctgttccagacctgtcccagtacacattatgcaaaaaaaaaaaaaaaaaagaggttttagagtgacctctcaaaaagtacggctttgatggtcacacaacagtgtgaacgtacttaacaccagtgaactgtacacttcaaagtgggtgaaatggtaaatttcatgttataaaatagtggactttcttatccagctctctcctttgtccagagagtgtatacactcttcttgcctttaatggggcttcctagtttttattttctgttggcatctacaatttccaactagatgcaaataaacaaatgccatgtttgtaaaccaaacaaaagctagaaggtaccatttatcagaggagttccagtgggttaccaacatggggttcaaagaccatgggcataacagttaccaggcagacttgttaaaaatatagattcctggacctcttccctagcgattctgcctaatatttctggagtggcgctcagaagtctgttttttaaaacaatgtccctaggtattttttatgggtgatcttcaaataacattttgaaaccacagctccagggtgattgaactgtaatatcagagagccagacctctatagaagctacctcttacctcctgtaagaagcaggatagcagtgcttcagaataggaggtttgagaaacaacagagcaagttcaaatcccagctccgctgcttactagctgtatggccacaggtaaataatgtaacctctccaaaccccagttcctcatctccaaaataaaaataggagaatacatcccgacttggttatagaaacaatacaatgtgttccctggaagttagtagttgctcaataaatgttagctttgagtattaccttattttatcagttgtaaattgcatactttttcacacttccatctgtggaattttacagttattgtcagtaagttattgacactttttattaacagcaagaagtgctaggatcaagacatattagagattatatgaaagagattattattactgtgttcaacaaaactgttgctgagaactagaagttcctgagggtttccagtgggagaaaaaaaaaaacagttttggtgtaggaacagtcccaataatccctaaaaaaaacctcattaatacatccaacaaagaaagcccaaagtacttattccatatcgaattttattaagatttgcaagaggaaagacatacatagaagagatgcatataaatcaagaagcaacagtcaaggtggtgataaaaacataccctgaaagaaacagaattatcataaagcaatgatcacatcagatattatgctatcagtaaatgcttttgaatacatgaatgagaaaataggagtgagggtgagaaaagaccacagcagactttctcacttgcaaatattaaaatcttgagtaaactaagcataagtttcttggggataataacctgcaaatctgaaatatattgatgtatatcacctgaaaggagatttatgtatgcagcgtgtagttcagttcccaccatgatacaaagactttaatctgtgtttctgtctctgatccgttcattgagctgtagtctcttatctccaacattttataaaacattgccattctcctctcctgtgttgccttgataccattatgtttaaaagtcctctcagaagtccagttttcttttctaatttccctggttatgtctataatgccagattttgttacttatcaggcctcaaaccacagacttctacttaacaggagtgtcccttgccttacatcttgcaaattgccatgtttggaatttttttttttttttttgagatgggaatcttgctctgtcacccaggctggggtgcagtggcacaattttggctcactgcaacctctgcctcccagtttcaagcgattctcctgcctcagcctcccaagtagctgagattgcaagtacttgccaccatgaccggctaatttttgtatttttagtagagacgagttttcaccatgttggccagtctggtctcgaactcctgacctcaggtgatccacccacctcagcctcccaaaggctgagattacaggcatgagccactgcgcctggccataaatattttttctttttttttccctgcctcccttgcgcaaacatttggcgatggtgtaccacatgccagtaattctgcagaaataagatgagttaacatccctgcctttgtttatcatattgtctaacaggagagaaagttatttaggaaaggaattcaattaaaactattttttcaaatttatttattttaaaaattaacataaatttgtagatattcattgcaaacatgatgttttgaagtatatatgcattgtggaatgtttaagtgagctgattaacaaatcaattcctcacatagtcatcatttctgtactgagaacctaatccactctcttagcgtttgtcaggaatatgatatattgtcattaactatagtcatcctgctgtacaatagatctctggaacttattcctcctgtgtaattgtaaatagctattatttgaccaacgtctccccaacctgcttcaccttaactgccccagccgctggtaggcaccattttaccctctacttctatgagatcaggtaggcaccattttaacctctacttctatgagatcaacttttttagaacctggaggacatcatgttaagtgaaataagccaggtacagaaagacaaattccacatgatctcacttgtatgtggaacctaaaaatgtcaacttaaattacagaattttactaaataacagcacaagtcaccttaagagttcaaaagagggaacaagggactccccaataatgaaaataattctgcaataattttattatctaataatgtaaacactaatttatattgttaatacaaaccttatttataactaggtaaaacaattctaagatatatttaatatgagttcatcttacagataagcaaatggagagagaggcttagtactttgcacagcatcacatagttgataggttatggagattttagcactaggctcagctgaggagttggtctgcgtcttgaacaatgtttaactctccatctcacggtgataggaagtaggtgcttgaggcaaaaagaaaatgtgcaaaagctgaacgatatggaagatcatataaaaggagaattaagagcatgaaattcatgagtgaaggaatgaggtggaaatagaggcacagcagttatcaaggaagatcctgaagtaagagaatgagagtttgcaggtaaccctaaggaggccaatgtggctgaaatagagagaatgaaagaaaggataaaaatagataaggtcaaaaagggtgtgctgatcagattttggggggaatttgtaaacctttatgacactttgagctttcctttgtaatgaggcaagatatctgtagttttcatgagaaatgtgacaagatatggctctaagaaggcaagggcagaagcagagagatggttgggagactattaggtaactcagacaagatgagatggtaggtgcgatcaggggactagacgtgcaggtaggtcagattctggatatattttgaaaacagagctgagaggatttgctagtggtttggacgcagattgtagaagattgtgatatgtcagtgagaactccagagtttttggtctgaatgtcagtatggatggtgtatccttaactgagatgagaaggcttcaggaagatgtgttttgatataaactcaaatttggaaatacaattctggtaccagtgtgggagatgccttggaaggaatcataagtcaaagcagggaaatcagtttggagtctcagtcatccatgaagagtgttgatgaggtttctaccagtgaccatggcagtggagaatggagaaagggacttgactggggacactgctggggtggttttgggaatgaattggatatagtagaagggggagggtctaaaatggtaatctacatggtttcttgactggccagtaagacacttctcagacttggctctgggaggcctgtatctttccaatcggtcaaatactggaaattaacacctttcctatttgaagatgcttacattcaccgttcttcatatcttttctttgggatgagcttcagaatggggaagcctttccagctcccctcatttctctatgatcttaaaaaatgaataaaccaggttttcaagtttaaggtgctcaatatttttaatttctttggaaaattccgtagtgtcatgcctgagcatttgcagtatcctcttaacaaaactaacctagttttcttgtcttcaatcctaactctccaaaatcctgtgcattgttagcatgctcctcttttccaaacagtttttccattgttgtttgcttattcagcaaacttgaatggctgtaagttctccctgagatgaccccatgttaaattccattgaagattttacatttgcaccagatgctaactcctaactttattacgtagtgttctctaaaaacattgcctacttcactggtgacccactgactctctgacacactgataacagctgtctgcccattttccctgtctgctctgaaactcaatttccagattaatcttcctaaaaatcaaccccaatcaagctatttccttcctctgaaacacatttttacactctattacctagtgatataattacaaactcctccatcccactgacacagtagttctgactcattttgctcattccacacaggtcatagaacagtacactcctagaaatgtctcacatcgactacaatgatctttggggaatttagcaggtatactcaggagcacataaaagagtctccaagtagaataattataacatgtatgaaaccatcacctctctagtccctactatgtgccaagtcgtttttgaacattttaaaagtatgaactcattgaatccacctaacaatcctatgaaatataaactattattgtttcattttatagatgaagcaactcaagcacaatgatggtaagcaccgtgacccaaggtcccatgactaataaatggtagaactagaatttaatttcagataatctggccctgaagtcagtgttctcaattgctctgacaagctgcctccctccttcaattcctgccacccaccacctcccacctctttccccagcgttgaaggctgaaaattaccaagcttaatcagttttaaacaagtttcacataagatctcatttgatttggaaggtggcctgggtcaaccaagccgccaatgactgttccttctttgatctgtgtccttgattatctttctcagataccactcataatttacttaccataaactatcttcattgacctcaaactgtgatatatatatatatatatatatatatatatatatatatatatatgtgtgtgtgcgtatatccatatatgtgtgtgtgtgtgtgtgtgtgtgtgtgtgtatatgtatatctcacatctctccaactagatttaaaaaattttcaaggccgggcacggtggttcacgcctgtaatcctagtattttgggaggccgaggcgggtggatcacaaggtcaggagattgagaccatcctggctaacaaggcaaaaccccatctgtactaaaaatacaaaaaaaattagccgggcttggtggcgggtgcctgtagtcccagctacttgggaggctgaggaaggagaatgtcgtgaacccaggaggtggagcttgcagtgagccgagatggcgtcactgcactccagcctgggagacagggcaagactttgtctcaaaaaaaaaaaaaaaaaatttcaaaaccataatcataattagcactccaaattgctcttttgatttcccaacttcattaatggtcctctcatctaacttcagagtgacccctgtgacctctctgtcccttacctaatccatctttacttgcagtctgtttctaagttttggttcttcatgcatccctaatatcactgttagtcttctctattttttctgtttatagtgtggacatgcctcatgcactgtcccagagtaaggaagcaatgaattgatggttgatggttgctttaggttctcattgtcttttcccctgctgtcatataagtctttatctagtcttccaaattcaataaactaaatttgaacctttgaccccatgtatctgtcctaaattccattgccagtttagttaatctaaggaagaacccgtgtcctcctcccgactatcaccttcctctccacatcattgtctgctgaaataaggatgcattccccagttggtatgaaaaaatctgaaactcaatttccagattaatcttccaaaaaatcaactccaatcaagccattttcttcctctgaaacacactgttacactctattacctggtgatataattacagactcctccctcggcagctccatcccactgactcagtagttctgactcattttgctcattccacacagttcacagaacagcacactgctgtcagtaatgtctcactcagcgcaccattgatttgtcctttccaccccttctcctgttattccactgcatacgttgtaccctcttaggaaaccagaccacaaactactggcataaaaaatgcagtgtgtttccacctccattccctgatttttgccgttcctcccctgcccatccgcttttatgtgttgacacattcacataatcttttttttcttattccaagtgctttcttgctttttttgactgtcagtattttttttaattcactttattcatccttctgtttgatattcgcctcatcttctttactcgatttgaaaattcttaaagacaggaaattggccttacccaactcagtagcccttgcaacatagagtagatattaaataacagtatgttggattgcaataactgctaaccttcagttgactatatatagaaaatatagatcattgttcaaacatagtctaatgcatcattttgcaaataacaattaagtcggaggctaggatgagttagggaaaagccttctaaatttcagactataggaaggacatactgagattaagtagctcctggaatcatctttagaaatccctaaatcttggctaaatatttacctatgttttccacatatgtattttaacaatttgtctcattgtttagcatgaacaccaaacatctctgaaactcagtttcctttcctttaaaaccaagaaacagtatctattttacaaggtggttatgaggaataaaggaaataagagtttaagtaagggaataatttctgcttaaaaagcaactattgcatttagtaggtactaaaaatttgttagtttcttcctcctgttgtgggtacacatggcccacttaactgaaggagtctgggatccacaattaatccttggcatcagagctgagaccccatagtgtggcctgtggagccatctactcaggggacaaccacacataaaccattagccttaagagaataaggaggctctgagcaagacactctaacacttttgcaaacaaaaaatttctattatcaggatttagctatttgatgccctaggattctgtcaaggtaatttgaaggactaaaatcaaatttaaaaggaacggcattctgactgtgcatttcacaattttttctacaaaccacctaaaatcatctccctgactttccgcccagcccactctacttccatgactctaagacaaaactgtgcctagggactgagcagaactgaggttataggtggggaatgacatagccccagctgttgggaaggggaaggctgcagagcctaggagcaggtaaagtctggagcaaacacctctgccgtttttattcatctacacactctttgaggcttttttttttttgtctttgaagtggaaaattataagcgattagaaaacatggaattggcgaagacagaatagtagaaacactactaaatggtttttaggaggcattgtaaacagattcaaattttcttgaatgcaaagttttcctcctcatttcttattactttcttatttttgtgtcttctatctctctttgctttctctttgttctgtagccttctctgaacactgtttctgtcatcgaggcttttaaatatatattgttaaatattattaacttgatgtaattaagcaaaggaaggaagtcagtctaaatcaatggcaaactggagaaataagcaattttttaggaaatgaaggattaatactcttagggatatactgaaactattgaaagcagtaacacactacatcactaaggaagtggaaggctgccttaactcctacataagcacattttggaaatttattgtttgaaataatttgttgtgctacagacctttactgtttaaatagactagtatttattttttttacgaattgcttagcaaaaaaacattgaggatattgagatataaatgcaattcttcgttgcttaaaacttggtgctaataaggtcaagaccacacactaaatctccgtatctgccggttctctctctctctgttgcgtggccacaaatgtatgaacaagaaactcagatcataagcagcagtgggggagaggatgtggatgagtctgtccaatatgccttctcatattggaaaatggctctgttttcatctgatatgcacctgtggttagtagcttcgtatttctttgtgagcatcagttatcctagaattttaaagataattttaataccatcattgttgctttaataatttattttatttgctatttcaactctactatgtggtaatattacttaaaactagatgagaattttctgctttcattgatatttcttgcacgtatatttatattcttctcattaaggctaataatactatgtgagctcatagaattggcattggaattctctgaaggaaaaataatgatccatttcatgagatgagcgatttttacaaactgctgtttccagctcagagtgctttgttcagtgattaaaatgtatttctcaattaaattaaaatgcaaatatagacagtctattttatgattataatagaattatttaaagaaggttttatgtaaacctgctattaatattttatgcataaactgttcgttttattgttgggccggttctgccatgttccattttcaagattactagaagtgctatgaaaacttaatcatactgtccaggttttatcagtttttacccactctactctgggaaattaagtaggatgctttcctatatactttataagttatgccaggggtgttggagaaatataaactactaaaacctcagaatcccctgaaactgaattatgaacaatttactattctttaaagaaatgtttttgttacacagatacagtgactcttaaatttacgagtaccatattttatagtttctcatgaaattaaagatctagaagcatacttcaagaagccattattccaactttttaatttatattagaaatataaaatatttatattagaaactgcatataatgctatggatttaattatgatccttttagggttttcttttttctttctggtgtcctataacttctcaaacatttggattaaaataatctttaaataatattttctaacgtgatcctttttgttgttgttgtttttagtgatctcagtgaaaaccaaattcaggcaatcccaaggaaagctttccgtggggcagttgacataaaaaatttgtaagtatctatttttaaatttatagtgttttaagtcattatctattttcaaagtcaagtttatattaaataaagtgtcagaaagaaatggtgaaaaccctgtgtatatttatgcttgcgtaggagaccttgtaacagtaagttgtcaattgttttcacaagctgtttgacgagatgctcatttagaagatgtctggaaacaagccatcattaaattcattctttaatccttgtgattaatcttttgaaacctatgaagtgatttgattcgcagatatttgtgttttttccccactttttctatcagcttacttcagtaactatgtattcagttgctgttggtgtttattagaaacaaaactgttagttttattgttgggccagttctgccatgttccattttcaagattactagaagtgctatgagaatatggactattattttctggaaatagtagataatattttcttcttagagacacctgtagcctagagctacagctttttccagagttttaagatcaccctttgcattaaataccaaaagcatgagaatgacaaaattatgtctttccctttgtgtgagtgtatttcttacactttccctcatatcctcatgaaagaatgtatttatagcatcctttaaaaaaatgaaagtgcatttctgtattttcctttgataaatctttagtctggtgtttcaattataagcattttttaagtgcctttatttctaaggatgcatatcagatttaagatctcagtgacaatcataatatcaatatctctctaaattttaaaatactatattagcttctaaaaatgatggtttttgatagactatgaatcctaggacataaatgtttttcttagcttttacattagtttggaatgtaggggagaaaagcccctgtatgctgagattaactgtcaggaatttaatatttcttagctagtaataaacagggcaggcactttttcaagaattaacttatattcagaattctccatggttggatccaatgcctttttttttttttcagtagcaaaagtaagacagatgttttcccttgtcaaagaagacaactgtttgtaaagccacagattttggcctctatgtgttctccttaatgtaaatgattttttgaacttgcactttctaaatgtacaggtaaagacagacaactacaggcttctaaggtataaatgtataaagccattaaaactatggctgtaaggtttttatgggtgctcaatttaatatgattttatttgctttctttttacttttgctagttagggcttcaagaagtcttcaggtagactcaatgatacacagtgttcaaatctacctggatagaacagtgtgcaagaattcctatgtagcatttacttaagttgccttcacttagctgtaaaaatacggcaatagctgcagttgaccatcccttagtaatgctatttgcagtcttacagtagtattacctctaattccttaaaacaggtggcttttaatcttcttagttaagatattcagggaatccaagtaaaaaagtggccctcctcccacatttaaggatacgcatggaaatagggaccagtcagtcatgatagaattcttctttatatattttatatttatccttaaaacatgtgatttcaaaagtttagcgataacagaagctagtcagtgttctatctaatgggatgttgatttagcaaagttttcaaatcttttctcccccacaggcataattttttctcagaatttaaagattttttattatcatttatgcagttagatgagtttttttaaaattattaatgcagttagttgagtttaagactggagtctcagaatgttttgttattttttggacttgcagatatgagcaaattagtcagcttcattaagccttagtttttacttttttttttttttttttttttgagatggtgtctcgctctctcacccaggctggagtgcagtggtacaatctcagctcactgcaacctccaccccccgggttcaagcgattcttctgcctcagcctcctgaggacctgggattataggcactcgccaccatgcctggccaattttttgtatttagtagagatgggatttcatcatgttggtcaggctggtctcgaactcctgacctcaggtgatccaccctcctcagcctcccaaagtgctgagattacaggtgtgagccactgtgcctggccagtttttacttttataaagtaaacaatagttatttgggtttggtatggttattagggaaagaagatgtatgaaagacctttcgaaacagtaaaatgctatgaaaatacagtatttcatttgcaagtatttgactaatcaaatgctaaaagttaaccctaaaaaatgcatcataaggggagacaggaaagtgtaacatgaaatgattagcaatattgactagaaatgactattctattgtgggtcattttgacatgaagttacaaaatggaaaaagaaaatataatagaaagtgctaaatgaatatgcacaagaccttgatttgtgaacaaggcattaaaggctgtaggtgctgaggaaacagaaaagtatcgcttgaagttatcagggaatggttagattggaagagtaaaaccatagtgcagtggagtctgtgtgtgtgtgtgtgtgtgtgtgtgtgtgtgtgtgtgtgtgtgtgtgtaatgtaagggatggaatgtgcccaaccccagtttgttttttttgttttgttttgttttttgagacacagtctcgctctgtcacccaggctggagtgcagtggcacaatctcagctcactgcaacctctgcctcccaggttcaagcaattctcccacctcagccccctgagtagctgggattatgggtgcccgccaccatacctggctaatttttgtatttttagtagagatggggtttcaccatgttggccaggctggtgttgaactcctgacctcagatgatccacccgcgttggcctcacaaagtgctgggattatgcacctggccatccctgttttttaaaggcaaagcagtatgtgtcttgaatagccgcagtggtaagaattatagggatctgaatatggggggagctgagtattgtggcatctacattatttcaactttggaagcttatgtttctacagaagaaaaggggcttcagaaactatgtggatgatgagtgatgttgatcaaaagaacaatttattcccactattctcattgccttccatgtaacaatgtgaaagacaatgagggaaatattaaaatatcacaatgaatgtataggtttattttatgaattaggatcacagctgcaatattataaaaattttacattaaaaggcattttctaggattaaaaaatagttcaaactacattgttcaagaaaagttccaatctcatggggtttgtatgaagtttaatcatgaaaacttacgaaggctatctggtaaaatatattataactgagggtaaatttaattcctattattgtgaaactggtgaacataagtcatcgtcatggctcaatacatttccattaatattagcattattaatattattagtatttggtgtaagaagaaggtacagtacttcatcccatgtgtcatgctagtatgtccatttacaagttgaaaaaccctgcatgatgccattgtggctactgttcagtgttactcagagagtaaaagagaaaaaaaagaagctgcccaggccatattttgtatagcactatgtaaaagcccagtctgatgcactgtaacaggtttatgggatttggcacattcaggccttagagcaaattccagtgttcacaagattttcactaaaagcatttgctttaatcttgtggattggctaaatatgctcaaggcggtatcccaacaatatgaaattgatgctgtggaaattttgcagattagcagatctcattccccttcctccaggcaagccacactaaaactattctaaacagatggacagttatcttgctcttaaacatctccagggaggacttcccataacttttttgcttctctctattcatttcttaactcgattaaatttttttacattttattttgctaccttattttctccagccacaatttaaactactttttcccttgacattttacacaatgagatatgctgtgagaatagcaaggtcatatgaaaatatcaactaaattatactgtttataatggtcactggtggtacatttctgtaggatttacatttgtgtttttaaactcccaaaacaaatatgaattaagtattgatagcatatcattatcaactgatgctttgccaaaatgtaaccaatatttaggaaaaattgctttagaaatgtgtgtgtgtgtgtatatatatatagatctatatatctatatatagatctatatatagatatatatctatatatatagatatatagatatatagatctatatatagatatatatatctatatatagatctatatatagatatagatatctatatagatatctatatctatatatatgtagatatatagatatagatatctatatatctatatatatagatatctatagatatatatctatatagatatatctatatctatatatagatatatatctatatatagatatatatctatatatagatagatatatatctatatatagatatatctatatctatatatagatatatatctatatatagatatatctatatatagatatatatctatagatatatctatatatatcgatatatctatatatatcgatatatatatttaaaagccttaacactgatgcagtaaagcctttgctgtcttctaaacaaatattgaacagggtcatgttacattgtgccactgatttgttttcaagtatctattaggcatttccattaattgagaatttagaaaaatgttaaaattaaatctcactttactgccaagaattgtgagcttattcttgaagaactaatagtacttagtaagtaccagaatatttcaaaagtcttttgtttttatgataaaacattcttagttatagttatcctaggattaaagaaaaaaggtacaaatatataaactttaaaattacctagatcactagtttttagtcacatcacaaaaacaaaatctaatttactttaccgttggttttttagtgagttcaatatgattacttaaattaattaaattcaaaaaggacatattttaaatgtactatgtgaggtaaaccacacctgctttctgctgctttaattttgcaatacatccacaaagtgcatcctctattccaatcaaactttactattctttcttcataaataaatatatatttttccagtttgcttgcattatctcaattccattaaccctatgtctgtcatgagtcttataatccttttccaggaacaaaatgcttcttggttaaaaaatatgttggggaaaatatttgtatttatccttttttgtacatgcattactttttagacaaggctttaagtcagtagatgattcagtatgattctctttaggtaagcaaaaatatcatttggaaaataaatatatatattcctatgacattttaggaaggaagtcacccaatttggaatacattatttattagcataaaacgatttggcaaacaggatagagagagttcacctatgtgttgttacagagctatttacattagttagaaattttgtttttctgctggaactgtgtcattttcaagttttgtatcgatggctccattagaacccatagaaggaaaactcacagttctatcccagaggcacagagctgcttacatatttcatcatatttttaattttttctcatttcaaatatctgttttctagttttcactgtcatctacataattcctaatgataagagagcaagggttgctcacttgatatagaatcaatatgtaacaaacagagaaaagagggtatgtaaattttaccaggcaaatgcaagacctcattaggtttgtcatataagttaggtcataattgcaaaatgtcttctttaatctgttagtttttctgtttagttcattggattttatttcaaatccattgatatcagattgcagctgtacatgtccgtgcccctagctctttcctagagtattttcagtaaacctgaagctgaagagactgcaaatggtaggttggtttctcatttatagggattgctatccttactcttaaattccagaggtcttcagtgtggtatagaaccttctgaacaaacctgtagggagggctttttacttagatagatagtaaatgaaggtaaggtcttttattgcctttctgaaatgaaacttaccttcatttcctatgtaactaaataaaaaggggttgtctcaggcattcatatatataaaaaaattagtagctcagcagatgtccccatcagtactatgggaactgtccatggttctgtattttgcttggttgcactgcctctgaaagcacaatgaattgtgataatccccaacaactatgacaaagtttgctaccaataacctctccatctttgcatttttctttgtcttcagagtgctttcagcagtttttcttcaataatgcattttgtcatgtaaagatgtaatctaacaatatttcttcataaatgccttctagaacaaaacaaaataacacaaaacacaagatagtctgattcagcaattgggaatccaattcacatacttacaaaatatgaattggcataatcatgccatggctgctgtgtcttcttatgatacagaatggacctttgattttttgcatctttaacactgaacagtacactttctcacctctgaactcttaaaatagcctgctaattgaattttgacctctagtttatattctcattagataattttaacaaggttgccagattttttcccataaaacattgtttattatctattactacagggtttaaaagtattcagtttatttaaaaagttgttttaaagtacctttgttatagacactatggcaaagccctgggaatagagcagaatgttgccagttctatagtgtctatagtatactagatacagaaactctaggactaggcagaatgttgcctagttctacagtatctgtaggaattacagactctttcctgaaagagcagagatgattattaaatgctgtaacatccagtctctttaggcattctgactactcctagcattctgactttgatccaggctcctagctccttcttcccttcaatctgtacagaagctctttgctcaagccagaatggcctctctgttgcagatattcactgtgaacattgtagtgcctctgctcacaactcttctttgatagacccattacctccataggaaatacccactttattttctgtctaattagattctatccattttttgaggatctgaggttttggtttttttttttttttcctttctttcatgactacatcagcctagagtaatctctgtcttttctgacattctatagtgcttttcatctgctggtctcttccatagtaatcattgatttagctgaaacctccatttggagaacaaaaagttcctgagtctttttcctgagtcactatgtattgagagggagttatggcaatacatacatctacattccaatgaaaacttcacagactatttgctacataccatgtataacttattgaacttctgtgagactcatagtctcaaaatccggatgatgctaatttctccttcccaagttatcatgaggaataataagatgacgtatctacagaccctgccatatgctatgaatttattaaacgttagcaattattattatcattttcagtttctaccacttttgattagttcacttacaattcccaggacttaatgtcaatgtagttgtccttccctcaattgatgttaaagcaggttccctccccatctctactactgctatctgttgcttcttccccccaaattgacaaacatataactttataccataggctactcctataaaaactgaaattctttattcctgtgagaaaagcaaattgttgcctgaaatattgtaaaaggattaaattctcacataatgtaaattactttggggtcctcagaatggtccataccttaattgctttctttaccagttttgaagttaatactgatgtgcttttatgcagaggtaaaggatatagttgctgaaacttatgtcaaggatgtacatgtatatggatcaatttttattcttatactctatatcataatttatatctggggctactctttaaaagcatgattggcataaatattgatatatagacatttgtattgacttgaagtttatacacatatggaaagaaggagaagagaccacgctcatatatgtacagcttttttattctttttctcccatgtggtttatatgttttatttggtttctttacaatagtgaaaaattgttattccctcatattgattttagccatttcgatgtgtcttaagtcaactaaatttttggagttttctatcttacaataataataatacgaacataaagtaaactatttctagcactttaaatgaaacaaaacaatacaaaattggagcatagttataataattttgttgagacattgagagatccagattgacttagaaattattaaagattgttatgttctatattgttaagcacattttatgtgtcttctaattcttaccaaaaaaacctattagttataagaacttataacttggatgctgcagtagaacatgaatttgctatgggtaggaacacactaattgaaattactgcagttttatatagttattaacctaagtgttgtatatgtaattcaaactcagtgtgatatccatattttaaaagaataaagcaggaaattctttaagaaaacctaaatgatggactagcatctctgtttcaggatgccaagtaagcaaatgtttaacctttttgtcatttaatatacctatttttaaaacttatatttagcaacattgtatattgtcccccatacctagaataaatcaaaatttgaaactaggataaattatttttagtattaaagagaatcagatgagcttcagaactttttgcacgtgaggcatacagtggtatctcttaatatatggagcccatcgacacactgcattatgtgagactaaatttaccagcgctggtaaaaaccaaaatgaactatctagagttattctagggcatcagaagatatacctcctaccataaaaaaaaaaaaaaagaatgttaataccgagagatcatgattttttttttttttaagacatggagttttgctcttgttgcccaggtgggagtgcaatgtcatgagttgcgattttggcgcgctgcaacctccacctcctgggttcaagcaattatcctgcctcctcccatgtagctgggattacaggtgcccaccgccacgcctggctaatttttgtatttttagtagagatggggtttcaccatgttggccaggctggtctcaaacccctgacctcgggtcatccacctgcctcggcctcccaaggtgctgggattacaggcatgagccaccacgcctagccgaggtcatgaatgttattcttgaccccatcatttccgtgagattaaagcagttcttcaaaacacaaatttacttggacagcaaaggatcacatagagaggtaatttggaatttgaacagaagccaaagggaagattggagtcagcaaataagggagaagacacaaaagtatgtgctaagttaggtcagctgaaggtctgaaataaaccacttatgatacttctgcccttagcatccaactgtctttaatgatctgcaaatttacactatgtcttagtgaatagttggagcataatattttttttgaagaagtgaaaaagtctcctctggctattttcttaattcagaataatttcgtagcacaattgcaaatcacatctgaagaaggccagcctgtcactaaaggtatggcagagaacagatcctttcctgtttacagaagccagaagtacccagggcttgaaaggtagtggagaagggagtgagcagggtgaaacaaaaagagtgcagctaagtagtccagaaaccctgaaataaattacattgttgcatagttttgacactgtttatcttgaaccatatacagacaaatgaaggtctgttgggagagattttctcatgagcagtgataccagcacaacactttatgtaaaccttcctttgaatatcaaaaaattgacaggttaatgaaagaattattcacttgtttaacttggattgccccttcatatgagtaacctcatgaaataccttcatgttcaggaaatatgtggactcagatataacagtattcagagaacttttaaggaaaacctcagtcctatggaaaccaaacattcttaatgttttagcaccaataagggcttagatttctgttaagaatatgaagaagcgtataaccatgagcaatattaaagaacaatgaaattaccaaagtttccagcagcatctcaacttctgctcctgtaaggaaagtagttggccttccattccttgtaggacaaggtttgcttgagtgctttctggcatgctggaggttcccctttgtgtattgtgtgcatgatttagaagaagctgtgtcagcattgatttatacattgacagctaaggataataagatatgggcaaacatacagctcacccttttacagattaacctggagactgcattaggcaaatttgatagcattaaaagattttgccgatttgtctggaaacaatttctcttttgtagtgtgtcaggggtaacacttcatgccattgtactaatttaaatggctttgataaattgttcaagaggttagagaatagtagtgtagatatatatatagcactttaaaataaaaaaggctattaacttaattgttaaatgaatttaatctgtaaaaatcaaaagtgctcaagaatgtaagtgttttcttggaaccacagcagccatattacatcatgagactttaaatgtcttcttcgaaaataaaatacttctgcattatgtcttaataagtagaaattatttaggctattataatagcatggatgttagctatgatttggggaaaactttagttttataaactaaggcttatacaggcaataaaattgtatcttctttggggtgcacctttgttaatagtgcacgtcctaaattgtaccatttgcatgacatcaaggtagccttgtgtatgattgtgtcccctagagaacttcttataaatgagatgtgtatttcatgagacattgtctatatacataatttctaaagtaaggaacttgaagaggcccatctgaaagtcactggattaaatcattgcacctttattcagtagtcttgtgggagaaacagctattttatagaaatgttcaaacggttctttatgaacagacctcaaatatgaattagccctttcagtgaatgctgaacttgaaacgaggacaggatgcatttgtattacgatcataatcttactcctgttcatccacattctctcacccagtgcgtgcagagctgaaaactcgcctcttccatgaaacattttgtttctatctcaagtgaaacgtcaaaatacttttttaactgaaataatagcatctctaatattcaagctactgtatttaaacaactgcttgttcagaaaaaaaaaaagagtgtggtacagatacaatatagtacttcactgttaatttcaaccaagtagaaggctcaatatgaacaagaaaattttaattctagaacaagcagcaggaaaagcagacataaccaagtttggagcattctttttttgtactatgaattttaacaaataagtgcttaagatattggagaagattcatttacttcaattatgcattatttagaatttcactgatacagcttttaggctttttaccatagatacatgtagtgtttttatgatgtgcctgtagtatatgtttcttagtggctttaaccaaaattagcatctttttaaaaagcaaaattgttatttaatacttaaaaacctattttctggagagcgatataattctggaagttccttaactcaaaagtatgctgtatttacaatgcagagcatttgcatataatgataaagaatgtgaattagtaggatagtgacacttaatatagaacaaatactagctttctaaagtgtatttctggttgggaataagagcaagctatatgggacatcagttccctttctcgatttggagtccttgaaggaaaactgcttttaaaagaaggaaacctaaaagtagtcttgctctctcatgccaaggatagtgaaattaacatgcagctgggcttctctgataaatggattctgttaggtcactgagggggtgcatgtgacattaagtgatttacagtcctttaccttaatgaaattgtttcagcaagatgacgctgaaagctcttaatggatagcttttcttgatctaatgaaattgcattcctatggcatttaatataaggtgcagttattatttactggagctttccaagggctgctatttgcacagacagttcagaacaaaaagatttcagtggcggcatagaggcgagaatggcttatgacattcgtaagcagatgagtgtgtttgtgagggcacttcagtgagtgtgtccagggtatcatagacccttcaggaaacttctcatcacctaccccagctactgtccatcccttctacatatattcttctaatctttttaacaggcaactggattacaaccagatcagctgtattgaagatggggcattcagggctctccgggacctggaagtgctgtaagtactgctatttctcttgctcttttaacgggggctttgtgtctggacaggactaatgtggaagcttatctgctagcttaaaaccttgttgtcaaaatagtctctcaagagataccttaaataactcatggtgaatacagagaagagtctaaatgtgtgtgtgcaaaaccttgcgtaccatatctgtatatttaggtaaaattgtgtaaggtcactcaaatgttctccttataaatgtttttatgagattcatagaatttgtcattgctaaatattgagataaaatcaactttataggaaaaataacataaaaaaaaacctcttagtagctgatatcttggaataatttgtcgttgttaggcaatggaaacacagtttctcattaaaaaaataaattttttaaccagctgatttaacattatttttgtaagaatactttgaaatctgcttcctaaggttaataagccacccattagatccattttcaagtcttcaccactgactttgtaatgtacaacacgcagacttgaattataattggcaacctcctttcctccctgggtaggcatgactgacaaaattggttagaggcaactaagtaacctctattgaccaatgacttagtaattttaatgaaattacaaattttaatgaaaactgtggttactaaagcattatatgccgcctatacatttttcgaattttttcagccaaaattcacatttgtaggttttttaatacacttacaattcctccaccaattaaaatatttttctctgctttatttcatccttgagaaaatttagtcagaaatctataattgaattaaatgttagggtgtttttagtcaatttattaaaagttatcgagaaatcataaaatccttccttttccccacaaaaaaggaattcattactttataaatctagtttcaggaatggaatatcattctgaaaaattaatctttcagctaaaatggcttattttatcagtatttttatatggttttggttttaattgcaagaaaatagaatttccagctgtgtaatgtactgttattaattattttaaaagattgtatgaatgaattgattgggataaaatgtgaaatataaaaatatagactactctctaacaacaggagaggccacctttgtttctattgataatggtctaagtttctatcggaaaaatattcaaagtgcttatcatatacattttagctttaagaccactatttaaattgtataccagaaccatttttaatatacgaaactcactgatggtatctcagagtcagaataattagaatgatttcacagtagtggtttcatggcaaaaccatagtcagtgtcactaaaattcatagatgaggagactaccaaatttaatcaaacagctgatcaagccaaaaatgtattattaaaccagtgttcctaactagaaatatgaatgataccaatcattttatgcaaagtttgctatcttggatgaattaaatcccataaattaccttgttattaagttttcagatgtagttcttcactgtatttattcaatatatgtatatatacacataaatgtatcgaatacctactgtgtatattttacaaggtagagtgaacactatgctaggcactgaaatcttttacccacaaatacaataactacatttgattattttctataaactaatatcgttgtcttcagaagcagtacgtttatgaaaacacaatcatctcatacattttgatcgtcatgattaatcaaaatatctaaaaagtgactttagcaagaatgaggcaacacaccaaagggtgacattttatggttcatggaattaaaatagaaatccaaaatcttggaaactcttttgaggaccttaatatatacatcttatagaagtatatattggtcagagtttgtttgttgaagaaataataaaaattagcatatgatagaagacaatgtaaatttcttctaaaaagattgaaatattttatattaaaattttataaagttgatcagacattactttaaatgtttttttttcaatcctcatactttaaacaacccctagaaaaatcagttgataaataacttaaggcaaaattggagcactgaaaagacgataatttatgaagcccaaatcacttgtgaaatacaacaaaagtttacctattacaaatgtttggtcaagagcttaagagaggttgcatgaagaagggttctagaaagatgactgtctgttttgcttatttttaccattcgtgactctttaggatgtactgtcttatgtggaaataatgaaggaacattaacttacacattgccttaaatttcagattccaagggttttagattttttaaaattttaattccttgagccatttgtgaatgtatgactatactgaagctagatgggagaaaatgaggtaatggcccttggtcattgatgaaaagtatcaaattaggatatatatgagcgtacaaagagtgaacagagtccaagaagtcaagtgaaaatctaaggtggatgaaagcaaggaagcagtttaacacttgcacgttcacggagaactggtttattgtcagattctgatttgtagaacttagaagtaactgcatattttcttaatatttagataccatctcaaaaataacattggaaactaaatcttgatcagtattttcccttctttggacactggcctcagaaatgaaatatatcccttgaattgctgcttttacatgtttatttttctttttcacagaatgaacataatttagtgtaatttaattgtagtgattcatatccactaaataccaaactctgccaaacgatatgcatggtggtaagggaataagatgactaaatcaacatacaagtgtgagaggtgctccatgattatacaggctaatatttatacatcaagatgtcttttgtattagaatactcattacaaagaaaatcttgaagttgagcacagaaatagacttacacatgggagaaaatgttcacaactaaataattacaatatataaatttccattatttcagaatggaagttgaccataaccataacatacacaagtaatcatacttaacacttatatttattattaattttaaaaataattttgttggttctgcatatttttcagtcattgagtatcagtatcagtacttctttccagcatcagtacagaataaaatactaagataatgtattcctttagttgcattatgtgaactaacattttgagaaaagacttcaaattgataactgaagtttttggcattcaatgaaagttttcctttgcatggagatataagaaactatagttcaaaattaatgcatgtctgctctctgtgtagtacttaaaacaatttattcccaaagtcatatttcagaatgctatatactataaagattttagccatattaagtcagcataaattttgaggatgggaaaagggatcatttgaaagcaaatcccattgagaagtttaacctttgcattcaaacatcaggatatattttaatggcatttgaaaaagacatctcatttcacctgcacataggaaaatgctaaaagctcttaggtaaactgagccaacaaatccagtgctctgtaggtcccccataaagtggtttattttttgtgacttaattcaaatgacttagaatagttcttatataattcaatacattgcaaaacaaggtggtaaagagggtccatgcatgatctgggtctctagctgacatgccctgttttactgaaaagtttttgtcaatctcttgacctctgaacgcaccatcaataaccgcagccaccaactggcccagagtggcctcaaaaatatattttgtgtagctcaaacataagcggtctacagactgtttgaaatgttttaattagttgccactatttaaacattagaaagatctaaaaatttttatctctagcttcccttggaaaatctgattgtttgacagccctcccttacagcaggtcagtagtccattggagctggagattatctgccacaagagagactatcattgctagcttaccatattcttcacattccccaaatgtctgctttcttccatctctcttgcccatcattgtatatttttgcacgtggcctgcttcgctcatttctgttctctgctcaggccctgcagtgaacttgcaacccctaattcaaatccttgtccagtatcaacttcatccaacaggaccactgatgctctttctcctacctccttcagaggaacttgccttctttagtcaacacctcaatgtgtacctttagtctctcccagtcttagaattgctttccatgtctacactttacttgtataccccccgggataacttctaccactttcttatcacaaccagatttttctgaagggtgatgaaagctcatatgttagccttattagtttttgtaatttgtccaatcatctccccagctggactgtatgctatcttaggacagagtatatgcctgatttatttttataatactccatgttaccataaaataatagccatttgggaaatatttgatgaatgaatgagtagtaatagaagtagtaataatcaataataataataataaaactaacaaagttgcactgggggaaaagtaaggatgttatttattttcacaataactcttcaccacacatattcctggatctgctacctcaagaaagcatgactgctgccacacagcagtaaacaaaggtgaatatgctactgcaactaaaaaccattagaatggattaatcttttaacacggtgctacagcaagttacttcatccccacctggtgcaagtaccagatgtagatatagctgtttccactcaaatttcagcagtggctgatgtctgcggtaaataatagttatcaggactctgttccaaagcctgacacgaatgattctgtattgttgctatgagaaatcagtaaaagaatattaattcaaatacgttcattgactcatggacactaattacacataatgccactctacggaaatgtaattgggcatattttccaactgtaactatcccgtgtttatttcttaaccaatatcctaaatagacatgcatgcacaaggtacataaagtagaatgtaaatagtcaaacatgctatgaatgaagccataaatttgtagtaaatgttgaataaaacaaaatgtacagtaatatgttaaattatgaaattatttatcaacttgtctatagagtagtgcattctctatgtcatctctaccaggtagctgtcctgcataagcatagtacaagacgttttctctatgttaatatataaaatgatcaatcaattttgtatctaaaaattctaacttttctttttaattctacagcactctcaacaataacaacattactagactttctgtggcaagtttcaaccatatgcctaaacttaggactttgtaagtagtcacaatatatgtaaaagtcatattaatcaattaaagcttccccttaaatagcatgttcagtaagcaaaggacaggaccactggtttacaaggtagacaaggaaaacccaactttggaaaagactagatatgatatttgtgggaatgagctattattctagaaactggaaagatttcttttaactgatatgcattatggaaactttggagttaaaaaaaaacaacatttactttgagctattgtggaggtcacatttcattaagaaatggaagactccttgattggctgtcagaaatgataaatgggaaatctttatgattttattactgtactgcaagcagacctaataaagctaaactggttcttcaacattccttataacgtgaaattatagcatcaccctctagtacttctataattaagattgtgtcagcatttatatttaaaaatatctttctgggttacagatggacattaagatatttttggtctaataaagtattgactacagctgtttcttttctcttgaagaaaaagtaatccttaaagcccagagtagcctttaaaatctttaaagcccagggtggactttaagttatagaatatcagaggtaaatctcatttgaactgaatttcagaatcaccttgacctaaaaaaatatattacatataacgtgtaggacatgattggaagcaaaaccaaagcatcaaacttcttgaaaaaaaagtgtttttaagttgggtaaatatattttgattagattttcaaaatactcctcattttctgatagcttgtaactggaaaatattaattttattttcttaataaaaattttgaattaccatctttttaatgaactaggtaataccaattttaatgtcatttttttcttactgaaatccaactctgtacataataacacatcattataatttccttggaatattatttagcaaaataaaggaattctacaagtatacagacatagctaaattttgcattcttggggctatcagaataagactaatctgacagaattaacagcctagttcactcaaaactataatttcccagtaacttcaggtattttttttaaaaagaaattgattcaagctttcaatctttgcaaaaacaaagccaatgaaattgtaaaaacattcatctgaatttttgacagtgtcccttattttcttgtagaaattcgtgagtttgtcttactaatcaggtttttccatttttacattcttttctcatttcaagttcctaattggaatttttataatgtgcttggtttagacggaaatatttagagtacaaggatatggaatgtgcctctgtggcttccaaaggccagaacttcaacttccaagcaaaccgagcaagaggtcacccatctttcccaaaatgtagctttttgttctgtggtacgccttctagttgtgaagcaaaacattgtgttccttatctataagctcaaggagaatgcaaagcagccattttacttgaaattcctttgctttggttgggtcattattctatagtatcattgctacttaaaaattccatttttatagcctaattatctttctggactgagttccatgttttaatatccattactgttattgggttagaattgaacacatcagcttaaaaggactaaaatggtattactgtgtcatagatggttctgggaatggtgctttgatttatagctttggatgtccttttctttagtttgagaaaacataaaagccagtttgaagtcatttacctaatttagtggatacatttgtctgatattttattaatggagaagtgctatttgccacttggaagcaatccatgatcttgtgtggatcctgccaacatagagcgactcacttaattccttcactcccagacatttgtgccttttaatttcagtccctgctctttgaggctaggtctccaggagccaaaggagctaatcccttttctgtgattaaacaacaaaagaaggaaatgagaataagggtgtgaaaaaagtgttttatattgaattattattctgtcttgttcagcaaaaaatgcaagtgtcctgctgcaaaggttttataagcggtttctatagagactcataatggcaggaattattgatatttcaaactgggagccacaacttttactaacttgcccctcgcccagtctccccattctcccaccccacccccattggctctcaggatgttggaactgtggagcaatttgcattggacttatttttttctctttcctcttttaaatgaacgtaagtgaaatatgttcgtttaaaacataattttatggacatattcaagcttctataaattgctcagttcagactaaatgaagagagacttgattctgtgattgtacatcagtttaatttttaggaaaaataattatattggaatctgcttagctttatctacttctatgttaagaaatacaggtatatattaatgaaataacgactttctgttttcttgctttacacttctttttttctcatttagtcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtaagggagaaggaagagtgatgttattgtgtttattgtatcctgttatgtaacagaatgtgagggctgcatgcgtcaaaggtttcagtattgttcactaatgttcaattgtgcactaatcactctacagagatcctctttttcagtgaaaatatgttctgagacctcactatatcggttggcaagtactggttacttgtatctaaattatgataaaacacttttcagttttcactccaggggaaaatatggaaaatcgctaaatgatgattctacttttgattttttattttcccattaagtaacaatttatagctacttttatgttaacaattgaaaaaaaatgattagctaatcctggatccctgctatgaaattcaaagagcaattcagccatagttgcaaagtaacaaaatacttttcatgcatacatgtatactaatggttcagttttacttaaaacaaatattaaatgaccagctttaataacaaacatctaaaaacaaaaataagacatagggtcaggcactgtggcccacgcctgtaatcccagcattttgggaggcagaggtgggcagatctccagaggtcaagagttccagaccagcctgaccaacatggcaaaaccccgtcctttctaaaaatacaaaaactagctgggcatggtggtgcatgcctgtaattctagctacttgggaggctgaggcaggagaatcacttgaatctgggaggcggagattgcagtgagctgagatcacaccagtgcactccagcatgggtgacaagagagaaactccatttcaaaaaataaaaataaaaaataggccggggtgtggtggctcacgcctgtaatcccagcactttgggaggctgaggcgggcggatcacaaggtcaggagattgagaccatcctgggtaacatggtgaaaccctgtctctattaaaaatacaaaaaattagccaggcatggtggtgggcgcctgtagtcccagctactcgggaggctgaggcaggagaatggcgtgaaccccggaggtggagcttgcagtgagccgagatcgcgccattgcgctccagcctgggcaacagagtgagactctgtctcaaaaaataaataaatcaataaaataaataaataaataaataagacataggctgtgtctaatatcaatcaatagctaacgtttactgagttttttaatatgcttaagcaccaacctaagtatttcacatatatttacctcacttcacctcccttataacaactgtatgagaaatgtaatattatctctatatttggagattcaaatgctgtgaaaaagaatatccttgccaaagtttatgtagttgagtccagggatctcaatagaagtggtttgattacatatatacacacacacgtgcatgcacacacacacccccatacatagtatcttatttgtatatgtgtatatatatgtgtgggtgtgtgtgtatatatatatatgtatggttggttctgcttcagcttcagaagtatctgttcaaaatacaacaaaacaaaattttaagaaacgtataatgcatcgtaagtagttcacagatttttaaaggcagggtagggagacatgactagtacttgatgctattaaatggttatattttagacccttgtttgtgttttttcacatgttttataacctaagaaaaatttttgtataatatcatggaatgttctcaatatgtctgattgcttttttaaaaaattaaataatgaaatgactaacagttcgttactaaccacttttttctctcttcactttttcctttctgttttctagatgaggaagaaggcaagttcacatttcttttttagaccgaggatatttttgtagtttaagagcttgtttagagggatagaattagcagctggcttgcagcctcttcctggcacgtcaccaccactagggccctttcctggcaggttggaaagggcagtccccactgtcttccagaaaccatgcatgtccagatgcttatttaatacaactgtgctgatattctgttgctcacctttcaaccattaatgtctcatttaaaaattgttccaaatattgagtaataaaagtacacacaggaagggagctacttataccaaaatttaaaattacccaaagcccccaaaagaataattttttattaacaataagatgactttatacaaattattattatgatttcagataaattgataattttgaacctatcaagacatcaaattctggcttatctaatttttccccacatttattggcatatgattatttaatttgagcaacaattatcttctgatggaagtactactgttttgttttcttttttaaaagaaattacaaagtaaataaagctgcatgaatttgataaagaccaagctctatttaatcttattaggaatgaagataaattagtctgaagttgctgggcttttggaaattagaatagttttgaatgtaattctgattttaaaactgaatttagcttttctcacaagttttaaaaattagcagtcttatgaccagtttttagaatctcatttacttcctctcatttgctttattgacctgaatatataaatgcatgcctcctaaaatatattttagaaatataggaccattttatcatcatgtatttaaagagatttatttatgtgaaatgctttgttacttgagctaagtttgtctgtttcacaattatgatattcaggaggaaaaatataattcctgtttatttcttttttaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatgtatgtgcctgaaattctttcttatctccccaccttcccggtgaaccaaactttgattttctttgggaaattctgagtttatcgaaggcacatctgatcaattggcttagacaaatgttctcttcagaaatgtattgattcttactctgattgtttaaaaacataccatgttaaagtggctgtgatgttttttcttccacagatagaattaaaaggaatacattttttaggaaaaacaaggcaaacaggattgtttatacctggttccaccctttgggcctgtacatctgtggttgtccatttctcagtttggagcagtaggaatataaaaagggaccaagctggggttagtaaaccacagaaacaatacagttaggtgatgctctgcctcctcgagagctcatgttttaaaaggcagtttcactgttttgtttgaattgatagttcaatgcaaagtgaagaaaggataacataaagtcaaatgtaaagattttttatatagtgcatgttttagcctatttgaagcagtgtctacctccattaaaagttaaattcttatgacaaactattgcacacgtattttgtatgcagctgctgaatgcatttctatgtcctcaccaaatataagtcatgtggataaaacaaggtcacataagatgtaaaatggaatgcttttaccatcttgaaaagtaagcactagggaaaattgttacctcaatattcattgacaaaaccccttttaaccacccagcccattatattattatgttataggccaattctaaattgtaactaaataaattatcttggatttttggttgaaataataggaacaacttcttagaataggcctacatagtatgcgaaaaagttgtttttaaagcgctcatttttaaccaatttatttaattatgataataaagtaacttatctaatgtaccttatatgagaataattttagttcacaggactcactgccattagtttaaagtatctaccatgtgcttaataatgtgcttagagctttgcagtataagacatgaacctctgcaggaattctagactctgtgaagatttgacactgaataacatataaacataataatatcattctcatcaaaattttaattgatagaacattactttacctctagaagacatcttttagtattttttggctgaaccttgaaagaagaataagttataacttgggaagagacagatgacattactgaaaaagaaacattggcagcaaagaacagaggtggcagtaagcattgtttgagagattgtagttgaacctaattagaataacaggataatgttgaggcatcgtgaaatataatgccctaaagaatacatctccatttgattttaaaactacagattactgaagatgttgacacttgatgggaagatattagatgtgataaagtaaagagtagaacgaaatactaaattttctcataagggaactatatagtcatctatgcaggcacaaacatttattaagtgactatttactacctaaaggcaccattaattttcctgagatcatccatcaagtggttagcaaatgtgacatgcaaattgaaaactattaaatgagatacacagtgaaaaacataataagagatgaacacatcaagttcaaggtcttacaaagggcatgaagttgagggcaaggtacgatggttaactagagtcagaaagttttagttggaaccccaggtttacctatcatttactatttgtgagaccatggacaagttacttatcctctgagaccctgtatcccatctaaaactaagggcggttgtcagtttgatgtgaaataattaacacacatagagctatgtgtgctttgcatatagtaatcattccagaaatgataactcaagcatagaagtctttgtgtagaaataacactgagctagagcttgaaagatgggtagtgaatgaaactacagagatgaggacaaggctttcagaattaatgcaacatcatgagctaggcagtaggaatgaaagtacaagatgtaatcaaataggaattcagcttgcctgatacatgagatagtaccaggaaacaagttgtaaatatacattggagtcagttcatggatggtcatgttgatataaggatcttggattttatttggaatgcatttgagcataggagttttaatctgacttttctagaataattggtctgatggctgtgtgccagtgatttgacaaaaggagagaatgcaaggcagaaggcctcttcggaggctatttctttggtccagtggagatgtcagaagagtaggagctagtcagtgacagtaggaatggtgatatggaaacagctatgatagcaaacatagtagcagaattcatgggatttggcatttgatgagataaaggagtaatggagaaaaataaaccagactctgccagagtttcaagtatgagtgatgcggaggttgtggttacatcattgtgtataagaaagtgagaagcgggaccaaaactggaaaggaagatgacagtgaactcaatttgtgaaatactaaaggaccagtgacacatttataagtacaaaaattgggctgggtgcagtggctcacgcctgtaatcccagcactttgggaggccgaggcaggcagatcatgaggtcaggagatccagaccatcctggctaacacagtgaaaccctgtctctactaaaaaatacaacaaaaattagccgggcgtggtcgtggatgcctgtagtctcatctactcgggaggctgaggcaggagaatggcatgaacccggggacaatgcttgtagtgagccgagatagcgccactgcactccagcctgggtgacagagctagactccgtctcaaaaaaaaaaaaaaagtactaaaataatacagactataataattttggagcaagcaagacaaggacttgaggcaaaaattttggagtaattaacataatagaaaacagtcaatatttgaaaccatcaactgtctaatgaaaaggagagtaagagaggagaagctcaagaacctaaataaaaacagcagagggctctaataagtaagggaggaagagacttctaggaaaaatgatctccggaggcaaatactgctgccagttaaccaagctggggtctgagagaaggtcttggaatttgacctgcatattgttcttagaaggttccattttgatagagtggtaggtcaatgagccacctttcagactgtaaagaaaagaagtattgattaatattcaagagagtagataagccgcagtttgaatagtttggctgagaaaggattttttgaaaaagacaattgttgctctgtaatggacaaatttgggttaattctaagatgcagaaacctgtcatcattagaaagtcagaatgagtttagagagaaacgagagtgtgagagttatataagatacatgtgggagcaagatcagtctggacacaggagcgaattggtcaaatccagatcatagggaaggggaacaaaaagctgttacaggttgataaaaggagaagagtaagatggagacataacatattcatatagcaatatgaaacatttaaaatgattttcttatgtagtctattttatttcttatgatcgtgattttcttctactttgtatgtgctatagattttgtataatggtgggatttagttgcattaaagttatactaaataatatgtcccgtggactttgcctaaattgagaaggtggtgtatcaggtaaagctacaataaattaaatttatgaggagagatgaaaacgtgtgaaactgcttgtgaattttacttccctgattattacattatcagctttatcagtagagcatctggtaataaataatattgatcctcaactcaacaagataattccattttcattcattatagtggcataacttactagcttagtaatttatttcttttattactcttttattttttataagaacaaagaacatcactaagattattaaatgtggaaatatctttatagatggcaggtttttattccatgatgaactgaaaattataaactctccccattttattcaaatatattttcatatctgaattttaccataaattgttggttgagtttctttattgcaagttatgagatatttcattcaataattttgacttgattctccactgtgtgatatgtctttattcttacaactgtctcatgatataattctaatgaaaagaaagtatatgtatgccatatatgagtgatcaactgcctataaatctaagtagaaaataatgactcattttttctgctttctgtttccaactacaaattcatacttctgctatttggtaacttcaattatttgttaagcaatagaaggaaaatattcctttaaagtcagaattagaataatttggagaaggaataatagaaagagactgacatttattaaatacttgcaatgttggattgcagttggatcgcaatgttggcttgtgcacatttgatcttctcattgacctggtgatggggatatttatgaaattaaataaaatagtaaaactaatgcagaagcacaggtcagataaaggctggtggttttctccaacaggcctcattatactgatcatgttaccacagtgcagaagctcccctcttgtttacaggttagaatctgcttttgactgtccctaattatcgtattttgtaattatatactattgtgtgtttatttttaaatatctatctcttctactgaagtaaacgttctatgaaggcaggaaccagttctgttcttatcactactgatgacccagcaaaaaatctagtaccttggcacatagtaggcacttgataaatatttattgggtaaatggaataatttaaaaattaatcagacatttggaacagatttgtctctgaaaagatgaagctgtattaaccaaatttgataaatagaaccagaggaacagcctattatctccctgtagacaaactggtaatttttaagcataaaatcagcaagagaaaaagtaaatgcatagaatttttaatagcatgggccaaaatgggtctagaatgctaaaaattcattaaatttccctgttctgcatacttacttggatttccactctttaaatatttctgagattttttttttttctattctcggctgaccaactcagcatttaataggtaccctattatggagctatattaatttaatcatcttacagatgtcttagacatctttctctacagtcatattccctctctaatgaagcctgtagacatttaactcaaatctttcaaagactgagaactttgttgtttaaaaaaaacttgggaaaaaaaaaaacaggctcaaaaaacttagaaattttgtaaaaaccttcaattgtgaagtggctaaaatggcttcaatcatacatttgcttgactctcaagcccatggtcctaacttgatcaagctataaaagaggtaggcatagcttggtcttgttggaatgtcattaaaggaaaaattttcaaaatcatgaagagagaatgactaatactccgacaaaaaggacaagagaaattttaagaaacttacctatgaagagaacgtagacaaggcattaagatacaggattgtttgcaaaactaagagctgttttatattactttatatctgtaactattacaatgtcatctttcctattctccgttaaatgttctcttatttccccgaatcttctccacacagcacttaccacagtttaacttgttatttgaaaatgaaaaactctcctattaaactgcagactgggtaaaggtagaccatgactttccctcaccatttctgccccaatacttagcataccatgggtggggaagacagtgttgggagcaggggaaggagatcttggacacacaatctagagagcttgcaggcctccattctttatactaaaacaaaacaaaacaaaacaaaaaacgggcgtgctggatcacgcctgtaatctcagcacttttagaggccgaggcgggcagatcacgaggtcaagagatcaacaccatcctggccaaaatggtgaaaccctgtctctactaaaaatacaaaaaattagccaggcgtggcagtgcgtgcctgtagtcccagctacttgggaggctgaggcaggagaattgcttgaacctgggaggcggaggcagcagtcagccgagatggcgccactggactccagcctgggcaacagagcgaggctccgtctcaaaaataaataaataaaataaaaaataaaatgtgacaaagcagtgtggactaatgaagaaaatatagaaggggaaaaagtagaacatataatgtaagctaaacctagctgtaaaagggaaagctgtttgctgccttggggtcatcccagcactttgctgcgttgaactatgctagttgaaaaccttattcttcaatagttgcaatgcctcctgtgagtctgtacatgatctggtctatggcaacacaatcattaatagcaaattgattctgactatcaaatcttaagaattaattacttagatcaccttttgaggtatacaattttgaatgtgatgtgatagattgctatgaagttagtatttagttctcttcaatctagttatagatttcctgtggcatattgccttttcaaaccattatacagaaatttcataaatcatggagaatatttagtaagaatgtaagttataacaatttggtttgttgtgtttgctcctatgtcctcctgcctttactctttgctgcctttttcaggggctccagctccatccatgttgctggagaggacatgatttcattcatttttatggctgtatattctaccgtgtcacatatgttccacattttctttattcagtcaaccattgatggacacttaggttagttccatggctttgctattgtgaatactgctacgataaacatatgagtgaaagtgtcttatataatgatttcttttcctttgggtagatacccagtagtaggattgataggtcaaataatagttttattttttgttctttgagaaatctctgtactgtcttccatagaggttgaatgttgaactaacttgcattcctaccaacagtgtataagcattcccttttctctgcatccacaccatcatcttacacaagtcagaatggctgttattaacaattgctattatttatctgatgattagtaatgttgagcatttttttgtttgttggctgcttacatgtcttcttttgagaaatacttgttcatatcatttgcacacattttaatgggattgtttattttttcttgttgagttgttagagttccttgtagattctggatattagttctttgttgtaggtatatgttgcaaatacaattttaaaagtgtctttttctgttcatttctgtttagataactacctcccatatacgcttaaactttttgcttgctatttctgcatttgtcccactcaaaatattgaatccttaatttattaaataatactcaattttgaatccacatatttcaaagtcatctgactttgttttttgtttgtttgtttgtttttgagacagagtctcgctctgtcatccaggctggagtgcagtggcaccttcttggcttactgcaaggtccgcctcctgggttcacgccattctcctgctcagcctcctgagtagctgggactacaggcgccccccagcatacccagctagttctttgtatttttagtagagatggggtttcactgtgttagccaggatggtctggatctcctgacctcgtgatctgcctgcctcagcctcccaaagtgctgggattacagggacatcacgccatgcccagagtcatctgactttttatatgtaaagatatgcaagttagatttgaccaacttgccttgagcctattatgtactggctgatttaaaataattataagtactcatcaaagtatgaatttttgattgattagcatgtatttagtaatatttcaatcagcagaatatctatcatgctatgcaagtagtttattttaaatatgctaaatgttaaaaaatacagtacaaaacttgactaatttttttacagcacatatggatgaacttgactactattcagacaatattgataaaataagtaaggcaaatgataccattttttaaatgtaacatggtatgaaagaaatagtcaatattctgagtttgccttgttaaataacaagtaggttggcaatttcaaagtgcaattgttttcactttgacagaactttattgtttcattgtgaaaatattttaaaacataaacatattcaacttaaggataataaaatgtaatggaaatcggcataatttagaaaatgttataaaagttaaaatttgagcaattctactttagttcataattttattagagcacttcttaacacatggagcatttgttagcattttgcagttttacacattcctgatattattgctacttcaaatccactcacaaattagctagcctacaacattactttcacttcacattttatgtttttataactttgtgcttttcaggcaagctaatatgaaaacaccctcaatattttatgcctgttagaaatatagatgacatagtactcttaaaaagtgtcttgtatcatacataataaaaaccttctttatgataaaaaaaattttcaaaaatgttaaattatttatttcacttaattcccatggaaacactatgtaggaaactatacgtctcctaaaggttaggaaaattcttttaatttttttgtagtgtagaaaatagttttgttagtttttaaagtgaaaacctggtttgagataagaagctatcatgccgatgcaggcaattagaattgcgttctcaaattttcttctgagatcctcacaatagcagaaactacatatgtatctcctatgtactatgaaagtactagtttttcctctatcaaatacaacttgcctagaaatgtcattaaataaacaatcctatgattaaacaagtcagtattattttatctctgattctgtgctaatatatatatggttagaaaaacaaaatgcaatgattcttctctagattatttttatgtgagtttagtagtcttaatgtcattgtatgtgaattttttatgtaaacatcattcattattatttttattttcttgtgtttttggattatattttcccaagttttcatattatgatttcatcaggtaatcccagaaaaagaaaatattttggcttcctacagacacagagcacctcattactcagcatacaaaatagtgttctacaatgtgtttccacagaagaagcttctcatgttaattttttttggggggaggaggttgagatctcactctgtcacctaggctggagtgcagtggcgtgatctcggctcactgcaacctccgcctccagggctcaagcaatcctcccacctcagcctcccatgtagctgggactacaagtgcatgccaccacacccggcttttttgtcttttgggtagaagtggggtttcaccttgttgcctgggttggtcttgaactcctgagctccagtgatctgcctgcctcggcctctcaaagtgctggaattacaagtgtgactcaccacacccggcagattctcatgttaattcttagttatcattagccacactcagtgtactccttatagcaactttgatagctccacagcaaaacagtgtaaaaagaattatgtaaaatacatttatagatgaaaccatgcatgtagttccgcaggccattattgagttcactattaatcatttgagtgttttcatctatattttggtaaaattcctaattgtatatgcgtatcttgagcagcctttaattgtcattgaaagaataattgaagagaaagaattatactattgaaagaatagtagaaaaattatcttcaaaaggcttcatatatccactatgtgcagagaaaccattttcatgaagactttgtgttcatgataagaaaattcttcatttatattttttttttgcaacttatttctttcttgtacctaatttcccaagaagttatttaggtaacatacatgttatacatacatatactcacacacacacaaatgttgtacatgtgtttttgttaaatcgtgtgataacttaagcagaaaactatataatgcctttctcaaaagaaaaatgtagaagatagaatcaaacttttgtaatattagttgagaagtaaaactgaatataataacattataaataaattggagaaaaagaaatattaaaataagcacagagattaaaatggtaaggacagacagaaactccaactggtttctcttcaaaagtccaaggaatctagtgagtactattgcaacacaagaagcacatgcagaaaagtggcgttttaaaaaagtacttctacatactcaacaaagatttctgagtgcttgctctgcatcaggcattatggatgaaaggggacagtctcaaccttcaaaatgtttgcagtgcagagaattgaagctttacacaaacagaattttaaacatgagataaatagtaaaatatgtgtgcacaaaaaacaaagagagagggctaccttgatctgccttggagaatcaaataatcttcaggaattaggatgtgttttgcaggtagagaacttgagggcttttttagacataagaagctgcatgtgcagagtcccaggaaaatgatagagtagtgtgtttttggaaaaattaaaatttgcagttgttagaatataaagtggaagtcaaatcttgaagaagagactgtcccgatggcgatagaatatgagggaaattttctagcaaggtagtagcatgattagatttccatgatagaaaaatcactaacatggaatggagggtggtttgaaagaaaggagcccactgagaatgcactagcagcagactctataggggataatgaaggcaggcctagcagcagatagtgatgggaagttattccaagaggtggctctagtgctcatgcagttcattcccctaaaacttctatgggaaaaaaatgcaggccccctcaaatgtaaaataagactcatgtagcctctaacataagactgaagacatctggggcatagtcacaatgttatttattctcataattggtaaaagtgtcatttgcattttagcaattatgttatagattgatgattaatcagctagaatgacaggtgaaaaattatgtagttcatattttactagtgatcagcattatttaaattttaggaaaaagatgttatacaatgtggagaataactcagtgcaggggtggagaataatgagaactactgtctgcttattgaataatactgttaaacaagtgatacgaaagatgatttttgtaattttttaaaactaaaataattagcaagctggagagttagctcagtgtctaattcatagtaagtgtctaaaatttttgttattaatgagaaataaaacaacaaaacttctaagtgtttttctttcttgggttgatttaaaaatatatatatgaaaacataatgatagtgacatattctctccccctgaaatctgtgggccatgtgcctaagcccattttttttccccgagtctacaccatttggttgcatctattgagtgtatctttgtatttgaatatgtgtccttgtgaatatatgcatgaaaattttaacacttagtcaaaaggtgcacacatagatatttttgtcttgccttaaatgcttaaagaccaaatggaaaatgaggcgtttctctcctataaaaacaccaattgaatttacactcgggaatgtattttagaatgacatcacaaaatgtaaaataaaatttaaaaatgagtacttttgaggaacaagaaatcccaagacagaaactgatgagaatcaattagtattgacacaatcctaaggcaaaacttctagctgtatgcccagaagtatcactctagggctaatattcattaagctgctgaagatatttattaaatttgcaaagttctggaaactgcaattataaaacaaataatgctgtaggctaaaatatgttggatcattttatgtagaaatatatgaaagattttaatgacatgatttactgctaaagttggaagtagcattccaaaaatagaaagtacttactttacaattatatgtaataggcaagataatccttaacatcaaagaaaaggaatattgtcttcctccttttcaaatgatgggccaatcttacctatgaggagaatgtgttggctacagtggacaacttaagattcagaagctagtcattctgcctccccttcccttaccccattaagactatgctctattctgtggcagctgcttttgccatttacgttaaaagcagatggagaaaacgcgaagaagtgtcagttttattgccatgtataatcagcatctgggctgtatgttacagacacaatcaatccaaagacatattttactgggtattataaaaactttttgtgtttctgaggcagtccccaaattacagatagtgctatattttaatcctgttgatcacagagattgcagccagttatgttgtttcagcttcaatgtgaatgatgtatgtgtgtatgtgtttattatacagttacggagttatctgcaaaactgtactgctaatttgtttaaaaacatgatttgggaccatatatatttatttcacactagaaatcaaatcatgtgtgagatttatatatacacatataattttatagtgtatgtgtgggggtgtgtgggtgacgttgcaatagtcccccctcttccacagttttgctctacatggtttccgttacccatggtcaacctcagtctgaaaatattaatgtattttgagagagaccacattcacataacatttattatagtatattgtaataattgttgtattttattattattgttaatctctttaaacttgatcacaggcatataggaaaaaaaagtgtatatagggttcagtacaatctgtggtttcagacattcagggggtcttggaatgcatcccctgtgggtaaggggagtctaccatatatgctgtagactttttattatttaatatattgtgctatatattctatttttgattgcatatacatatttttattacttcactatttttgtataagaaataaaataccatatttttttctacatctcatgtaatttttagaaaacatttatggtaagttctattctccccatttttcaggaagagaaactgagacacagcgaaagaaaatagcttttgtaaggtccagagagctaatcagctgcagatccagaatttagtccatgtctatataagtgcaaagctcatacttttaattgctaagtgacacaccttgaaaaattctatgtatgtctataaaatgtagaaatatctcttgaggagggctattgaagatttggcatgtggatgttattttatatagtttgtcaaaataacacgattttaaaacattgaaaataatgtctacgaattgaacgctagagagctgaaaatgtcatttaaagtgctaatactgtttaatatcttgtaaatgtctttagaactagttttttaattgcccagtcatacacactgcatgttgtgtagtctacttatgtaagatctgctcaccaaaaccattagtttattttatgtgttacagagcccatcagtccacaagtggcagaattagacttcattgagctaaaagatagctgcacataattaacatattctaagggtcttgtgttttaaagcagagggatatttcaccattttttattttctataatttttgaaatagacaccagaacgtgttatatattgttggtagttcattctttaagagctttaaagtcgtgaagacatgtataatgaggtagcagtaattagagagcaagagaaaaaaattgtagaagtggagacagaatgggaagaagttttttattggataaacatacttttgagttatttttattagtgcagttagaaaactgtcttcatcttctcatatactgagcatgtaactaaaatttccttctacatttgaaagagtagtaacagccattgctttggtttcatgtgtgtgtatatgtaaacacacaaacacatacagtgataaaatgttatgcaatcatttacataagttatgtggagaaaaaggtgttggctccttttacatggaaaagtctttcttgtagtatgtgatttacagtactttcttcccctaatcactttctaaatctatttttactttgaaactcaagatattgaattttctccgaaggactgacatttgaaaatctcttaattatggtggattttatccatggcatgcaaatatatcttagcgattatactatctatttttggaatcccagaatgtttttaattaggttctttatggaacaatggattcaaatttgcactctataaaattcagcagcttctatgctattaaagcacagattacaggacagcaatgctagaaaatgtaaattttatttgccctttctttttacctcaacctgaaaactttattatttcacttctttattttttataatctgatttaaatatgttttcctctttttgtaggacaaaggacatcatttgagatgtgtgttgggtttagtttatcaaatatattctaaaattcttacaatgaaaaggaaaacccctttattctaaagacccaaaagtttgcaataagtacacattagtttattgtttctccactaaataagagagaacagacattttataatatattaaaatttattgtttgacatctgtccatggtagaatattttcctgcttgagaatctgtccctctgaatgaaggatgcaattacgttttgccttaatgaactgctgagacagtgcaataaaaaccagttcgctgctgagtcagtgtgaataacaacataaactctgtttcaaatactttttttggaacaagattgaaaatagataaatgaataaaagtaaacaagtccatggtacatgtcattgtacagctttctgtggtacatgtaaatgcaatagtttgcaatgtgaagatcaggtccttggtacattgcaataacagatgattcatgcagcatgactcaagtgtgtctgaaatattgtttttgcatataaaaatataatgccattttatcatgactcttctttgttttataactttctgagtatgcagcattttcaaaaaacaaggccttatttattgtataatttgggtttttttggtgacaatcattgaaattagttgtagattaattacagaaattatcataacatatatttgagtgtcattagaaaaattagtgatcattacgagtattctagtttgagactttaaaataataaatgaattttaaattttccagggaaaatcttcagttatattaaattatagaattagtttggtcacatttgtgagttaaggttattgacatttcagaagtctctatgctgaatatagcatttaaaaatacttacattggagaaattcattttgaaatctaactgcaaaataagattatttatcaataaaactttcacaaatgtatgaacatctctgttttttgattatcattgaattccagttatacagcttaatattttgtacagagtagacattaaatatttatagggtgaatgaatgaattaatgattattggtttctttagattattttcaagaacctgaaataatatctatgaaaagtagtatatgaactagctttgcattactattaaaagaaatctactagtcactgagagctattaattttttctcatcatagcactacgttattgtgagcaaatctttaatacattgaaataatacttaattgaccaagacatgaagaatcttccagcgaatcaatattatttcatctatagctcgtattctctgtatttttattgattacattttaagcttaaaattttactataagaatgagtaaaggccaaaaagaattactcttaactgtcaatcaaaacattctaatcaataaagtaacaggcaaatgatttacatgtccttcactctatttagagcttttgaaaaaaaactccctttcttatgacctagataaataatacagaagacaaattcatatttccatcatacagtttatttactgtcttctggagtaaatccacctattaggagccaaaaacccagttagcagggatatgtgaaaacgaatagaatatagtggaataagaacagaggagttaagaggatgtccttgggtatgtaggaaaaggcacaacttattatacctaagaaaataaggaaaggatttaaaaggaggccatgctttcactgtcttaaaataactaagcattgttaatatcaatactagtataaaagtatcactaatatatacatgtccaataataagaaagaattaaggaaatagggtatttttcaacagtggaatattatgaaggcattaaaagtaatgtcttacaaaatgttaaatgatatagcaatacatgtatgatatgttattggatgtaaagacaatacacccaattctatttgtagtaatacctcaattacataaaatatgctcaaaattctatatgcagtaatacctcaattatataaaataaatatgcataaataaatatgcaagcaaaaaaacactaaagtaaaactccctgatctgagtagggcattatggatttagttcttttaatcatatttttactttttccaagtacagtgagcaccaaggagatagagtgtctcatcaaagggaaaaaagattgttagtaatatcaaatgttacagtgagttcaagagcaacgaaaactgaggaaacccattgaatggtgaaataaagaggtcagagaatgaaccctgatactgttgaagaaaaaccgtagcaccatgagaagggctttgaaatcagaaaagaccaaaattttggcaatttcatttaatgtcctagggataatttgttttgattttatttccattaaatgttacgcgtgtgtgtgtgcatgtgtgtgtgtgtgtatgcgttaaagtattaccaacgttcaataaaaatgaattaatgtatatgacacatatatggtcagtatgttgtcatgatatttattcatatttaaatatatacacatatgtatacatacatatatatataatatatatgcatatattttttcaaatccgggcgggaaagtggagctcatgccagttgagctttattttcctattgaaagtgaactctatttttctgttgaaaaacagagggatttaatgtagagaatagactgaacagttgaaggaaggtaacagggaaaaaactgctaccaacccagggctataaggacagaagaagctggtattttataaaattaggaggtggcaccaacagaaagtaaaattaggaaggagatgagaccactgctgtggacatcccctgagacagagaagggaagaaatatcctggcttcttctccccgccaacctttcaccaccctcccagtgtctgtcactggcaaatctcacagtagcctgttggcaaatgagcctgggatatatggttcactggagtcagctctttgggagacagagcagaacagaggagaaggggatgggaaatgatcataacgatgtttgtttggagtgaaaggaggctgagaagcaacatttttttgatagactaaaatatgtaccaaaagacttcatgcaatctacttatttgtgcgtttcataactaggtgggtaaaatcttgtctttctctgttagcaggaccatagaatagatgatatcagttattttcaactctgtgattttagtataccataaaaatacttcagttgtgctcaaatgcactttgctgcagtggtttttatgtgaaatattcacaaaatgaatccacagagtctagactgtcttactgaaaatatctgtagcatatatggatttataatttaacattttgcctcataagaagcttcaaaattaattttgtgagtataaaattattttttaaccgatcatatgctttccatagaggaaataaaaggcttataaaatttaatattcaacagtaatcttctttgtggaagagttatgattgtatctaaaatatgtaatagatctattcagtatttctacctatttctctaacttatattaagttaattaaaatgtactcctaagttagtttcttaaaggtattatttcttttgtacaaagtccagacttaaatattgatggatatgtagtacttaaaaatctgaatattttaattatgtttataattgcttagtttttaatcccaatttgcttcacatttagggacagaaaaattaaatttagtacttatttttcaggaaaaaaatatatcactcatgaagaacatcaactttacttcttgacatgaatcctgagcttgaattaaacatgtccgaaggttcacatttccatttaaaagttgaattttttttcattgcagacgtttggaacagaacacaatcaaagtcatccctcctggagctttctcaccatataaaaagcttagacgaatgtgagtgaacaatattctacaatatatgtaattttaaaaattatagaggtcatgagaccatgcaaagaaacttaagtatgagtatataagtgtttgacagcttaaatattaagtgatgtgactgtctgattactagctctgtaataatattttaatcttaatatctaaactatgtaatttttaaaggtctgtaatttagcatattgattcatacaaatgtgaatgtttatggtcaatatattttgcatatgaacatatgttcaggtgttctattgtcaaaaataagacatagcatcttatatgggaaagtagacaatggttattttaaaaagtatgatttcttttttaaatttctgatccttcagatgttcaatgttgcacgttttggacatgtcttgataagtacaaaaccaacatttaaaagccatacatagctttttccgcagtaaatctcactgacatttgattgaatgtaacctaaccctatttctaatcttagtgacctgagcaataatcagatctctgaacttgcaccagatgctttccaaggactacgctctctgaattcactgtaagtattcactgtgtcactgaaggaaaagagaagccacaacaaagagtggctaccttttttaaattggggtttaaaaaatgctctcaggtttttattatgaataatgaattattaataatgttaattattattaaccacttctgggtcccattatttttatggaggactgctacccatcactaaaattagccaatttttaggggtgtatattttatagtttgatcattttgctgttaggagagcaagagttagatcccctttttgaccatttttttatttctttttttttttttttttttgagacggagtcttgctctgtcgcccagactggagtgcagtggcgccatctcggctcactgcaagcttcacctcctgggttcatgccattctcctgcctcagcctcccggtagctgggactacaggcgcctgccaccacatccagctaattttttttttttttttatttttggtagagatggaatttcacaatgttagccaggatggtctggatctcctgacctcgtgatccgcccgtctcggcctcccaaagtgctgggattacaggcatgagccaccgtgcccggcccatttttttatttctaaaagaaaaagaaaatatttattttggaaagcatgtagctagtatctggagacaatatcagtctcctttgaaatgctaggcaaaatcttgctgagaacacttgaagatgaccactgagaggaaacctccactctttttcatcaccttaatactttcctaaaagaataagcttttaatctctcaaagaacaaagattttaaaatatgacagctttttaatgtcaagagaaccttcgaaagatagctatgtaaattaaagaagtttaaaaataaatgtatagcagctgttattaatattacttcacacttgtaaaaaaatcttcagaagtccaccaagtaacctttagatcagatttaaatattcgaaagtggaagtcggcacatttttattttttaagagccgaaactcagagaagggttcttattgatgtcaattcctgccaaaatatttcagatatcagaggtcaggggtagccaatgagaatgccaagatacacatgtgcgagacccagataaacccctggagtttgtggaacaacttgctggcactctttccaaggggagaactagatcggagtgctcatctgggcacatgagtgttccagttgctatgttagtctgtttaaaaacaaaaacaaaaacaaaaaacactacagttttctttaaaaaggaaaatggaaaactgttacttaaatggcagtatctgcttgggttcacttttgcttctttttgacttggagggttttgactagaagaagcacgagattaaaggaacaattgttggcagaaaatatagcgtgtagtcatgtattgctctcaggctgtactgtcaggttctaaagtaactaggttcagtgtaaaactcagatcacccagtcagattgtccataaagtactgttagcaccattctgaacagtaatactatccagagtaaacattgacaaactccctgtcatacagaaggacaaaaggcaaatcagcatgtcagttcctgattctccacaattttggtcctcaaagataaccattaaatgtcaagaagaagagaaatcagtgggaaattcttatttatatcggcttgcttgcagagtttgatattaagctcttcccttaataatgttaattgacacttctgtggttgtgagaattaaaagaaaatatataaagatatttacaagtaaattataaatagaacagtttattataatttgttacttctttcaataaattacattatgtttgttgataaacagggttcctgtaattaatgattataaattatgtaatctaataaacaataaaatagtgtgttgtcactccttttgctatttgctaacacatgtaaaataacatgcttgctacattgaaatctaaggcctcatgatgagagcactcacgcacacagttgttttagaaggccgtagaaaagctttatctttacttgcagataaagtaaactgcagttaagtcagggagttaagtcactggggtttttccagttcaaaatgtagcaacgtgtggaagatcacaaactgtttgccaaaagtggaatacctgcataatactgtaaaacagataaactggaaaagaatcaaataactgagttattttagagaaagcccacgtgttataacacgtatcattttcctggtcacgttcacagtttgagttcactttccaaagattaagttattttcccctccataaaatatataactacacacatttgcaatagctcttttcttcattgaaccacagttaatatgttcaaaagaaatgtattgggcccgattatgtactaggccctagtagagggtctagagatgcagagtgaccagaacacaaaaatccctgcctcatggaggagaccagtgataaactggcaaatgtatagtatacataaaatttacctatatttatagtattacatctatctgtagatgaaaatgctatgaataaaaattacagaacaagggataaggatagctgtggttggcggggggaagctaaaaccttaaataagatgatcaacaaagacctgaagatttgagctatgggagtgaactgtgtagataatgcagatatatagaggaaaggcattcaagacagagggaacggttaagtactaaggacgtttagcaggagtatgctagatgtttcaagaattagcaaaaaatatcactgctactggagagtagtgggtgcttgaaactgaaatgatgaagagaatgcaattgtaactacaggtctgagacactataattagggtgggagaggaaagccagtgaaagctagatttgcagagaagaattgtgctggagatcatgatagtgaccaggagttaaaatcttccagaagggagcagagtacttgggagtatgtagtttactacaaaaaccatgcaagtacaaggcaacacctctttttatttaaataaaaattttgcttacaagttttgcttacacctgatattttaataccatgtctttctagaactgtactcaagaatatagccagattaatataatcactacaattgctaaataaataaaactatttaaaggtgatatgatgccaagcacctctactgcattctacttaaaaaataaaaatttcagccaggcgtggtggctcatgcctgtaattccagcactttgggaggcctaggcaggcggatcacttgaagtcaggagttcaagactggcctggccaacatggtgaaaccccgtctctactgaaaatacaaaaattagtcagtcagacatggtggtgcatgcctgtaatcccagctactcggagagttgaggcacgagaatctcttgaacccgggagacgaatgttgtagtgagccaagattgcaccactgcactccagcctgggcaaccaagtgagtctctgtctcaaaaaaataaataaataaaaatttcaagttattagatcaccaaatttcatctcttagagataagtggacttgatttacctaatgttttttaaggcctctcctactaagaaatcctatacttttttttattaacattatcatttatttttattacgtattatataaaattataatgttatactaatatattgttacatagtataatatgcaatatattaacaaaacaaaaaacattcatgtcgttttcagggattttaaaatttctttcaatgtgacatcaacaagatttctataatatttagtaacaatttcttaagaattcagcatactagtatttttagcattgtctgtaaacagtttttattgttttctgcttattacttggaaacttccttctatagtaacaaaacgttttaagtgtagtatcattgtagcatactgctaagcatatgacctttaggacactaggtggctgtgttcaaatcctggctctagtacttactagttagaggctgagctagttactaaattccctgggtattagttcttccatctctaaaatgaggataaagttacttccctgctggctttgttacggagtaaacatcaagaaataatatgtatggccatggcaaattcatctcttgatagaaagcaatttgtatgtttctggatctcaattatcccagagaatctttctttatgccaaaggtcctcaatatatgatttttctcttttcccattcttttcattagccctttgtaaactattttaattcacttactctaatttccttatttccttaactagctcccaaattccacaggggtctacagtggaagactttaacactgtacttaaatttctggcaaccttttcctaaactgctgttaactctcctgcccagtatcttgcattttactataggttttcaatgaaaattaaaaggtagcacctctgttttgtcctctgctttatctttactgtactcttctaaaaatcactgaagagttataattttcaaatgtatacatttaaaaaaatttataagtataatttccttgacatttttttgaataataaagtatctgcccataacacctttttcatgatagtcatcttataggttgctgttttggacattttttttctcttcagtaggagttgtcttctgccagctttcttttttgagacggagtctcgcactgtcaccgaggctggagtacaatggcgcaatctcggctcactgcaacctccgcctcccagatgcaactgattctcctgcctcagcctctcatgtagctgggattacaggcgcctgctaccacactcggctaattttttgtatttttagtagagacagggtttcactgcgttggccaggctggtcttgaactcctgacctggtgatccggccgcctgggcctcccaaagtgctgggactacaggcgtgagccactgcgcctggcctctgccaactttcaataagagcacaagagctcaaacactggtcaccagctattgctgcctcttactgtcctaatgctgaaactcacaagggctaaattgtgtttaacgttcttggccttccttatagcagcaggtacaagagctaccttaaaatttccctattgttcaaaaagactagcaacaacaacaacaaaaaaatctctatcagagtatatgtatattgtacacatataatagtacgtatgtatatactatctatgtggtatgctgaacataagtcatgtataagaaactgtagaaaagatactcaattagtcattcttggtatttggatgatattatccacatccctcatgtattgattttcttttcagctgataccacttttttctttcagtttcttttaaaaatttcttttcctccaacagtgtaggacaaattctcactggccttctcttagtttatatctttatgtgatgatatttctttccctcatttttatagattttggccctatttcctgggctgtcatccaacttctctatcctggtctttggattttggtatattttaactaattttccttgctgtcattttgatctcattgctatgtaaaatactgtacccagccctagtcctgctaaacctttctggagaaatgtcattcccattacattgagtatttctttattatttttatggttgatactccatatagcaataattcctatacacatagatttcctgtatcctagtgtaatttcctccttttttgccgtttacccactttgtctcattaacaatagcatctgttactttttaacatggtcttaaagaaagcagtgatttattgaaaaaaataattacacaatataaatacgatgcatctcctagcttgttctcctttcatgctatttgggccaaccttcaaagcagaagtctcaagtgaacaacctactaaattgtccaccccttgatactcatgcaggtcctccacaatttatatacatctttgttcctttctaaattgcagtggattcacaatatcagactctttgactattcaaaattactcttttggattgccctttgaagccataccttctttatctcagtcatatcagtgcctgagacatgggcagatgatgggcattcaaaaatgacagactcaattgaattgagcaccaaccttagaatctggcaaagttacaggcacatagtaagtgcacaatctctattgttgaatgaatgaattgaaagatattgaattgaatatcccagactggtgccatcttaatctactcatttgtgtttcctaatgccctctcttctcttaatcttgacctcaaaatatatatttattcatgccttatcttttctaattccctttctaccttgttctggacaatatagaatcctctcttttgttctttgatttttaaaatggtttcttctctaattgatgtacttttctaaagaaatctatgttttctacaaacaaaatttcatgttctattttatagttatatcatggaatctaaagagacaaatggaatatctctttacactataatagcacccggctttatttattcctttgaggattttcttcacattttataatataccttacctctctctgacatcttgaaagaggaacagcttttctctcacgtattcatctctcttgtatagttattttcttccttttcaaaaagagattatatactgctgccaaacgtatcaattatttagattcacatttcagctttttctttatatgttatggcagccatttgtttatttcccaaaagaatatatctctgatctttgaaaatgatatatgcttattttagagatatattaaaatacacaaaaatatgtagatgtaagttcaaatcacctctggatggcaaatcatctgccatctaaatatgtttcccttttattttgtgcatatatgtgtgtgtatatatatatacacacacatatatatacatatacatatatatacatatacatatatttatatatatacatatacatacatatacatatatttatatatatacatatacatacatatacatatatttatatatatatacatatatatgtgtgtgtgtatatatatatatatatttttttttttttttgagacagagtctcgctctgtcgcccaagctggagtgcagtggcgcgatctcggctcattgcaagctccgcctccctggttcatgccattctcctgcctcagcctcccaagtagctgggactacaggtgcccaccaccatgcctggctaattttttgtatttttagtagagatggggtttcactgtgttagccaggatgatctcgatctcctgacctcgtgatccgccggcctcggcctcccaaagtgctgggattacaggcatgagccactgtgcccagcctatatgtatatatatatatatatatatatatatatatttttttttttttttttttttttttttttttttttgagacggagtctcgctctgtcgcccaggctggagtgcagtggcgcgatctcggctcactgcaagctccgcctcccgggttcacgccattctcctgcctcagcctcccgcgcagctgggactacaggcgcccgccaccacgcccggctaatttttttgtgttttttagtagagacggggtttcactgtgttagccaggatggtctcgatctcctgacctcgtgatccgcccgcctcggcctcccaaagtgctgggattacaggcgtgagccaccgcgcccggccatgtatatatttttaaaacaaaactaacataatactttaacatgcttcttttttacttaatgttgtatcttgaggacttttatgtcactgtatactcttctatacttgattctacacttagcattcttctttgtcatatatagtgtgctctcattacatatgaactgtgtatgcgtgtgagtagaaaaacaacttaaaaggaaacatttctatgaaacggcaatgcaagtggaaatgatatatacatatataaaatgttctttatttttctgttttccaaatgttctacagtaagcatatatctgatctgtaatcaggcaaaagacatttgcaaatggagtttgtttactcagctataacttttatgatgtattgattgcctactagcttcctgtatgcctgagtaaatatgtattagatgaatttgttatgcaggtttggtgtctaatttttttcatttaaaatatttttttcagtgtcctctatggaaataaaatcacagaactccccaaaagtttatttgaaggactgttttccttacagctcctgtaagtatttgattgttttggatctctcgagcctaataatatatattagccattttgttgtctcatatttttatggaggccttggaaaaatttgactcaaaatgatacagtttaacaaaatagaaaagagtagtccagtcaagctagtattcgtgattatttacttgaagacacaactttttggaatagtccccaaaccaattttatctacactatcatgaatgtatgcattctggcttctctatcatttaaagcttctacaatccctgtctttgtaaaacatctctgttttaatgtaaccagtagttggaaccgagaaaaatatggtgatcactttgggaggccgaggcaggtggatcacgaggtcaggagatccagaccatcctggctaacacggtgaaaccccatctctactaacaaacaaaaaattagccgggcgtggtggtggtgggcccctgtagtcccagctactcaggaggctgaggcaggagaatggcgtgaaccagggaggtggagcttgcaatgagcagagatcgcgccactgcactccagcccgggcgacagagtgagactccgtctcaaaaaaaaaaaaaaaaaaaaaaaaagatatggtgatatactcagcaacttttgtccagagaatctgcaggagcgacagtgctgcaataatttcctcaaacggatggtgtgcggtgagctgtaacacacaatagtcctcagactaaacctttagagagataattacctgtaaatcaaagaccactctgattagacaatagatactactcatttgtctcaaaagaagtatttaccatacatatttgcaaaaaggagatttaacaccatgtgttttaatgcatgcccatatgaaaagtaaagttggaaaaaaatgcaaatattaaaacttggtggttaatcatcaaattctattcatatcatcagaggacctcatttggggcacacactggcctatatgctttagatacaaagataattgtgttgtaatttttttcttagtaaatctcccttaaaatccttacgcatacaatgttattttccctctggagtgtatttatttcttggcatttatttggtaacgatttattcctaatcccacaatcttcatgtatatatataaatatattcctgaatttataaacttacgttcttaagtacatcctattatccatgtcttaaactttttcaccattatgcagaaatgtattttacattacaccttagcacacacacacccaaacaaatgaaacaaaatgttaatgaaacaataatgaaccttattatatgtagtgctctcttttctgttcatccccaccccaattctctctttattttctcagtgctacataacccagtaaatttattttacaatagaccaatgagtcatgagaaatactgattttgtaacttaatgactttatttgggtttcagatttttctaagctttccatttctgttattaaatattgctactaatttgataaaattatgctattcacagcctagatgtctgtacccattgtagatatagcttgatgctgtaaccaagtattgcctacttgtgactcacctctctgccattcttccacattcccctagacttactctccatgccagttattcacaatcactctatcactgccctatctactacaaatacgtgaagtgtcaccttctttttctttccatccacacttattggtagttgatgtaacacacatgctaataaaatatggagatctatatagataaaccttacttctaaagccatctttataaagtttcatttctacactaaggctcattcttaagcctgccagagggaaagaacggcatgattatctctttacagctagctgagaacttggtaaaattaagtgtcttagttttggttggtcagagattagagagaagaggcagggaaataaaagaaacaaaacagattgttgtttaatatttatttactgttccttgggccacactgagttaaagtgagtacaaactgcatagatgcaagatgatgcaaaacaacatctttcagtttcctcaggctccacacaatttcattgtccttgtttgctctctaactgcttcactcaattagattattaagtaaagaacaggtcagcattacttgagttgtggcccagggaggagaggtgtggggttaatcagcccctgtcacccaccatttcttgaaggcttttaagaaggtattacatataccggagggaagatgaagcttcagctcctgatggggaatcaaagagcacagccaattgagtcaccgtgagaaagtcatcactttgcatgttgctgatgtagcacctttaaaaaaaaatcaagtaaaatggaaataacccatgttaacatagagattgttttattgtcaaaggagaaaatattttttagtatgttagataatgaggcatacccaaaccacattacacatattttttgagctgttacaaatttgttaaaagttctaagtatcaaagcactgaactaaatatagctagatatagcttgatgctgtatccaagtattgcctacagtttctccctcttaaggcgggaatttaaaaaaatttctccattcctatggagaaaaatattctttctctccttatataataacacgcttcagaccatcaccaaagggaccttttcacctcttcgggccattcaaactatgtatgtataagtgatttggatcacagttgatgacattgtttccactctgaatgtaagagttgagtccattgcaactcatctataaaactgtcctgtatgtgtttccaaaggcattaggcccagcacccctttatttgtgactgccatctcaagtggccagtggattatctccataccaaccctattgagaccagtggtgcctgttagggatggagaaaaagaatattatttaaaaaaattgtccttcctgaagagggagaaactgtcattggacaaataagcaggtctgcataaaacagttgacaagactgcatagcatggaatgacattttgaggaacccagagggaggagtactctgttgggtgaaagttgagttcagaagatggttgaggaaagtagagagcagagtacatgctgaagaataaacctaagctcacacacagtcacatcaccgagaatgatgtttgccaaagtataatccataaactacagttccacagaatattgatataatacataggggaaaaaggagtttgtggggaattatgttaaaaagttaaacaggtatttataatataagactacagcctatactaatgtaccatgtgactctccaagagggttgtaaagtattcattcaacaactgatatttattgagctcccagtatgtgctgggcagtctgggaaaggaagggaaatgaaatagacatatggatgatttactgtgggggtagggaggcaggcatatagatgacagtcagcagtaacatagtaagttgtgtagcagaaaaaaaatgtatatattttagaaaatagaaatagatcaaagtaaaaggaattgagagtgctaggggttgggaaggggtcaaagacagcctgcatgtattaaggagaggggtgcgggaggctggattgagaaggcagtattagagcaggcttgacatctgggagatgaacatttcagacaaagaataggagagcctggtgtgtttaagaaaggcaaggagatcagtgattggagctcaaacagccaggaggagagaactgggaagattgcagagttctgaagagtgggctacaggtcaggctgttgtgacgacttaggtttctgctcagagccaattgggagctgtcgcatggttctgagaaaggggtgacatgatctattccatgtttagaaggatcacactagctactgttttgagaatagcctgaactacttttgcacagagtgtcctgagggattaatgatgtcttagagcatttttatggtgtccttgccagtggaggctgggtctcacccacctttgtgtactatcccacctttgtatcttccagaggaaatggttaataatgtgtattgaatacatgtataaataccactagatttaggttcatttgatcacatgacttttgttatgtggtaaaaccccacatctctagcctctaattcctaaattattaaagttaaaatgttagtgttgaggtgaaaagaaatatatttcttgactgggtttccttaaaaagcacaaaatcttgcaggtgagttaataagatgctacactttaattctacaactatttaatcaaacagattattgaatgccaacaagataaactgccttcgggtagatgcttttcaggatctccacaacttgaaccttctctccctatatgacaacaagcttcagaccatcgccaaggggaccttttcacctcttcgggccattcaaactatgtatgtataagtgatttggatcacttttgatgacattgtttcctctctgaatgtaagagctgagtccattgcaagtcatctataaaactgttctgtatgtgtttccaaaggcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtaatttcttcacgtgttatttcccctgtgaccaacaacaatggttacatgagacctaacaaaagcagctggccttcggctgattagtgaacactgtagaatcatatttctttttcttctgcccatgaataataaaataaagaggactgtagacccaattcaaataatacttctatatgtaacattttaacaccatatacagcagaagaaataggcaattgaccaagttaaaaagatgcctagatacttcatagtacctttccaaaattcaaacttaaccagagccttatagctaactcagaatacctttaaagtatgttaagtctcatgtttgttgaattgaccagcctcaagtaattaactgtgttttcatttcttcagaaagtgaattgagacttggttacatgatttgtttgggctcagaagtacaggggcgccaggagggactccagatcccttgcttcttactctgaatgcactttctcagtttgcattctcttattttgcatacaaccgtgaggatgcgttttttccaaaagctatttttaaaaatattgtgggaatattgcatttatttgtaaaaagctaaatatgaatgcattgtattgatattaaatgaaaggctgccatcattcaaatttactgtttgctttgatctaatattttccttttttatgatagaatattttatgtctttttggtactatgctacctaactattccaggcgtatttcacattcggcagttaatttcatactaaaaagctaatataagaaccaagctggttattgtccataattatagatgcatttactactcactgtacattattgtacttcagtcacagctgtgaatatacatttttcacttaattgcagtaactttagtccattcttaatctaatataactcatatctctgcttgctgacattcaggtgcatcttctattttttgtctctttttttatttagctaaagaacagtatttcattccaggtaggttttgctcggtagtaggactaactacagacaccctttcctcaccttataaaatatagcttctaaaactgatatgcatgcttctgaaagtacagtggatactctatagatagattgacttatgcatatatcacttgtagctgtttcctgaaatcctgacctttgcatgcagcttctgatgttaaacatatattattaaactccaccttttcttctctttcttttactttggcgcattatctaaaatttctcacagtagctaaaatgtttgaagctatggctttctacttaaatcattttctctccttacattgtatatctgatcttccaacctgtttttaaaatatagctaattgagctggttttaaagacagagatctttctgatgtcaaagagctagttctacatgaaatcagttacacacagaatttcattttcaatcatgaaaattacttttttatagattcttatatttaaaaactgtacttattgctttacttttgcttcactgtttatagaaaaacagcaactccctgctgaattatatgcagttgtttcttatttgtttatgactttacattcttctatatccagaattacaatataactccataaaaaagaatatttatgtgtgatgtgaaagcatcagaagttcatgggcacaaaatgccttgaataatttaggcagatggataaaatgtttctaagaaaagtaatcgcaatgttttaccacttcaatcgtaacactatcaagactgatgattctagaactagctctttaaaatacgtttctttacttatttttccttgcctgccaattgtgtaaaatgcctcttgacttgtttgttttaaaccattatgttaagtatcgattggccacattcaccgtctcttgggtatattctagactataaaaaattttaagagctatagattaaaagatatttctacagcgttagtgtacagagttagtctaactttccatattttcttaagaagaactctgggtttagtctctattttaaggagatatttgttagcttgccattattgaattacaatttgtataattttatggatttagtagatttggtgatatgacttattttgagcttgaatgatcaatagcattgtatattattatactggctgcataacaagtaacatgttgaaaagaacagttgattggccttcattgacaatgtttaatattaattactttacccaattaagtggaaagtaatctgatagctattatttaaccagaaaaagccatattctaaacaccagactacctatagaataaaacattaatatgatttaaatcctaaaattatggcagtaatgtaattggtatcaaattattcaaactatttcatttaaatatacttaattaataattggtaagtttaatatttccaattcactaaataaagaacaaaagtcaggttgttttcatatattctgatatagtttttccctgttactgacagcagccaaaataggatttggaaattatcttttatatcaaatatcatgtcttaagtttcaatttatgataatttaatttacattctttaaacatgataattgtagaagccaggactcaaaaggatcatttgggcttcctccccttttttccaaaaattttaattaaaatttgagtccacctaacaagccaccataaaataagcattattactgttccgttgaatgcagattatttgaattgcaagatatccagtgtacctgtcacttagactttgtgcactcttatttcattttggagtgaagcataaatcataagacaccagatcctcagtaaatatcatggcattaactgccaaatgtaatgaaacgattatatttaccatcgcaaacttcttatgagattctgattccatttccactaagacacattatttataagttgaaaagttcattaaaaagtgtacatcacaacataaggattaatccaaatgttgtaatgattgtccttgaggatctccatgattagtttttcattcacttttacgtgtgtacctcgctactaccattttatatggcactctacatattacagtgataaaagaaaatctgtcttgcagagagttcatctttttttttttggagatggagtctcgctgtctcccaggctggagtgcagtggcatgatctcggctcactgcaagttccgcctcccgagttcatgccattctcctgcctcagcctcaccgagtagctgggactacaggcgcccgcaaccatgcccagctaattttttgtatttttactggagatgggttttcacccgtcaggtgaaatggtcttgacttcctgaccttgtgatccgcccgccttggcctcccgaagtgctagtattacaggcgtgagccaccacacccggccttgagagttcatcttttaaaggaatcaagaacttaatttgcactatgcatcttttattacattggttttcttgtgagaccaccgtgcttcaaaatattatttataaaattttacaaagcatgacaattcccatcacatcatgctattttttcaataattcccataataaagaaagaaggaagagagcttagttttataaatatgtatattaatcttaattgggattactctttctttccttcttggtgatctttacttttgcaggaattcaccattttggctgtaagtaaaagtgtctgatctgaaacataataccctcccttttcaatcctgatgtaccttcttctagtcttggtctttggcacctttttttcaagaagaaaccacagatcttttgagcttctctgttgtccttgtagctcaccttcaacttcttcctggatgttgttcccgaaagctgttgtttccattctgcagttctgaggaatggtggaggcaccttttccatatagccccttctttgtgtttccaggaaatcatcggtagtaatactcttactgtggtcataaacattctgcgggaagaatgcatgtcatgtaaacagtattacgtttccagaacgtctgtagcttttctcctccttccctccattttcctcttggtcttacctttggcctagtggttggtgtagtgataatgtagcgagattttctgttgtgcttgatctaaccatgtggttgcgaggtatgagtaaaacatggttccgtcaagcaccatggaacgtcacgcagctttctacagcatgacaagctgctgaggcttaaatcaggattttcctgtctctttctacaaaatcaaaatgaaaaaagagggctttttaggcatctccgagattatgtgagagggagagaatagtaaaaagtccatagaaaatttaaaagcctgagtatatctatttgccttgaaagccctaatttacaatgagatataggatcatgtttattactggatatattttcaattcttgactccgagaaaaaaaataaactttttaataattaatatccattgtgtgactagctgtgaagtaggctagaatgactcagaattggatcagcagaaagtacagctgtgaaaagctcaactttattaatgttttcctgtcatgtgaatctggtcactcttttttccagaaaattccaagcctttcttttaacctttctcctgacatccattgaccaaaataccccaagttgtctccctgctacataatctatagttatcttacttttttcttcctacaaactaataaattttctaacctttagactcagtatcttttttttggtttgaattctcaataggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgtaagttcatcccccaacaaaattctggttgggatggagggaatgaaagcattaaagcataagaatgtttgtcttgccatttttattattaataattgcattaattttaattaatatgcattacattggcataactctattttgtacaagaatatattagaggctaccttcattcatctttctagccaaccatacgattaagtacagaaactaatttatctctcaaaattcagtaagcacttcatactaataacaatggtatttatttgatgcttatttattgggtattatttattcccaatttgttttctaagtacttagtttttaacgtatttaattcttatagcaactaaataaagtagtttgagagcctccattttcaatctctgtaaactatcaatagattcaaggagtctgtcttacctaatttactacttcattgacttacgggcagaaggattcagtggttatcaagtattaaagtagaaaggatagctttttctgaacaatgcaagaaaagctgaaaaggcagaatatgatggtatttacacttaacagccttaacataggaccttgcacatactaagtgctaaggtgtttgttggagcacttacagattctatgcccatgcatggtttgcctttactgactttatttataagaagaggacctttaatgttagtgttctaacaattcagggaaaaaactagcaaaacctcatcattctctaaacatcttagccatgtttatatatagcaccatctggtatttgtcatttactgctttgcaaagttcgttgtctgtttgtttgtatataatccttccatctttaactagattatagctccttgatgacagggattgtgtgttattgtttatctctcactgtgcctatactcatgcctgtacttaattaatttttagcaatttgaataactaaaaataaagtaatgcctttcaaagagttgacagaaacccactatcttgtagttatagtgatttttttttttttactcctattagttgatgaagctatttcacagctccaggaattttagaaatgcatggagtccatgcaaccaaggccctgaactttattttttatagacatatagggatttatgcttattacctataatactacaaacaagtgataccttccagcacaatagtactttttttttttttgagacagagtctcactatctcacccaggcaggagtgcagtggcacaatcacagctccctgtagccttggcctcctgggcgcaagggatcctcccacctcagtcccccacccccatctccccaagaagctgggacctcaggcatgcaccaccacacccagctaattttgtactttttgtagagatgggattttgccctgttgtccaggctggtcttgaactcctgagctcaagcaatcctcctgcctctgcctctcaaagtgccagggttacaggcatgagacactgcccctggcctagcactttaaataagtttgtttgtcatggaggaattatagtggaaactagcctccaatttagacttcagcaaatgtgtgtaatgtaagagatttataatttttttaattatataataaaatcagtactgagaataaaatatttgcaagtcatgtatctaataaggcacataattcagaatatatacagaactcttataatttagattaaaaggtattttactcagctaatgaatggttaaattattcatattgacctttctccaaagaacatatacaaatgtccaataaacacatgaaaaactgctcaatatcattagttattagggacattccaatcaaaaccacaatgagataccattttagacccactggaatggctaaaaaaaaaaaacaaaaacaaaaagggagagtaacatagtggaagaaattgaaaccctcatacattgctggtctgaatgtaaagcttctatggaaatcttttttgctatttctcaaagagttaatcacgatttaccatgtgatccagcaatgcccctcctatgtatatgtccaaaaaacgacaacatatatccaggcagaaacgtgcacaccatgttcatagcagcattatttatagccatcaaagaatggaagcaacacaaatgcctcctaactgataaatggataaacaaatgtgtcatgcctgtgtaatgaaatatcattcagtcttaaaaaataatgaagcactgccatatgctacaacaggaataagacattacacaaagcaaaagaagccagacagaaaaggctacatcttacatgattccgtttatgcaaaatgcccagactaggaaaattagtaaaagcaaaaagtaacctagtggttgccaaggactgtgggggaacagccaccaggagtgactggtagtaagtatggggtttcttttgggggtaatgaaaatgttctggaattagatagcaaagatggttccacaactgaattgtatgacttttaaagggtaaatgttctggcatgtggtttgcattctaataaagctgtaatttttgttccaattgtgaagcaaacgattagggaaaaaacagtctagaaatcctttttagtggggacgatagtggaaaaaattagagaaaatttgttctagagattactgagagctggttttgatctttgtgtttttttttttttactgtgtgcttcctaacattttattttgatgattaaaatttgaataaaatgagaaaaaatatcagtatgttccacaaatcttctgtgatttatgtatttccttttattttcctggtatcattaaataatgttagaattcattttgagaaatcaaatttaatcctttcctaactattggtaataaaacttctctattccttcttttttcttcaggcgtctcaataataatgaatttaccgtgttggaagccacaggaatctttaagaaacttcctcaattacgtaaaatgtaagtcacttgttagctattttttttatttctgtagcattttttgggtgttcatttcagttaagtttcttagaaaattagaaaatactaaaaatcctgggaaatttccctatgatgatgacctgtaacatgaatttagggtaatctctgcaagggacttttctgtgtgttcagcagtgtcaatcacattttctgtagcagagcctaagcatcttactttaactcagacagctggtctgttatgtggccacagcaggaatccagcaatctaagcacattaaaatgggttcagtaatgttttgtaacttcctttactattccccaaaccatgctgttattttttttttcatgtcaactattggacttttttgcttcattaaactttcattagaagatagtcaaaattaatgattggtaaactggcttgatagctcatctgtgttactacatgtccacaactcatattttaaaataagttcataagctcagcagtttcagcaacactcagtgggttactccatgcccctggggaggtgtgacggggagacaggacataggtcaatagcatgggaccaatggagcgccctcacacatgcagaaacatcagcatcagctcactttagctgtgtgtccatatatgtaactggcccatagtcacatagactgtaagttaccgaacagactacttgtacagatggcatccatattagcctacctcccaaatggtttctgatatcttaattgccctcctttttcactgttatgaaatgtactttctttttagccataagatgatttcccatgcaacaaatatttattaagaagctactgtgtgcaattctctcagagaaattaaaatatgcataaaaatgatccttgtttgggagacactcctggtcttggagtgatcagtgagaaagagaaagaaaaagcctataaacagttgacctcaactagatactcttgccttctggcaagcattgtagtagttggtatcatacgtagtactgacagttaatttggttgtttcaacacattattacatgagacattcttctgggaataaacccatattcaaatacattcctgatgctatatataaaacactaacacattttagcccatctatctccacctagttgccttcttttagtcattaacatttgacaattttaatcagggactttttttgaaaagtttcttgttaggttttatagatggcataaaggtttgtgtaacccaatacctgacctcaagaattttatactcctggagacccttggagagtatgacatgagtcacgctggcattttttaccacagacattccctgttagtattattgtccctttgtcttgatggtgtaaggaagtggaatcttttcagagccctggcagtgctgggcagtgaaaagttggaaaacttggatcattagaagaaaattatcaactatgtttcaattcccaccttgttagaaattatttaaaacctttgttccaacaatttttatttagaaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgtaagtatttgtacttgcattgcagttcttctaccaaaggattgcagctcattgttcattataatcctgggagagagaaacacctacttttacccaccccactccctctatctctttcacattctctgttacacacacatacacaccgctacacacacacacatgtattgtgaattcagatggtcccttaccccaatattcctgccttcgatgtgtgttacacacacacacacacacacacgtattgtgaatgcaaatggtcctttaccccaatattcctgccttcgatgtgttcatagcagatgatcaggagcgtcccccatggcttctgtctcttctacaaaatagatcatccttgttccagtgcttatatggatctgactaccctgtcctgcctcaaaatggtcattttatttctttgtcttcaaacacctctctatactatacttcttcttggcccaatgactgtaagctttagaatccccttgaatctctgcagtagaataattctaacagcttatctggagactactgttttttgcccctgcaaggtctcagtgtaaaagaaagacaggctggtgatacatcttccactgttttttcaaagaaaacatgctaagagttatgtctacttgctcaggggtagggtgtttgggggaaaaaattatatatgtttccaaagagttgttgtccaagaaatatggggattagattgaggtatttcaatcaaacatacttacaacacttttgtattacttgaatttttcatgtggcatacaaacacgcatatacacacatatacattgtatctaaaaagtatataattatgtttgacaaaagtggtagcctaaaaattggaagaaagacaaaccaaactctgaagcctttagaaggcagaaaggaaaatatttgtaaccaagaagcagtccttggtgattgtagtggggagtctgtctccctcaaacccacgatcctgccccgcacagcctgtgagagccatgtatgaccagtgggctgaaggctgagtccattgtctgctctttatcagatacggagggagaagggcattcccacagccagcaagatgtgtttatagcatcccaaattcaaatccccacccgcaaagccctccctgcacctaagagcagaagtgcattccttgagttttgcaggaatagcctgaaacctgaccacccagcaggaccagtctgggacctgctgacccatcccaagggctaacttggtgccctttcaaaatgataggcaaacattcactcagccttgtgatgaaagagatactgaggactgggcgcggtggctcatgcctgtaatcccagcactttgggaggccaaggtgggcagatcacgaggtcaggagttcaagaccagcctggccaatatgatgacatccggtctctactacaaatacaaaaattagccagtcatggtggtacatgcctgtagtcccagctactcgggaggctgaggcagaagaatcgcttgatcccgggaggcggagattgcagtgagccgagattgctccactacactccagcctgggtgacatagtgagattctgtctcataaaaaagaaaagaaaagaaagatactgaggaatgtgtaggaagaggatagaaaagagaccacaggcggctgcatctaaccttttccagagttgtctcaggtaaaatacaaatattataacaagcagaaggctcccttttcaaacagcagttaaaaggctttcttgatactggaaccttctcctggcagggaagtaccttggagtgggaggaaggcggtaggctgtaactccacctgtatgcatgtcttcaggcggccataatgagcttccacagactggattgcttacacaacagaaactgattttctcatcattctggaggctagaagttcaagatggaagtgctgacagggtgggtttctgatgaggcctcgcttctgggcttgtaaacagtcaccttctcactgtttcttcaaatgagttttcttctatctgctcatagggagagagaatgagctgcctggtatcattttcttcttgtaaggatggcagtccgtcaggatgggatccacacaatctcactcaacctcaatcacctccctaaagtccctctttccaaatatacgtatgttctgataaatgtgtcattaggcaacgttgccattgtgcgaacatcctagagtggacttacacaaacctagatgatatggcctaccacatacctaggctatatggcacagcctattgctcctgggctacaaacctgtgcagcatgttactgtactgaatactgtaggcaattgttactaacacaatgtaaagtatttgtgtatctaaacatactaaacagaaaagagcaataaaaaagatggtacaaaatatttaaaatacttcacctgtgtagggcacttaacaagaatggagcttgcagaactggaagtttctctgggtgagtgaatgagtgagtggtgagtgaacgtgagggcataagacattactgtacactaacataggctttataaacactgtacacggcctggcacggaggctcacacctgtaattccagcactttgggaggccaaggcgggtggattacttgaggtcaggagttccaggaccagcctggccaatatggtgaaaccccatctctactaaaaaatacaaaaattagccgggcatagtggcaggcacttgtaatcccagctacttgggaggctgagacagaagaattgcttgaacccgggaggcggaggttgcagtgagcagagatcgcaccattgccctccagcctgggtgacaagagtgaaactctgtcgcaaaaaaaaaaaaaaaaaaaaacaaaaaccactgtacaactgtacacttaggcttcactaaatttattttttaaatgtatttcttcagtaataaattaaggttagcttactgtgacttttttactttatgaactttttaatgttttaactttttttactcttttgtaataacacttagcttaaacacattgttcagctgtataaatttttttactcttatatttatataagaattttttattttctattattcttttctttattcttttctgttttttaaattgtttgatttacttacttttgcatttttaaactgttttgttaaaaactaagaaacaaacacatacattagcctaggcctgcccagtgtcaggataatcaatatatcaatattactgtcatctccctccacaccttgtcccagtggaaggtcttcaggggcaataacatgcaaggagctatcatctcctaggatagcaataccttcttctggaatacctccggaaggacctgcctgaggctgttttatagttaactttttgttaataagtagaagtacactctaaaataacaatagtatagtaaatacataaaccaataatatagttgtttattgtcattatggagtattatgtgctgtacataagtgtttgctatacttttatacaactggcagcacggtaggtttatttacaccagtatcaccacaaacatgagtagtgtgttgggctatggcattatgatggccatgacatctcgaggcaataggaaattttcagcttccttgcaatcttattggacaacttttgtatagctctgcttgaccaaaatattgttctatggtgcatgactgtacagtcacatttgggggttagggcttcaaaatacgaatttgagggggacacagttgaacccgaaacaccacctcaaggaacttatatcaaagtatttcttcttgttttgtttttcattcacaggactctccctgtgaaaagttatctaaattccactttctcctttcattgtatttctgtggatgtttttgaagtgcttacattttagcacctgagacagatattcacggactccctccttaatctagttaggtttcaacaagcgtcatagagcattttagaaccaaactcagggtagttaatcctagaatagttttatctgaacatacctattcttggtgtcttttgtcttggagctatgaagattttgagagcacatttccattccccctaggcttcttaaccctaataggccacttactaattcatatacatatttcagccagtcattgaattccttgacattgcaggtgaaatttgtgcatatgtgtgcttatggatttttctagcaacagagatcaaacttttctcttttttaaaatttttatctatttatttatttatttgagacggagtctcgctctgtcgcccaggctggagtgctgtgatgctatctcagctcactgcaagctccacctcccgggttcacgccagtctcctgcctcagcctcctgagtagctgggactacaggtgcccgccaccacgctaggctaatttttttgtatttttagtagagaccaggtttcactgtgttagccaggatggtcttgatctcctgacctcgtgatccgcccgcctcggcctcccaaagtcctgggattacaggcatgagccactggacctggcgctcaaacttgtcttcaacttcccccaggggcatgtgactccagcaagattaagacccagtgctcttcatcatttatgacaaaggaaagcactgataggaatgcttttctgtagtgcatttgttttctaacataaaacgatcccttcataaggagagcatcatcttatctgtgacttcgcagaatgcaaacgtttatatttcttatttattatagggcaacctagaattttaaagtgacactttgtttctttatttttacctctctttttcacattcttcaatattttagtagccaacttatgtttagaaaaattaaggaataatttaatttttcaggaattctgaatacgatttatggcaactattcatatactcataactattttcacatgggactttgagctttttgttcagtttttaagccagacaaataaataattagcaaagaattgataattgagccaaaactttagcagtaacaaggaaatgacaatagtgttaatcctataatgacaatgactaaaaaaaaaaaaaaaaaggtattttttcatggtaaaccttttaaaactttattgtggatatgggatctgttaccgttgcctctttttaagttctcaatttaaaacaatgagctaattttcataaataaaattattcgtgtagtctttgtggatattctgtccattttggcgcccctggaccatgtttgacattgactcagtgtgtaagtccctgagatgccctcagttcttcatctgcagtggctattgattcttttctgcctcccttctgttcaacctcaaatgtaatactaccctgaatacacaaatcacagggctccgaggactcagagagctgtaggtgaattaggacattatgcaatcacgcaaacataattgtagcatcaaaggaaaacattcttccctcatcatgggattataaatccatgcctagactcaccgtgccttttgtaactgagattaatcattggcaactcaaagcattttattcttgcaagatattcccagtatatattcatagcaatatctaatagcaagagaacatttttaaaaagtagtaatgaatgctacatatttgcaaggatcatttcgatcctcagataggcaaaattgattgcctgatgctttgtctccataacaatgtcctttttttcccctcaggatgttgagaagcaatcgaataacctgtgtggggaatgacagtttcataggactcagttctgtgcgtttgctttctttgtatgataatcaaattactacagttgcaccaggggcatttgatactctccattctttatctactctgtaagtatgaaaaatagcccttatgtattacttgagccatttattatatttgttaatgtatttaatatattattaagcatttcattaaaatgtgatcaagggttttaggacttaaaaaaggacaaacttgttcacatcaaatttatttaaattttttaaaaaatattacctactatcttagattaaattttaacaaaaaattatagtattgttcagtgaattatttttcatagtgatatgatcaataatgtagcttaattccaaattttagaattattataacttgatagtgctgcatataaaagaaatgttatagatttttgccagtgttctcacattggagtattttcagtataagtattataaaaggagaattgatagagttattgccaacaaacttgctcaaaaggatcagctgggcacagtggctcacgtctgtaattccagcactttgggaggttgaggcgggcggattacttgatcaaggtcaggcgttcgagaccagcctggccaacatggcgaatccctgtgtttactaaaaatacaaaaaaaaattaaccaggcatggtgacaggtgcctgtagtcccagctactcgggagggtgaggcaggagaattgcttgaactggggaggcggaggtggcagtgatccaagatcgcatcactgcactccagcctgtatgacagagcgagactccatctcaaggaaaaaaaaaaaaagaatcatttgaaatgacagtagatatattaggatgaccagatcaaaaataaaagctgtttactagagggggtctactatgatattagcaaaatattgaagaaataggttgagctgatccaagagaatattttttgtagacagcttaaaaataaagagtatttgtaggcctatagacagaattcaagaaaagtaaataaataaataaataaaatttaaaagtaaaaaaagccacacacctccaaacaatgtatttcaggtctcttatatgtcagtatctaaaaagcagcatttgaaattattaattatctaactgataagatttctcagtaacggtggcatgcaaatctactaatctaacttaaaaggaggggaataaagatagagaaaaaagttcatagctcaagtcagtgaagaaataatttgagagaagcatccatccatcaggaaagtacttaatcctctttttgcataaaatgtgacattttacatcgagtggctaatttgcacatattaaagatggcatgtttataaataatgagattgtcaataggtttatgctgaagtggtgagatgccagaagtattgaaatttgtagaagtaaattcatttttataactggcatttaatcaactcagctgtcagtttagatgggaaacctattctctagagcaaataagagatggaaatcttgagatgacaaattaatgaattagctgttgtcaggttaaactcaataatataaggtaatcagccttcatctttatattaaattactgcattatcagtgcgaagtttgacagcaagtcagatttctgacaagtttaaattatttctaaatgaaatatctatcaggatccactgtataaaccccaaattctaccttaccttattttttgcatgaaatcatgtgaagaattaccttatgtaaaagtgttgttactgcttaagttccaagcataaatattttatcaaaaaaaaaatgcatctcatatactgcatgtgattctgagtaagaatggggacagggaatgcaaagaagaaggaatcattccagcggaaatagcgtggagaagggtagctggggtttagagaaggaagaagatgaaaccccaggctaaactgtgcatcgtttgcctgtggctcttagaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggtaagaaatacttatcaactctttgattgtcaggcattcacatgcctgttctgatgcagctttgcacaaatctacagcatagttcagctcagcaaataatgatcgtgtatcttttgctttgtcgtttgggttttgttttagtgccaggacacttactttcttagacttgccttccacatttgagtctacttgatgtgcatttctgaatgttttagattttctagtttccaacttgtggttggtcttacttatatagcttcattttaacttttctttattaccctaggcatgttttttagtacctaccattttcaaaggagaaaagaaattaacttacagaagttttagtaaatctgacaaaaatactagttgtcactttttaatgctctttctatatcatcacatttgattctcatatagccctatcaggtacatagaacaagttctattattattgccaatgaacagagagctaatttgagctttataaatgaggaacctaaacttttaagttaatatattcccttatgtctcttcatatctgtttccgtgccgtttctctgtaattcactttgcatttacatattgtaattaaaaatataatttgtacaaataactattttccattgtattggtaattgtaattacagtttacaaattgcaagccattttccagaattcttccctaggcagtctgaaaacagtgctatatagaacttacggtatcaattagtaaatactgaatgtcccgcaaataaatgattatgtagcttaagactcttgtgtttgttaagttaatttaaaggcataaaatcccttctagcaccttcaagaccacaaatcttggttttcctgtatttcctctgcgatttaggaaatgatgacaatagttgctccccactttctcgctgtcctactgaatgtacttgcttggatacagtcgtccgatgtagcaacaagggtttgaaggtcttgccgaaaggtattccaagagatgtcacagagttgtaagtagagcttgtctttcttttcttttctttttccttgatgataaatgtttcatacacccagaggaatggacaaaaatctttacaatcttctttacaaatcatattctaaggccagttaattattatcctgtaaaatggtaaataagtaatgcaaaagctactttagaggcccttgggaattgctgtgtgtgtgtgtgtgtgtgtgtgtgtgtgtgtgtgtgtgtgtgtgtgtgcgctataagatttctcagtgcctttactatgctaaagtgtactatgactcttcaagaaacaatggtaaaatataaggtatctttcacatttatttgttcctataccccttttctcatggagcatcttacaagactaatggcccatggaatgcactttgggaaatgctttatatttcatttacttacagtctaggatattctgtacaggaaacttttttttttacctctgtgacccctaggagaaaattttaccacatgggataaataactatctggtatatggaagaaactagcataatctcttcccttaagaagagatgctgcttttggaggcttgaatcaaagtcctttagatcctaaagggtatgggaccaattatccttgacattttcataactgatatttaaccacaaattatatggccaggatatacacatctcgaccttcttctgcactgcccacgctcccttggctgcctcatgctacagttgcagaatggaattcattagagaatatgctgccagaataatgatgcttccatgccccattcattccattcctttgtctctaaactgtcatattctggatatgcttgttctgaatacaattgagtcactttgcctgtttattttttatctatgtggaactatggatcaataatgatttaaacccaaatgtaatttatgcagatgtgtatcagttatttgtgcagatgcacacacatattccaaatgagcaggtttgacaaacttttgacagtgtgcaacataggtaatgaggttcaagggcatgtcatttcaatttttaaggatcttattttcaaatcacatgcaattctttaaaccctaagtttgatcctgaatagaacacttagaggaaaaaggcacaaacttagcacatgtgcttagaacacggctcttagatttgaactgctgttaagtgcttaggtcctctctcactaccaatcacattggttaatcaactggaaggactattttatatgtatatgtgtgtaattaaatatttaattcttatagtaatgttttttatttcagaagatcacatagggatattccgaaaccctcctctgtgggaaagctagatgcctatagaatattctgtgtccacaggatggggaacatcacacaccggggcctgtcttggtgtggggggatgggggagggatagcattaggagaaatacctaatgtaaatggcaagttagtgggtgcagcaaaccagcatggcacatgtatacatacgtaacaaacctgcatgttgtgcacatgtaccctagaatttaaagtatagtaaaaaaataaaatataaagcagagatagttaaaataaaaaataaaaaaagaatattctgtgtccaaagcattaattttaggagtacaccaatgaagaacttacactcagaccacctttgatgctaaatcccttcttctacaattttaactggactatgtattggtcactttactctattcccattaaataactttaaacatttcttactaagctccattggacatcctgcttggtgcataccctgtgctatctacagcatatttcaactattcaaaaagttgaattttcaatctattttactacaaattattaaaaagtagtctttttttccaaagaaagtttgtcatagagatgagaaaaatattagcttatctgttttgaattcaagttttaccccctggagagcttattcttgtaaccttaccaagtcagcagaatccttcttagcagtaacatatatgcatgtattagaagaatttcatatgtgtattacattaaataattaaagactttggcaaaaattagtattattggtggactagttttaacaaatggtatccattatttttaatcagttccatataacttccgccttagattattttacatataaacattcatagcgcacattctgaatcttgaccttctgctgtgttttctggaataaagggagagtgctgaactatatagggtgatgcttccctctagtggtatcaagaaaaacttaggtagaggaaagaaaaaaatggagaggggtcgaagaagaaatatcaagtcagaaaatttaggtagacatgatgagtcataacatagacccaattatttatcaaacattaattatattttctgataactggtgccttttatatcattgtttttattttgaaatattgggaataaattatcatcttagacaacttctcagctatttctatatccagaaaaaataccaacttcaacctggaatcttgaaatggaccacaacattggggtaggaacggccacatgtttaatgtcccagaagtgtctgtgggcacatgtatagccagatggccccagtttctgaatgacatttgcacccttcaccatctacgttctaggaaaaacagccttggaaggagatgaaatttattttccttattgtgacataatagatataacttcaggcattcgattatctctctgtcctgccagttagcccaaaacctattttctgattattcttctgactctaataagaagggaaagtttacttatatatggttatttgattattgctgttacatatatatatatatatatatttatacacttcatcaatttatattctataaaatctcctaatgttatcatcaccaagaagatatatgctggttacaactatttttaaacttaaacctaatatgttcaaatccgcaaatatgcctttaatgtgtccattgttattcactaagtgtattgacacatattaaggcagcaatgagtggtcttggccacagcagcaaggttttgttactagttaatgaatttcatggtattgtgtccacataaacacaagcaaactgaaggctgactaaaagtacggttaattgaatgaatctccttgcttgcacacagatggctaaatgctgggcttgccttgttagataaaccacaaagaactggactcgtggacaactctgctttttttttttctttacttctcttaaataataatccatgcttggaacacgacatcttaaagcaaaaattgccaaggggttccttgcctcagttaagagtgaagtactgtttacttattttattcaaggccaccattactttgtaagaagataatattgttccattgtttttaggtatctggatggaaaccaatttacactggttcccaaggaactctccaactacaaacatttaacacttatgtgagtaacatattgcacttttctttgacttactctatttccagaaaatggggatggcaagggacagaagatttagtgaaccttccagataatacaaatcattcacagttagatgcttccctccttgctcattgcggttctggacccctggctacatcttcattgaatatcgatcaggcgatggagtgtcttagcaagaggtcctcctctattcaaaaaagcacaaatacaacgaagtctgagtagtcagagaattatgaaaatgtataaacctgcagatttttattgataatgaatatgggttattttatgacaaactaaggaaggaaagatagaaaacgatgcctttattcttgactttaagcgaaagatggtaggtggtaatgactttcccaaaaatgtaaatgtagtttattatgtttgtttcttatacaaagcattgttaaataagttatgggtttccagtattaaaatgtattttagaaaatccatatatattcatgtagtgtttaagtaaacttgacaaagatactaacattttgagtataaatttcaaaattttgattttttagcttaaaataacatctctttttttattaatgtaaacaacctttgacaacccttaagttgtaaatacaagaagatatttaaatatacaaacatttgatctagttacatgcacaatgtttaaaaattgatataatcttttacatataatactatacttttaaagtagccttattggtaattgagaaaacttttcagaacacaaaaaatcaggaaaaagatagtagatattaatagaaagtaccgtatcatttgtttaagtctatctaattttagagtaaatattactagcgtaagaagcagattactggttaacgaattagaaggtttatttctaagtgaattctacaaacctaagtagcaaaaaatattacatgccccaatgtaaactaggtacattgaagctagttaaaattgctgctgatcactttccttgaaagtatgggtaaatcaaacactttatagaaagtaaataggagtatttaaatgacaaatgattaaacaatggaaaaagatatcctctaagatgtcttgttctgcttctagttatttatttgatagcagcaagaactgattacatacattttgttctgttaaataaaccattaaattgctgcaatttccaaagggtcactttagcagaattgggtcatttgtgggacagcatgtgattactttcaagccagctcgaaatgacaaatgaggatttgtggatccaaaaatggttttactagtgactcatgatacaactctaggcaagttacttctgctaatacagatacttttatttttaaaatttaggaatagttcttcagcagttaaaaatatgagtataaagctcctctcagattcttaacattttcacaatttcatgggtccattttactgacattttgatattttaataaaggaatagattatcctcggtttttctgaatcttccatttattcatatattttgcattttgcttcagaaaaaaattagtgaatatatttagttattataaatggtgaatatatattagtattacatattgtatatatattttaatatattttttacatatatagtgtgtgtatatatacactatatatataatgagaataagatcaagttcatgaaatgtaaattacgacccatagtacaaactatacatataagtagccatttaacattggtaaaaattcaacgtctctcccatttacttaacattcattaaacaaatatttattgaggacctactgtgtgaccatgactcagccaggggcaggagcacagacgtttttattgatgacattttgaatgtaattaatcaggggttctttcagtgatcaaatttgagtctgtgtatcagtgaacatatgtatcaatgagggtaaagtatgtgtatctgataggacttttgaagataagggtttatttcccaccggcaaaattttgtctatcgcaagtcacctccaaggaagctccctgtaaaatatcaaaagccttatggagatgggcgcagagggataagggcaaataaactctgctctgaagctgctgctttgaagtgaaccaaccccttgcacgtacactacattggctaaagcaatgcatatatatataatcactcctaatttcaaaacagtgaggtgtaaataatcatgaataacattgcaatctactccagtgggtcgttcactgttttattgttttcagataacagctgaatgctaacaatactgctatgactataagaagacccttctccttctaagaatcactaatattttcatttctgtggttaatagtgtactccatttctttttctcttttagagacttaagtaacaacagaataagcacgctttctaatcagagcttcagcaacatgacccagctcctcaccttgtgagtgtgaaagtgtggtactgagtattcattaattcaatggacaaaaggcagtctctagatgctggacattgctattgaacaagacagtctctaccctcaaggaatgtttctattgggagaaacagacaaaaccacgatacgtgaacaatgtagacattaggaaaagtattgcgttctattaaaaaaaacaaagaataatttgtgtttgtggggggcttaggggagatccctaagatagggaaaatccaccttagggaagggacggctgacgcaccaaagttgggcaggagtaggcagcgggaagcattctaggttgtatttaggaaataagtatgttgtgttagggagacaacacacaaaaaataacaatatattgtgtgttaacactatcagttaataagatgctttaataagccttaactgctttatttttggaagtatttggccatttttggatttctgaataaaacaaattgacatatgtatgctttcagaattcttagttacaaccgtctgagatgtattcctcctcgcacctttgatggattaaagtctcttcgattactgtaagcatcttgtgttcaacagaatatctcttttctcagagatctgagtttggggttgtctttttaaggatgtaactgctttgttgattcttggtgcttgaagatacatgcattaggatttattataaattaggaaatagaaaaatcatttcttacagtatcattgtccaacagctttgctttggacaatataacttcctttttagtaatactgattgttgttatagtcatttatttgattatatgtaacattaagacatatggtttatagagtttcaattaactttgaaagaaactttcaaaattgagaaactttcaaaattaatttctttagaaattacatagtatatgaaaacatttttactgtgaaatgtcctttaaaatatgtgaaataaaacatgatccttgatcctactctcctgcctcagaatttacagtttgatgtgctctctggtcctttttcagatgcatttttttctattctaatagatgtaggcccatggctatatagcttttaaaagccacagatattaataggatctgtttttgttctgccattgtctatttttgtttaacatatgcttttgaatatttcaagtctatcatatatatgaataaaaatatatatataagaatggaatagatatatatttatacatatatataactcaactgtttaactggtagagactgttgtattggtgggaggaaccagaactgattcaatcatcttcatctttactgtgatttggtttaatttcaaattttaatgagtactatacagtactctaatgaacatcctatacattcctcttggtgcaaatgtgctggcatttcagcaagaatttagggtgtgtgggaaggtactgtcaagtatattggaaggattccaaaagtaactgtcttgttattccccagacaagactttgtccatttagaagttaatttttccaccaactatttaagagtacctttttcaaaacactcttgcaaacactgaatattatttattcttttatttttgtccatatgacagattcaaagttattctgcgttcctgtcttaatttgcacttccaattagtagagcatttgaatatattttatttgtttactaagcactcgtgctttttattctaatgagcttgatctatcatttccccattttctgttgggtactttatattttccttattaatgtagatatctttatgcatatactactttactctatgcttgcaggggttttttttaaatgaaagaattaatccttatatcttatataagttgcaaatatatattattctatttcttatatggaatattttattgtttggatatattttatgttgtcaaaaatttctccctcttttccttgatggtttctggatgttataactgagcctgtgaaagccttcctcactccacatttataaaaggaagatcttctttattttcttttaatacatttttatttttacatttaattcttcattctggaatttattttgtacacataatgtgaggtggaagccatttgctttctcaggtatccagttgtaccaaaactgtttattttatagaccgtcttttctgcactcatttaaaatgcttattataaactaaagtctcggaatttctctggagtctatgagttcagaaatataggaagtttaatttttctttttctttcttttagttctctacatggaaatgacatttctgttgtgcctgaaggtgctttcaatgatctttctgcattatcacatctgtgagtacctagtttatgaatataggtttagggtcaaacacttcctaatgagtgacttggaacattcctctgccagttattttactgtaacatcataagatgtaattggtttcatctttaaagaaaatgtgaagattttcaaactggatatgatgccttctgcaagatggctttaattttcccttctggctcttattttccagtagtcgaattatctttgcttagctaaacatgtctcttctacaaatatggctctccaactttactagcctatgctttttctctcattattatctgattctagaacatcagctcccttttaattatctatcctaaccctgcttttctaagtcacatctcaagtatcaccttctctatgaagcctctcctgatttgctcaaagtggatttacttattcagcatcaactgtggcaccacacaaaaataaattcaacatggttcgagactatagtttggaagtaagacacagccaaatacttagattgggtgaaatggcttttcctttatgttttctctgatcacaacttgtttgtacctccatagtttttggaagtacagtataaccatttgaaaatatgtgataagtgtggtccaaaaaactcatttgggtcaaattccatgattttattattactaggtgtaatgttaagatcatggcaaacctagaaggaagttcagccagcagccttaggatccaaagcctccttggctgatgctgagttgggtgcttggtggcaactatctatttaactatgcctaaacagcaatgtcagttgtgccccagtttcctagaagagattgcctgccatatcctctcctggttttgcacttctctcgaaaacccacaaactccaagaagatacgattttacaaaattgagaaaggaataatcatttttcactccaaaaatatacatatgattggaattttaaaatttgccacccaaaagtctacgcttttacatcttctttgaattgaattgaagatccaatgttcaatcacattatgtctgcatttgccttatagagtctgtgttatcaattgatgttttgtacatcagtctatcagactggtgcctattaatattccttccactaaactactaggtccaggaaggcagagcctttacattttcgtgtttgagccaagaacctacctctaagtcactcctttacaaactccatggctgccacgtgcatgagctgcaatatgaaggaagctactagctcagagatgcagggctgtggtgccctcaggcagagaatgcaggctgaatgaggaggtagccgttctgctagtgttatggtcaggcatcagaaaaggcttcacaggaaaggtgctgcttgagctgagcggaacttcccttcatgttaccagcctcctcccgcaacagtgagagcaagtagagtcttccttgttctgtgccctgctctgccttgcatttctttttttttttttctttatatatataaagaaattttatattttatattttattatactttaagttctagtgtacatgtgcacaacgtgcaggtttgtttgtgccttgtcttttaccccctagatcataaagagctctgctttttcacttttcccacttcctcccctgtcacatcaaggacttaaatgttgatagagatgagatcaaatgactaaaaaacatcattttgctcatttttaatttggaagggtttgaatctgacatacatatgcaggtaacattcactacattctgattcttaaacggggcattaaaacttccacagtatcgagtattatgattctacacatatatttcaggggctacctaaaaaaaataagataactatcctgacggtagacctagtaggattactagttagaagctaattgtaaatcagaagtaagcagtttttaaatgccattgtatgcatctacggcttcaatccaacctttataaggttatgagtccaggtctcagtttcttaatctgtaaagtcaattattaattaaatggaccttataaagttactatttaggataaaatgaagtaattcttataaatggcttatcccagctcctgcatatagtaatagtgcaataaatgttagctattaccttgattactttcctgtcactacttctaatgaacaaccgtaaaatgaacgatcttgaaaagtgacagacagcacccagtgcaggtccagctcagctctggtgagctagctctagacatcttcagtattttatgttctttctttgtacttacctgtcctttatctgtatcattattcccaacctttctttctacttaactctaactatcctacacagcttagactttcttaaccaccagcctcccagaaaagttaatctgtttgttcaccatcatcttgtaaatacttctcctacatcacttctaatgaaacttctttgcatctgtgagtatatcccaatgctaatgctaatctcctctgcagcaggggttctttggaggtaagaataatgcattatttatatttgggtcctcagaaccttgcattgtgacttaagtcatcagtaaataattggtgaatgaaatagtaatgcactcggtgtgtttacactcaatataaacacgtctctgaaaatattaggagaccttctaaagcaacatgagtgttgacaccagtgacaactcactaaatcccagtgcacatcattcaggaaaatggggaatccccagtgtctctatttttttgctaaattgttatcctcaataaatctatggggattttctgctgagcatcactttgaattcttttgcccttaggaaataacaatacttccatacttgtgtgtgtgtgtgtgtgtgtatgtgtgtgtgtgtatgtgtgtgtgcttctgtggtgttgtttttccagagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtatggtttttaatcatttgtatttcttttaagaattactatattaagtaaaaaagaaaaagacaaccaattgtcaatccaaaggtatggttgaaatgcccagtaaatgattattttttcagcccatgcttggacaagacagagcagttacctgaggtgcccaagtaaagaattaggcttttcaaataaatctcagaaatagtccattggtaatgaccaagttttcttgaaagtgtatcaaaaaacgtagagttcacaatttctggaaattcctttcatagcctctaacaagtcaaatgttttgcttttgccctgtctgaacatgtgccctgctcctagggctgccagggccctgtggcttcctcataccaggtaaggagaaacaggccctccccagtgttcagcccaaaccttctgactcgccttatgtgctgcagccttcctgtgttgatgttcttgtttcttgcttgtttgtatccctttcttttccctttgtttgatgtatttgtgaatctaaatattgtcagaataacaaatattattttcctttttattacaagaataatacatgcccctaaatagaaaaatatgaataataagaaacaatttattttctgcaagaagaaataaaattaaccattagtcagcatacctggagataacgactactaaagttattgtgtaaatatttccactgatggtagtcaactatatggatttaggttccttataaaaagtgggataaagtttactattattcttagattgtggggttttgggggggcttttgttttgttttttttttgtttgtttgagacagagtttccctctgtagcccaggctggagtgcagtggcacgatctcagctcactgcaacctccacctcccgggtcccggctcaagcaattctcctgcctcagcctcccgagtagctgggattacaggcatgtgccaacatacccagctaatttttgtatttttagtagagacggggtttcaccatgttggccaggctggtcttgaactcctgacctcatgatccacacccccttggcctcccaaagtgctgggattacaggtgtgagccaccacgcctggccagattgtgtgtattttaagaaggtcactcatcattattagatggaggagagaaattcttgaaaatgttaaatgtctaatcagaaaatattgattaagcatgttttatgtgcaaaactcaatcctaggtgttatggagcatagagaacttcatggtatggccttgccttccatgatttgaaaacctaactaaaaagataagctttcaacatttgaatatttatggaggaaaaacgtacttaagtaggtaatgctgtgcggtgggttgcagtgtgagctctgaagcccagcctggctggagccaaattccagcttcactttttggtaagagttaactgtagtttaattactttactagtctgtgcctcggtttcctcattgtaagcaaaggtggtgatggttacagtctgaaaggattttgttaagattagataatatagataaaagactgcctcaaacacagaaacattcaatatgttagctgctgattgtattgttataacatttcaaaacaccaaaaaaaggtgatgtaggacacttcatggtttattaataaaaaagtaattttcaaatcctatacataccctcaacgtttttaatttggcctctaatctatttcatggtggtaaatgtttgcaaaaggtaatttgcaccacattgtaaatattgacattttaaaacaaaactcatctgagattttttttaaatgtatctggtggaatctaaatatcagagctaattttataaaaggaaaaaaacaagatcccccttaatatattgcattgtttttttcttaaactgtattttctccttgaattcctattttcaataccccagaaaattgtgtcatttttttgctccaaaaactatgtatacaattgaaattttaaaatttcctgccaccaaaaggctgtaagtttttacatcttctttgaattgaattattgctgttaatattagtgcatcactgattgaaactacataattatttatcaatattttattttatttaaagttgaaagtgaaattttattgcagtgcctctctgggattatgtgcattgattgcaagaatttttgcaataatctttcctttacgatcctagatctttattgggacagtgtcctgtgataagtttctggtgggctgagaagtatatcattattttgtaaagtgagagagagatgattgtcaaaggggaggaaaggaaggtgaaactggcataaaaccttctactcagcacattatcaggcaaatttcatggggaagttgacaaactgcaaactgattctgttacacctttctgtgcccagcgatactcatactttattttcaataatgctaatgcttatctgtatttcttaaagtttataattccctacaggtatttcttgaaaaaaaattataacacaaatctgaaaaaagttgcatatttgtactccactcttagagcatcacagtttacactaatttgtgaaatgctcttggaagtccaagataagtcccctgtctctctctctctctttcaccttgggaatcccaattctctgagacccaacaatactgaaattaggccagacataacactacagtggtctctaagtgttcaagtgaaagaaagagtctcatatctctcacattaaatcaaaagctagaaattattaacaacaacaacaacaacaaaaatgtagcaaggaaggccacgttgaaagccgagagagacccaaagctaagcctcttgtgccaaacagttagccaagttgtgaatacaaagcaaaagttcttgaaggaaattaaaagtgttattccagcaaacagaccaatgataagaaaatgaaacagccttattgctgatatggagaaagtgttagtgatccaaatggaagaccaaaccagccacaaaattcctttaaacaaaaccctaacctaaagcaaggccccaactctctttatttttatgaaggctcagagaagtgaggaagctgtagaagaaaagttggaagctagcagaggttgattcttgaggtttaaggaaacaagccttctctgtcacatgaaagtgcaaggtgaagctccaagtactgatgtagaagctacagcaagttacccagaagatctaagataattgatgaaggtggtgacactgttaaacaacagattttcaatgtagatgaaacagactttattggaagcagatgtcatctaggattttcatagctaaagagaagtcagtgcctggcttcaaagtttcagaggacaggctgactgtcttgttaggggctaagaagttgaagccaatgctcatttaccattccgaaaatcctagagcccttgataattacggtaaatctactctgcttatgctctataaatggaacaacagagcctagatgagagtacacctgtttacagcatggtttcctgaataatttaagcccattcttgagacttgttgctcagaatgatttgtttcataatattactgcttcttcacagtgcacctagtcacccaagagctctgatggaaatacacaaggagaatgatgtttatatgcctgctgatgcaatatccattctgcagcccatggataaaggaataattttgattttcaagtcttatttcagaaatacattttataaggctacagcagctgtacatagtggttcttctgatggatttgggcatagtaaattgaaatccttctggaaaagattcaccattctagatgacattaagaacatttgtgattcatgggaggagagcaaaatatccatattaacaggagtttggaagaagttgattccaatctgcatagatgactttgaagagttgaaaacttcaatagagtaggtaactacacatgtggtagaaatagcaagagattagaattagaagtggagcctgaagatgtgactgaattgctgcagtctcatgataaaacttcaatgaataaggagatgcttcttacggatgagcaaacaaagtggtttattgagatgaagtccactcctggtgaagatgctgtgaacattgttgaaatagccacaaaggatttagaatattatataaacttagttgataacacaatggcagagtttgagaggattgactccaattttgaaaaaatgttctactgtggataaaaggctatcaaacagcatcacatactacagagaaatatctggtgaaaggaagagtcaattgaggcagcaaaattcattgttgtcttattttaagaaattgctacagccaccccaaccttcagcaaccattaccctgatcagtctcaccagccactaactccaaggagacaaccttggctagcagaaagattacaactaactgaaggctcagatgatcattcacattttttagcaataaaatattttataattaaggtattgcattttaagacacatttaacatataatagtatagttaaaaataacttttatatgcactggcaaaccaaaaaatttgtttgactgtctttattgcaatattcactttattgcggtagtctggaaccaaacccacaatatctccaaggtctgcctgtacatacattcatacctacgtacatctttgtgtaactcagtatttatctgactaacttgagctttttttacatttaatgactatagaatctcatatacttaatgtagcatgaatggaaatatgtttcagggaaaattagcacttttcagcactgcccaatacaactttctatagtaatagaaatgttccaaatctgcactattcaatgtggtagccactagttacataggattatagagcacttacaatatggctaatgcaattgagaaaaataattgttattttattttatttacctttaaactgaaatatacatgcatgtctagtggctaccatagtggatagtgtagttgctacaagaactcagagggataatttgtgtaaaagaaggagggctgtgaaagatgtaatgacataagtggacaagcagacaagtgtgaggataatgctacaggtgggcataactgtgggagcagagcttgcacgtaggaaacttctggacctgttccagggccaccaaaaacagttgagctaaaacttgttaattgtcagatgatgtaaagcctaaatttatcatttcaactgtggaagttcagtttaatattcactaaactataagatcaatagattgcacgtatttcaaagtataccttaaatagcaaacagcatgcgtgtaagccagttggcaagcagagtagacattcaagactcaatcaatatagttgcagttgcgtttagaagacttaagagtttactcagtttttctgtaactgaattttagagtgataggcactgaaacttacagtgccctttgccagcatttgtctcagcatttgtcaagctattttgaagtttcattgtcctattaatgaagactctgctagttcaaggtttatgacagtttagactggatagttgccaatactactaccactacaaataataataacaataatagctaagttctattgaatagtttacctaatgctgagtactttacatagatttttatctcttttaatctttccgccattcttatagtgaaaactatcatttccccatttgagatatgaaaatattgtattttagagttattaagcaatttttaaaaatcactcagctgccgactggagtcagaatttgaaccttgactctgattccaaagcttactgcttaagtttattttaaagtttttaataaaagtattttcaaaataaattttcagtgtaaataagattgccaccctattattgaaacatacttagaaaatgaaaattctgaactaccctcaaaagctttactagaaatatttacttgtaaaaatggattggtagaaggccaagtattttaatctattaattaaaataattcattcaaggaaatccactgagtactatactattaagcatatatgctttttgagttttaaagcagcaaagtcatgtttctttaaatgttttataattgaggtttacatattttaacttaactttccctctagttatgccagtctaatgtatttttattttattcatgaaaattatgtaagtacaaactctcaatattaaggtttgtcaatgtataatttcaaaatatagcaggaagacaaatatttttaattgaatgcatgtttacatagctatatttaaatacaatttaaatgtttttttctgctaaaggatgccatgctgttattttgagtcattaactattttaataaagacaaaagtgttttctttatggtaaactctcatcattttgatgcataacagaaataaatgaacaggaagaaattgattatcagatcatatttaattaatacccagatagagcatccctgagtgggaagcagatggccatgacttgtctttataacccaaatgtcctgacctcatcttttaaatataagatgacgttagagtgattaagcagtctgcaataaaacagtttttgtcctctccagatagtcattgagaaagtcagtgtggaaagtggaacattgttaatttctaatattccctttatttctcttggttcaggaagttttagctatggaggcaactaaattatttttttatttgaaagacatttattaaataattacatatgctaatgagtgaacaatctaatggagatgacttacatgtgctgaagagtgaacagactcatggagatgaatgatatgtttattcattaattaaacaaatattattcaagttcgtacaatgttcaaggcactgtgtctaggtgataagaatacaacaataaacaattcagagtaaaacctctgtcctcatggacctgatactctactgatagatacttttaaatagataattctaaaaaatggtatggaagtctggtgatagaaatatgtgtaagatgctaataatatatctataccagatgactatggaattgtaactgatactgtcaggtccaagaggccaacaggaaattcttcttttgaatcaaatggagtataacacaaagaggggaggaggcccaaaaggggaggggtctggtagccatgagctcaaaagaaaggccaggatacgatgctgaatgtacctcattacttcatttgtaaaggccagctgaaggatcaaagaaacctgaaacattggcataacccatgataatcaacatttagcatgctgtggttgatctcttcctctaattttatatgttaggaatcctctagattctggaattcctgtgaaaaacttcacaattctcagcaataacattgtaatattattgtttttcttagcaagttgatgttttccattttggacgagtttttgataggcttgagtgggagcttttgttctgtgtcttaaaattattgatattgtcgttagtcgttgaattaagcatgaaggtgattaaataattgagcccaacctaaagcaatgaaaaattcagttttgaagcattatttagatcagttttgaagcattatttagaataataattattcaaaactgatcagttagatcagttttgaagcattatttagaacttggtcaaatcttttttacattttcagatttagtattactagtacatagttgtatcttggaaattaccttagattttggaggttttgatttgcttattggctaaagagaacattcaggtttggatatggtagtatgctaaacgtaccatttaaaaaagggggggctcttttattatactttttaaaacttaaaacactgggaaaaacttaacagatatttattttaataggtaaagagaactagcaattaatgctctgttcttatatgttttacatccatattctctccaatgcaaagattttataaaataattattgccctttccatgtaattttggctcaggaagttcatttagtggcccaaagtcacatgtaggtgttgcgaatggccaagcctggtaatccaaaaggtgtagtaatttagcctttgtgtttttagctaacgatttttacaatgcaaatttacaggattttaacctctgtcatctggagatcatctccacccctccactgaaactagaacaccagtatcttctatcttgccaatttagtggcttctttttacttatctttatttgctgtctttacatcttcgacattggtggccacttctccttcctctacaatctcttggcttcctcattccttttattttttcacccactttttcatgtagacatgtagcattctatctttagccctatcaaattctcagtagatttcaatccatgcctttaaatttctagccatggcttttcttaagaacttcacattcatatttccattcacttagtggattcttctcccttgatggcttgcagaaacttgaaacacatattctaagacatgcattctcattccccacatccactctctaattgatacatgtatgtctctcctgctaaactgtaagttttttcagaaattcaggcatttcacttgtctttggtctctgaaaatctggcctagtccctggcacaatgtagatgctcagtaaatatttgataaattaatgatggaatgttgttaacaaatatgcatttggtattattaataaaacttgagaaatgccataatgtaattgcaagtggagcgtaaaagcattggttttaaataaaaaccttcttttagttaattatacccaacatcaaatatccccaggatgttttcctgagttgcctttgatgtacctctggcttgatagaagggcagtgctagaggattttgttatttgacccatgtttccaagggatgccagaatgaaggcagattctagaatatagctagaagtttttgtctggagcttttggtaataaatcaaaatgagatacagtactcactgggtagcaatagtggtgtcaggtgcgtaactagtgattttagtcaagtaagctagtctgcctacaggctttaatggaatcgaggtccaacagttcttccattaaagattaaagtaactgacagagacagattgttaaccaaactttcttctcattttctctttgaattattaagctaaccacacctccacccatatagctaatgctatagtgctctcttaatcaaaaccaaatcttaaatcaatccagttcacctcgactgttctccttcattttagtgatgttagtaaagatctttatccctgaagctacgtttcctttcccctccgtggcacacatctcatgaaagctaatttgttaataatatgttaacatttcttggaaccagttagctttagaaaggagaaaagcttaaagattgcagttctttaccaagcagcaatgaaagaacaaagagaacctcttctgtttcttaaaggtgtactattatttctggtgcttgtccacacctaatttgtaaatcacagttgctttccctaacagcttaaagtcattaactctcagtgttgtacccggtgcccacttctatttcccatgggtttcctaatagtccctgtagtttccccaaatttgagcagctcctagcatatatagaaggctctcagggagactgtgatgaatagataaacagcaagatctaatttgcctttgtctgtgttgaaatttggacaaacaagaaaatgactgcttttctccttttaaataaaacactttttgttcctcctacctattccaactctctggaagtctaagaaagagtgtcagtacttgccgtaattttgtatttgatctcactaggttccctccttgacattcattgacatcttaaaacaacctattggaatggctgccattatcctaataccacacacttaagtagtaaatctgggtttaacttgggttggtggatttcagatcctatgcccaagattgctacatattatggacatcttttcacctaggactgatcaagtgtggaaaattctgccaagtgttggcttgctcgtggagaggtgtgcttcttccctcattttatgactttatttggcatctctttttagctctgatattatctccttattgtataaacagattaaagttgtcattctccttgattaagaagatttcaggagaggtgctctgagaaagtgtagtggatagaaaatgaatcacaagttgaatgcaaacagaagacagaagatggacttagaagggcaaaatatggacagggagatgaatgggaggagagccagatgcaaagaatattatttcaagagattagactatagaaacaagtggatttagataaaccaggtagatgtaaaaatcacattctgaaaaggatttttggttaaggagaattacaagctacataaaataggaaaagaaattatatcatatttagacctttagagatatgagaggaggctgctatgtggaatttgtttgacttacaaacatcttttgtattacccttcactcaaactcaagtgctagaaataagaaatgattgttgaataactgggttttaaaagatatgaaaaacaagaagcaaatagaatgatagctaactttaccattttggtaaagttggtagtcatgagctttaccaacctgaagaagttggaactcagtattttgctatattcccaaaccctatgccacaatcagttcagcaggtttaagaaattgttaaaagagtcctgagtgtatgagaatgcttgttatcttgattttttttttttagctaaactgaacatatatgaggaggcaacaatctcccataacaaattccagatatgaaaataattcagcataattatcgctgtggaaaaccaaatttggtctggaataaaatgcaaagaaattagatagtgattattaatcagatatggtccggtggacatttattaaataaatccccactacgtggtaaaatgaacatgaactacttcagccaggcaatgatgctgccagtatactcgattaaattcttcaaagtgtattccattttcttccctaagacaatctctttaatttctcatctaattactcaaacataatttttggaacatgtcacattccacaggatgaacttacaaactgccaaccccaaactccttttatttaaaccacagccttacaaggttgaaagcacagtaacaggccaaaagacattttttctcgaggccgtgggatgtggccagataaatgcttatagtcgttgcatttgctgacttgctgttttgctggcatacgttcttcaccgttccatcctacgcctttgttctgagttaggttctttcctgtaaactattaagggatctgctagcaatgagctattttctttcctcttgctgactcatatataactttagcaaactcaaaaccatttattgttaggtattatgctaatttaactaactgctttcactgtcaccattcatttctgcagtgtgctgaacagctaagttttttgcccttaattgataaataaattggggagggcggagagaaattaaatttctatggagcttactttacttcagaattaatgccagcagtttcccagctgtaatttgatatagagactcctttagttattgtagttaccaagacaaaatgtaagggacattagcactggcacagtctctcctagtgactgaggcatcactagaagaagtaagcaccacctctttcccttaatacggtcatcctaggaacagttaattttctcctaatggttaaaaacaaacaaacaaaaaacaatttctatgtggatacatttcaagagttttttaatcgataggaaagctaaacactacaggacactatcattttcatggattttaattcaatactgttacttgaatatgtgctagtatttcccagggtaaaggatatgaagagatacaatgaatctctgtggccaccatatttattcatgttctcttacatacatgagtttctttcagtagatcaacaacgcaagcgtgggctgtaatctgtagaataatttgatgcaggtagtttatgtgagtagaagttatatagctttttggtgaaggcaccttagaaggttagagcagtaacggtgggggtgcagagctgctctgtaattatccacataactttgctagaaattgcttgtgataaaatgttcaattagaattattgctgcttgttccagtgaagataaagaactacagagaaatactacagagtgaaatataattaatgttgacagtaagaaatgtatgtgttttatgtataaagatgtcagtgtccttttcagacacatttgccaaaaggccttgtggtgagctctcacacagaatgcacaaagtatcataggtggaacatacttttattgaggacagtacaatttccacattgttagtcatttgtccaataagtatttgtgaacaaaggaaaatggctgtggctaaatatgcatttaatcgagaccttacagctcttgaagtcttttaaagatgtctcccaaaacatgattttgcaagtaaagatcgtttcaaagatgttttctttttggagaggaagatacagaaacatcacccatcacatattgtgcaaatgaaccaacaaataaaccgaatcaaaaggaaatgagggagatgataatgaaggttacacttttggtttatttctatatgcataaagtggcactgttttgtatctcctatatgaaagtcgtactactgagtcaatgttacctgggcaggtgcattgtattgtgtatttaattacagtgttaaatttctacttatttctaaaatttgctcaccccacaccacacccacacacgtagtcttctctgggactgacaataggcatgtccatgaagcaggaggaggttaaagtacagacaatgaccaagaaacacatccacataaactagtcagcccatgaggggactctgtgacactggcaccattaacatcagataccaactcagagtcccacactgacttcagagaggctcacagtacatccaattgagaaggcctcctgttgcattcttgaacatcatcggaggatgctgatttctggcttgtcatggatgagagacacatatagatatgtgaccaataataattttatatgaaatttaccattacattaaggcatacaagtaattaaaagtaaactggaagagcgtcagttgcttatatttttgaattaattttcaggtcctgtggatgtcaatattctagctaagtgtaacccctgcctatcaaatccgtgtaaaaatgatggcacatgtaatagtgatccagttgacttttaccgatgcacctgtccatatggtttcaaggtaagtaaaagcactttaagagtcacagtttgagagcataacttttcttggtgtgcctttattattctactgtgctttctgtatgtgccaagaactacttcactcgactatacttgccccttcttctccaggggcaggactgtgatgtcccaattcatgcctgcatcagtaacccatgtaaacatggaggaacttgccacttaaaggaaggagaagaagatggattctggtaggtcattagtctatgaccatctgtgtctgaagtattggagcaaagataactaagccaacatacattttccttttcaaatcaaaggacagtatttttcaaagaatttgagagaaatggcaatatgtattggtccctctcgtagatattgcaatataaaaaataaatggagacactacagcattctcagcacaggatgctacaaaaccaaaactaatttacaaacatacacatgtgcacattatggttaatcaggtcagattagggcaagacaaagtattaatattggctccattatactaattaatagccaactagtcccctactgctagtcatatattcatctgttgttttgcttattgctttaacagacagtgtgtaatgacaagatataggtcccactgaaacagaaaattaacgatttatttccaagacacaatgtaagtagacagacttgctgtgaacgattttaatctggagttatttaatcatatggtacaattacttcagatgtacttcatgaattatgaactggagctctttattaaatgacactaataatgtcacataagaatgctaatatactactaaaacttgttagaatttcactttttagaagaaatagacttcactgctgcattctattatgaagttctctcttattcatctagactttactcaaaaattattcgatacatactcaagatagttttatgccagaggaaggattgtatttaagacaaagagaacattcacattttgtaattgcaaggaagacaaaattttgttttcggattttttttttcaaaacatcaaggacattataagtatgttagtagatattgcaattttaaagatcagaaccagttcctcttcatttatgagcaaagaagcctgaattattttattagagcacaactcaagattaagatatctagggctgtggaataaaactgcttgtgttttagacctgcaaatacagtgggtttgttgacttttaagaccatggaaccatttgccttcttgcaaccggcataaattttattttttgaagggtttctgctttggtggatattaccttaaattgatgtttacaacatgtcagttaaaagcattttaaaaaatcaatttctggtagttaaaagctctatggttgatgagtgtaattatgcttttttcaatatttagaccacatgactttaaaatgcaacaaaaagatgttttttgccttttctcctctggcattcaggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtacaaataataggaaatattttgccttccatcagtatatctgtttgaaagcatcattggaactatgttatatatgtttagtaaatctttttttatttgataaatggtaggtgtcttgaaaatcagatgtaatgtaaataacataaggacttaaagatagtttcagctaaccaaataaaagacccaggaatctctgttcaaacatacgcatctattataaagccatgctatccagtaataaaagaagctattttgctaaagcttttagtcccacaattaaatggcatttttgtgcaaaccattttccctgtgcaaaccaatccccagtacctgtgtgtaaagaggacatttatttaatagccaaaacataattaagcttttgagatcatttgtcttcatacttgtgtcttcgctagtgagtatttgcctctagtaacccatgtccctcaaaataaaagtcaggaagatattgagcactttggatagtcttataagactatcaccttttttctaacacttttgtttctttggatgacacatctcattagagtattaattgctaaacttcctccctattcaaaccaatttgctctaaagtcaacatcaagtttatgacttgtctgttttgtcagaattgattttttatttttattttttgtggctccgaattagaaacttcatagatatgctctttttcctttaataaattacttaacattgacaaaggaaaaacaagaaagttgtacattttatttgtaagaaaaaaaatggagaagtaattttgatcactctactcaaagttgccgttttcattttctgggtgcatttcatttactatgtctgttttcatataatttaatacatagcgagaaaatcaaaggatgaaattacaatgcaggtgactggagttaacatctcataacatgaaagatgaacatacatctgtataattaaattttcccagggatttgttggaaaattattaaaacggaagcttttatggaatacccaaactgaactttactaggtacctttcttgatgggaaaatgctaggtagaataatgaggctcggttttggcaacccagatctgtttgagtgactctgaaggctgccttttctagggtcttatttttaatttttatttttttggcaccaataaagcacccaatgtcatgtaaagcagtaatagcatattaagtttccagtagaaatttgaacgtgctgtattaccaagtcttctagtagttgtctatggcccttcgactgcttagtgggtggaattttagcattatttgatattttacataaacaaagaatagcaagtatattcaacatgcacctttctagagtatctggaaagaatgtaaatgttatgtagctttgattttcacactaatattaccaatattatcacacctcagaaacttgacttggagccctttgagctgcctaagaatttaacttcattggatgggctaatttagacttctccaagaagcccgatgtttgcactaaaatctgctacctggtaccttcttaggatagaataattctcttttccatcattttcctgatcattatagacagggcttaagaacccagttaattttggaggcctccttaaaccaagccactgtcactgcaccagacaaattggacccaagcatttcaagcaagctttgcctaaccaatgcacagaaccaggaatatatatatatatatatgtatatatatatatatatatatatatatatatttcctgatgaaaacctaggctttggagcacaactgcaatcaggttcttatgtgtctttttgacaataaaatttctagaaggtggttgaggactcttgagttggtttggaggagtcctcctgctttgactttagatttgctattccttattcttatccatttcttttgagtctttgtctcacctgctcacccttcatttccccagctccctccctacacctgctcctcttgaacacatgttttctcctattctaagtgtcagttcagagcagtttccttggagaagtgttatgaagcctcacttccccaactatgtcagatctctttctttgaaacatatcataaatacctaaagcttagccaaaccattttttagccaaaatgtgacatctataaaagctgtcatctgggaacttgccatgagtatctgtcaagagccatttggctctccacaagaactgggactgttttagtctttttacttataactattgcaaatgtcagtttgccttaatttgggcaaagaatcaacaaaaatactaaacagaaagtgcatggcgtacagaacatgaagatatgaccattttatctttggaatgggtcttgtgggccatgaagagtttgacaatttggcatgagagaaggtatctaaatggggcaaatgtataactcatctattaattgtagtatttttgtgcacacatgaaatgagctcatttacaaaatttctaacaaccatctgcggattttgaaatcattgacacataagtgacctttaattatggggaagtatgaatgaggctctagagttttatatcctacttcatccaagtctgcagttaaggaggaattttcttataatgtgattatatggttttaaatttgagtttggaatctgattaatgagcatgagatctgggagcagaagccctgctatgctcagggaatataatagtgttgtcagtgtttaaaaatcatcctagtaacaagttgatttttcctttgaaaattttttattctatatcccgaaagcatacaatgagaagtgaactctgtttaataagaacaaataatgacttacagaaaaaaagcttgtaaattattatggtgacagtttttgtatttgacacctatgtcaagagtcagaacggacattatgtcaatggaaacaaattcagagatctgagagcaatctgacagagaagttatgatgtgatgaacagactacaaaacgtgactagaaatatttaaaataaaatgagccaccaatggggaatttattaaacattgtttaagccctatgtgaccaaaatatcacagtaagtagttactgatttgttagaggagaaaattctctgctctttcctgctccagggattgacagcatgaattgtaaggacaagtactgtttttctgttatttaaatattgctgtaacttcaccaccctagtcaccaaaaccattctccatatactccagttatcatctgtgcttccagttgtgtaatgcatgactgccgattactagtatattttaggtaagattaacttttgaaaagttgaattcactatgaatctaaattaacatccctatactattaagaaagtaggacttcagaattgttaaacaaataattttaaaattaaatttaaggttttaattgtagcttgagagaattttgttgattttgattttttgtttggttatttttttaaaatcatgatcatcttctttctaaagacaagacatttcttggagctaaatttccaaggaattcctgaaataacataaacctaacacctatgcaaataaaaactataaatgtggcacccctgtttttttaaaaaatggacactttttttaggctgtagtgttaacttaggtgtttaattcaaaaatgtgcttttgtatatttcccaacagtcagaaccctggatctgctgtatcaagactgtgtgtcttaattaacttttattcttacaggaccacatacaagtatgacacagttgatcacattttaagcccttctttcacttaatgggattacttaaattccataaagtgaacatctccatgcagattgggtgtgtaaagccttagaacacattttgtggaaaatattcagaccactttaaattttccattgtgtacccattttctctttgttttccgaatctctgacgcccatgcacaagccattcagtgtccatcttaaacagtaaaactgctggttgttccatcacctggtttagacgcagacctctagctccctgtgatggcatttaccttttgcctcattttctccatgtttgtgcgtgtggcccggctgtaggtaagaaatccaagccttgcttcagcttgctcgcccacccctgcttctctgttgtgaacgctgcgcattggcttcctgtgctctgctgttgtattgcaatgtaaaaagtcttttgtctcttctgtctttgtcgctgccagctgctaatctgaatgaggtggaaaaaggttagttgccttttaagtctattatgattttcattttagtctccctctttcttgtaaagttacatagatttcactgcgggtacacagtaaaaaggaatgttgacaaaatataaaatctgaaaacaatatgccaaatcagtcattcagatgtttaatctatgcatcgctatgacaaacagtataaaatgggcctctgaaatgcaatttatctattgttagaagacaatgaatagaaactttttgagtgggaagaaggggtggctagaataagggactaatataaatttttttaattttctacttgtctatattctttcactttttaaatatatcacaaacatattatttttggaatgaaaaacataggttatttagtactgtagataaggctgtagatagaaaaatttttaagtaagactgttcccataactttaagcaaatatctttagtaacatgtaacatgaaaaatatttgaaggtgtatacatttattgaaacactttatgaaataaatattataaagcccaagaagttgacttataaatttgtgttataggataccgtgactactaggtagtatgtttaagcataaaaatgccatatttaattattggcgtcaatatgggccaccaggctcccaaaatacatcagggcccaagaacgtgagtcatagaattattttatttatttatttatttatttatttatttattgagatggagtctcactctgtcacccaggctggagtgcagtggcgcaatctcggctcactgcaagctccacctcccaggttcacgccattctcctgcctcagcctcccaagtagctgggactacaggtgtccgccgccatgcttggctaattttttgtatttttagtagagacgggatttcactgtgttagccaggatggtctcgatctcctgacctcatgattcacccgcctcaatctccccaagtgctgggattacaggtgtgagccaccacacctggcctgagtcatagaattattagagtgatagccatgtctgggaaatcatcatggaatatttatgaaatgttatcttaaagactcagagttttaactaattacattggatttttaattattcagcttaccaaaagtcttcaagtaccaaatgctggcacagtgtcctaaaaggaacacaacgtgtgcttgtcttgatagctccagttgtatctgaagcatttgcagttggattatgaggataataaggaagttatagactgggcacagtggcttacgcctgcaatcccagcattttgggaggccgaggcaggtggatcctttgagcccaggagtttgagaccagcctgggcaacatggtgaaaccctgtctctactaaaaatacaaaaatgagcagggcgttgcggcacaagcttgtagtcccagccacttgggaggctgaagcaggagaatcgcttgaacctaggaggcagaggttgcagtgagccgagattgtgccagtgcactgcagcctgggcaagagagtgagactcgctttcaaaaaaaaaaaaaaaaaaaaacaaaggttattatatagcaggtctctctgtcttctcttgctatgggcttcatttcctctgttgcattgtttggatgatttactgtgtttgctgacttactcttacagtgtgcagagttaagttgaaaacaaatggtttcatattttagaatgtaacagtataacatgtgctattctctgtggattaatgcatctaataccttcctgggtcaaatggcttcttttctctttacaagtactaagcaattggtggcctgggtcagggatgtctaaggtctgagtctatctcagaaacataatagcaattattccatcacaggaatatgtccttaaattgttgtgtatactcttagaaacaatcttggcagtacaagtgttttaaatcgccatgtggtttcatgtgttgactaaatttcatgcttatgtttataaaagctcccttttatttccaagaatttgctgctgactgaatttgcttttaaaagcagtcaaatcattctctatattttcaattcaaaacttaattggaaatagaatttccatttttttctagcacctgggggaattgtcttaaataaaaagaatgtatatcattagtcgatacattgttaatttaaaagaactctgcagtttatgtgaacaacacaaaggtgggaaaaaacttctatgaaacaacgataaaccacttattcaaggatatgcaccttgtaagtagaggcccagatgcaaacccatgtctcattggccccaaagcatgcactttgaggtgggggcctctgctggagcctgtcccttctgccttgctgcctccttccaggcacggcttcttttctatctcacaatagcttatttctcattcatgatttatgccaaacaagctttccttctgctctcctgctgtctcttcagctcgctgtgcacaattgtccttatgtaaggaaagctgtacccacaaaattcaagtgcagccaagccgtctattttatctagataggaaaaaagcaccgaatgaatgcctgtacaattaatgaataaattccccccgagaactaggctaccttttatcccataaggcaggtggttagtttgtgtaggtaaggggaaaagttcgggtttctcttcctggcacgaatatttataaactctgggacacctcccagtcttttatttttcttctgtgaaagaggaataatgatatctgtcatataattcacatagacatttgagagtaacatgtaactatgtatcggaaaacactttgaattggtaaatgtctatactctggaaatatcgaaggctgccctgtaagacaggtttaaattttgcatcatttaattccagccatcatcactacagtgacatggttcagatatatttgatgccattcctcatggcagaagaattcttatgggaattctttattcaattttttataaagaaaattacctaaggtaaattatgtatagaatggaaatttctctccccatattgttcagtattgtctgtctttattattattgtttttaattgtactttgtatgctcacttcgtatagaaagattttatttagggataggtctttggttctctttgcccccatacactactttgaaacataaagaaatacacaatgctgaagagctcttggatttggctgagttggatttgtagattttgtgtatatttttagattttcatgatctcttagtaacagtgacttctgtttttaattctgcttcgagatgtgtaaggtctttatatcaaggtcgttatagttgcggacacacttgtgagcctcaaataagggaaacgttaagttgccatctgtttttactagagagaatactttggcagcctaatgatactatgtggtttgtattcatcctccaacctttcaaaactttcttaaatgcactttaatctcaaaaaaaagttttaaagatcttgtttgctctttagttaataggcagtgcccattgagcccagaacaacaatttagcctaagcaagtcttattcaatctaatttgaatttatttattttgaaaactgagttaaatattttctgaagtttcagtagctgctggaattggctatattatttagcctcagtgttccaataaggaaatgctgaaaaacacttcattttctgtttgtttatttggagaggtaagttttttttttttcatttaaaaatataccagatgcttattgagaaaatatattatgcaggacaccatgctaagtattgaaagtgatacaaaaatccataagacattaccctgatctactgagcaaaaactctttggctttgattctttactgcaagatcagatcagttcaaatatttctcagtacataaccatcacttctcacattccaagaacattaataatataatatagctactttactagtttgtaagtaaagaaaaacactccttctgaatatggacaccgaccaatctccctgacagagtcaagcaactcatttcataccacttagaaaacaaaaataggaaccgaaaactgattttccttctttgaaatgtcttaacacctacatttatagcatattttcttgaaccttcctattttgaattatgataaacttttatctcacagggtttctctatggcagcattccgattatgtacgtgtcccattttgcacctattgcacacaaagatcacatctgttaatggctaatgtatcttactgggcatctgcctgtgttactgtgttgtggtgcctgggattataaccttgagtatgtaacaaatagggcctgcctggtttagcaaaagaggagaaaatatacatacttttctttcaggtccaacttaatgaagctgccctgtgatgactcccataatctcatcagctatatccaccctgtgctatagatcatcagtctctctgccacactgcatggtctgtaggagtagagagaatgtttctgtttctataaataaagaacaaatgggaaatgtatactttttaaaatcagaattggatcgaatttataaaatttggtaatgataaacattcaggtccattcatcttaaccttcctcaaacattccacttaagtgctgacaagtgcaatttcttgataatggagctcatagtctccatcctccattggaatggtaattgttaggcataaaaatacagtagggaaatctggaaatgaacagtctacccatctcatccagcctgcaagggcacacctcgggctcacatctcagaacacaaatctgctatcagttttttaattctctctttgcttccttacattgttctttatgtgatctgggtctccattaacatttaaaaagcatttgcctgcaagaagcaatcaaataagtgctatctttcctatttttttatccagcactagtttgtgccactttactagcgaatgcaatgggaatggagaaatacaaaaatataaatataaaggtatcccatgccctcaagtagtgtacttttaagaaactaaatcatattttttatctattaggttgcttattttgatatcttcccttgctgagttaattcaaagagaataaaattagtacatttattcaaatctttcttgagtttgactgattacatttaacactagaattctggtccagttattcagattgccatcctaaatttctccttcattattatcaatattaataattatttcttataaaaaacagtttgttacaagttacagtaggaataaaaatgggctgcagtatcagctccagtaccctcgccacctctttcgtacatctatgatatccagaatggactcagatttttatctatttcaaagagagaagaagctaatctagttacattagcagaaggtagcaacagtagcaagagttacgtgtgccagcaacaccatgtactgctatctaaaattattttgttgtagacatgcccaatttgaatttaaaaagctaactttggggaaaattaaagagagatactcaacatccatttagtgtaaaacaaattaatatttttaacagtgatttgagttggaaaatttcagaaatcttaatctggggacaaaatgacccacttttttgataagcaggcttccacctttttgataagcaggctttgaggactaaataagcctagatgagacatcccattgcccagatttcttggtagatagaaagcaattaatagtccagccaaggtgggcacagtagctcatgcctataatcctggcactttgggaggccgaggcaggtggatcacgaggtcaggagtttgagaccagccttgccaatatggtgaaaccttgtctctactgaaaatacaaaaaaaaaaatcagctgggcgtggtggtgcgtgcctgtaatcccagctactcaggaggctgaggcaggagattactcaaacccaggaggcggaggttacactgagctgagattgcaccactgcactttagcctgggtgacagaacaagactccgtctagggaaaaaaaaaaaaaatagcccagccaacaattcttcaaaactttcctgtctgtaattaacacagcttatttagcaaagagaacaaatctctttggggtaataatgtatttcggaactgtataatatagtttttaataataattaaaaataaaaatttcattcagcccagtttctaggccgggatgctacacatatgtcagtcattaaggaaacttaacggacagtaggaaattagatgttgatcttatttctctaaattttccatataggaacttctccagggtaaagctttgtcatactcatccttcaatcatttgctagatctagcacaaaaaatttctcccaagatgtgtaatgaaaattacactaaagcagcttttgttggcgaaataaaaaaacctcactctgagagagtacatgtaaactaattatataatcagtaaatttatttttaaactattcttactcatttcgggaaacatttattgttaactctcatggaccatatactatcttcattattcattcatttgtcaaaaaattactatagttaagaaatttcaacaatgcttaatgagttaaagcagtattttttaaagaaaaagtacatttaagaaatttgacagtatgtacaggaaatgtaaatcaactcaaatattctccaaataatatatattatatatatatttaatatgtaatatatcatatataatatattattatatataatatatattatgtatatattatatattatgtatatattatatatatatatatatatttgagaccgtgtctggcctaggctggagtgcagtggcatgatctcagctcactgcaacctccgcctctcaggttcaagcgattctcttgcctcagcctcccaagtagctgggattacagatgcgcaccaccatacccagttattttttgtattttcagtagagacagggtttcaccatgttgacctcaggtgatccacgcacctcggcctcctgtagtgctaggattacaggcatgagccactgtgcccggttgatataatgtaaagtaataaaacactttcaggattatttttatacttaatgatagtatatatatatattatacgtgtgtgtgtgtgtgtgtgtgtgtgtatgcacataagtagttaataattgcagctgttaaagttcaagatcatctgcaaacttaccataaagctgatggcacaggcattcgactcactttctcttcttcaagacacagtagtctatgattctcttgcctttgctgtctttaagaccttgaagaggagaattgttgttattatttggtggatagcctgtcctgcaagccctaactgctaacaccagctcccctccaacagaggagtaagtgatgattggtccaagtcaagcacaactcacagtgctttgcagagagacatctggccacagcagcaaatgtagagctaatctacactactgtgctccacttacatcttgactctcttgaagcacggggagccttgtcatggagcactccttctcctttgtgcaccgcttattacagactgactgttggagaagcttatagtcctaaaagaaaacttgagacaaaggagaggacagctacatgaaataaaatgagaggaaagagacgtaaaaatgaaaaaaagaaaaagaaaaaggaagaaatagtggcataagttgaaagttttattccccgctgtaaacttccagtgatttggaatttactacctgtattgttttgctagggctgccataacaaattactgcaaactggaggcttaaacaacagagttttattgtcttacagttctggaggctagaggtctgaaatcaaggtgttgattcctgccaaggattgtgagggaaatgtctcttccaggcctgtctagttggcttctccctgtttttcatatcatcttccctctatgcctgtctttcttggtatccaggtttccctttttgataacacaagccatattggattagggcctatcctaatgactttattttaacttgatttcctcagtaaaaactctatctcaaaataaggtcacaacctggggtactagaggactcacacatattttgttttgaggggcacaattgaatcctcaacaccacatcactgtattttaaactctgtttgcaccagaaaacctggtcttcttccactgttctccatgtcaccaaaaggtaattcccaatataggtacccaaatcatagacattctagacaactccctttctctctttcccccatgcttattcagtccatcacaaagtcccatctgttttgcttcctaaacactgctttgggccatgtatatctccaccccacccctaccctgtacaagtggtcacctctcatgtgcacttgtatccccacttatgcaatctgccatcctccactggagacagagttctctctttctctctctttctttctttccagaatttcgctcttcattgcccaggctagagtagtgcagtggtgcaatctctgctcactgcaacctccacctcccgggttcaagcaattctcctgtctcagccttccaaagagctgggattataggcacccactaccacacctggctaatttttgtatttttagtagagacggggtttcaccatcttggccaggcttgtctcaaactcctgacctcaggtgatctgctcgccttggcctcccaaagtgctgggattacaggcgtgagccactgtgcccagccagagtgctcttttcaaagtgcagatgtcatctggccatgccccgactcaaaacctttcagtgggagcctattattcatagaatgaagaccttcgaccctgtggcccagccagcctctggggctcctctggcaccatgttttcccgggctcactccccatctcttagggctcctgttcttcatgctgcctcctgcagaagcctctgtcagagctcttcattctccacttcacccttgcctctgagtctcacctcttcagaagaatctctcctgtccttcttcagaggaaacagtccctttctagggccccataaaatgttcctgcttagcattcagcacagaggcaattttatgcatatagtagtcccctcgttatctgcgggtgatacgttccaagaccctcagtagatgcctgaaaccacaaatagtactgaagccagttgctatcaatcagaacatgtttctgttcatgtctttcaacccacacactgaatccctcttcatcccaagtaagcccttagcatgcatggtggctgtaacttttgcagtttgaggtatgacagcaaaactagtatgaatttctttttcccttgttcacaactttgcagagataggagattcatttttgcggtagatcttagcatcctcagtgtacaatttttctctctttccttattaagttaagaacttttaccttttcacttaaaggaagcacttgacagtttctcttgggcttgtccaaattaccaacatcactactcttgcactttggggccattattaagtaaaataaggtttccttgaacaggatgactgtgataccacgacaacagatttgataactgagatggctcataagtgactgatgggcaggaggcttcttcagccagataccctggatagagataatttacgtgctgggtgtgatggagcagaatggaacaagatttcaccaagctactcagaactcatgcaattcaagacttacgaattgtttatttctggaattttccatttaatatgttttggccgctgttaacagtggggaactgaaaccacagaaaacaaaactgccgataaagggggactactttacttgggaaattactgaattaatatctttctcctcctcctctcatacataaactctgtggaaataggaatagtttgttgttgttgttgttgttgtttaccattatacttctagcattggtagaggtccccattcatagttgggactcaaaatatatggtgatgttaaaaatctgatttgctgttttaattatttgaaaaagctataggcagatcattctgtaagtatcagggaagagctttgtagaatagttctaaaactatttcagtaagtatggtaacaaatttaaacacaaagataacaagatactaggaaggaagtagaaatgaaggcaataggaagggcccctttgtgttaaacaaggaaggagcattaaaaacagttaggttcaggccgggcacagtggctcacgcctgtaatcccaagactttgggaggctgaggtgggtggatcacagggtcaagagatgagaccatcctggccaacatggtgacacctcatctctactaaaagtacaaaatttagctgggcatggtggtgcgcacctgtagtcccagctactggggaggctgagacaggagaatcgtttgaacccaggaggcagaggttgcagtgagccaagatcatgccactgcactccagcctgggcgacagaatgagactccatcacaaaaataataataataataataaaaataaaataaaaataaaaaagttaggttcatagatctaaaatgaagcagaaggtaaggccaaactccaggtattatttctcataaaaaccatcaaagtgcattgaggtttcttcctcagtgcaataatactcacaatatcagtaccacagggggctctgaacatatgctggcactttatttttaccgctgaatgaagtaatgttattttgtacagctaagtgtgatactccctctggtaacttgctgtctgcatgatccatatcttcagaagcattttcctttttattgaaaaaaagggatttttttagagccacagttaaccttacacatctctaattccagagcctcagtttactgatgaagaactgaggctgagaacaataaaatagttctgcaaccagtcaactctcgtatattgcatacaaccgtagaaggccatcctagacaataatacaactaaccaaatgtcattttccccaataagaacagttacttcctgaggtctctttatgctgattcactcttcactccagagtattatcaactctgatgatccagctttttactgttccacctagaaggtgacccataacatttatcatccaaatcagggtagttatgtgagtgcccaggcacactattgacaattacgttgggacaacgggtataaaccaggacggttgtacaagcaagaatgaatgggcacattaccactccatgaaatttttcagaagaaacacattcacagatattcagtaagtagcattttatctccccttcaagagtgagtctgaaaaatcattcccatttagaagagtgggtatcacttttggcatgctctttcacaagttgtaatagtgttactgtagaacttggtcatttcttgtcctgttgtgtcccatatataaccgacagacaaaatcaggaagaggtgatctaagaaacagataaaactctatacctgtaatcccagcactttgggaggccaaggtgggaggatcagttgaggtcaggagtttgagaccagcatgcccaacatggtgaaaccccgtctctacttaaaatacaaaaattagctgggcatggtggcatgtgcctgtaatcccagctactcaggaggctgaggcaggagaatcacttgagcctgggaggcagaggttacagtgagccaagatcacgacactgcactccagcctgactgacagagcaagactctatctcaaaaaaaacaaaaaacaaaaaacaacaaaaaaaaacaacctctatgtcaaaaagattcctctgtttacaacatgtagcactttttcttaagaaagttctggcattcgcagatattggttaccagcaatatttattaccagttacagtagatcatttactaacctctcttatcctgaagaggtaaccatagaccccttgatggaccactctttgttttctcgccaaaacatacacaaccaacatatatacgtacactcagaatgcttcaacctcttatcaacaagagatgaaaactagaatcataaggaaaattaatttgctcatctgatcaaaagtgaaatcacaaatgccaggcaatgactgtgttccacactattgggaaattttaagggcccatggctgaaaataaataaataggatttcctgggatttagaggaatgggttgaagccagatcatggagtcaaggcttgcctaggctcctatctcttgagaggctcatagacaccaacatttaacctatattcaaccacattgccccaaaccactccaatggattgacttatctttcttgatgtcagtttaaacgtattaagacctgcttatagggtaatcatttacaacactaactctgtatagtcgaataaagaatatttccagttttcctttctgtcacctcacactttatcatctctgaaagggaggcagccattgataatattatctcaggacctgagccatcacaaaagcaaactcaattcccctattttttattatttttccactaactcagtactagctctgactacacttaaaataaaaaccaagtaaaaatggcatcatgtcctcacaatactatgaggtttgggggaacttttcaatattggtaactaaaaatacattagctgactaatgttagtcattttatctctattcttcctggaaaaccagtgcagcttttagctgtctaatttcctcttactggttgagaagtagacatgcaggccagtattcatctaaggagcttgctaagtttcccttcttatattgagctcctgaatctcgccactgttgcactcttttgaaagcggtccttccctcaagtatagcagaatccaatataattaaggaaaattaaagaaacagtccaatgaaaacattcatgttaatatttagtcagggaaaattcacagtaatgtttaaagagaatagcataagctatgttattactaatcatgagtgagtaattaagcaaaaaattacactaatctctaaaggctagaatgaaatctgagttgattacaggtcaacaagatagagctcttgccttaaaaagcatgattcctccttttaatgactattatttgagtatgtcagcataccacactctggaaaaaacacaaaagcaaatgtggcaagaattctactcttagtgattttacagtcgagaaaagagagtcagataaacaccagtaatataaaatgcacacataacagtgcaaccctaaaaccttaccttatatgcttgtaatgaatattaagtgactgcatatttatacagtgtttaaaactgtttagcatacagtagtaagcatgatataaatgctcattaagtacataaacaaatatataccatgtatatgtcataagataggcatagtcaaacacaatataaaattagagatagagaagaaatagttgaaaagatctggcatgattccataaagaagggaacatataatggatgagaaaagtgacaacagaattgtgaaaggttgttattaaagcaaaaggagaaaccattagccctggcatggagttgaaataaattcaggaaatagtaaacagacccaggtgatatgaatgtcgggtggaagattggtctttaaagcaagttaggcagtaattggatgcagaaaatgtttttgtaatatttgttagcattataatgttcggtgataataaagaaaatcaaatctttttttttttttgactgctcttgtcacccagaccggagtgcagtggcacaatctcggctcatggcaacctccgcctcctgggttcaagcgattctcctgcctcagcctcccgagtagctgggattacaggcccccgccaccacacccagctaatttttgtatttttagtagagacagggtttcaccatgttggccaagctggtctcgaactcctgacctcaggcaatccgccctcctcagcctcctaagttcggggattacaggcatgagccaccatgcctggccaaaaatcaaatcatttttgacgttgtcaacctatcttactaaggtcaggtgtatagctatgtaatggtcacaaagaagtaccatatacaatctcagtaatgattattgctattttgctactcttggagaggtaaggaatacttgacattgatgtagttttttatgttcaagttggcatgcttaatcttaaagctgttgattagagatttaacaatctggttagctaacagtttcttggaactttgtccttgttcactcctttacattatcaagtctgtggagtaattccttttagacaagggtcaactctcagttttatttttttagagatgaaattctctgtctctgttctttccctagctcaagactttctctgctggtagattaagaactgattaggagcagagtccattacattcatccttgtagctccagcctctagcacaacatcacgtagtaaatccttatggactgtgacttagattggatgaattgggttggattgtatcagagtaaataaagaataaaacatttccctttattataattttaaaacagtttcttatttaggcataaagtgaaaagtacataaaatgacatttattatgtatctcaaatggtccttctttactatcagtttttacaaactgtcttggatagatactactataaacagcctatatctccatcagatagatttggttagaaactgaaagtgatttcatcatagtaggctgataaaatatgatgaatgcatttcatcaaggtatccaacttagagtaatactatttgaaatcacaagcctttaaataaaacctgtttaaaaatagttcatcatgcatatgttgctaaaaatcttttgtatcccagaaaacttatagaagcaatatatgagacttactgtgcaattagttctttttaagagacagataaaaactaatatcatacaccagattgatgtaataactagatgaatacatttattaatttgcatcacgggaaaagactcttgaagtctaaataatatgccacatttagttgtcaagcaatgatttctaccaactagcagtgtattattttaaaaggatcatcttgtaacaaaggggtgctgttacaaggtgcacaagcctgaaattttaaccgatgctgttacaaatgacagttttagtagtttcctggaaatgaacagctgcctatagatgtgtcactttatttgtccatttattgcatataaaacaattcaaaagtaggagtaaagtagaaaaggtaaaaataacttaaaatgtattatgtaagttaatatatattatgtatatgaatacctttccagtcaccttaatactttatgccacaattgggaaagtcttctaaatgaaaattacatttggtctaatgtatgtgaaataataaccatgttatttttatcagaagaaattttctaaagaaattatcagtcatgtgattcaacaaagagtacctagaatctgcgtggttatgccttcagctctcatttgttgatagaagttctatttcatgagttagctgactttcatggaaaaaatatatgttccctgtctctgtattgagtctccttttacttttttctttatatgtcagaggatgtggctctaagaagttttctgttgagctgcggcaatgatccacaagaaggaaaccaagtgtttttcttatagacttttaagaccagagactatgaagatttgagaatatttttttcaaacataaaactatagaataagccaggcataaaagggtacatatggaatgatttcatttatgtcaagctcaaaaacagtcacagctagcctatggtcttgtcatgatagtgatcctctttgcagggaccggggggaaggcttctggggtgctggtacatggtgtgtttctagatgtgggtgctggtgacctgagtgggttcagtttgtgaataatcattaccaatttattcatcctttgggtctatgctatatatcaagaaaaaaaatccaaaataaacaacgccattgaaaagcattcagatttccttttcctaattcccatagtatattctgagggtgctcatattagtcacagatcacaatagtcctgttgtccaaaatcacaacactacttagcagcagactcagaattggataatggaccacctggttccatgccttgtggcttttgttttgggttttttgctttgttttgttttaaatcacaagctgccctaacctctaagacccatgacaatgacacagtctgctggcaggaagcctgttgacctttttctatgagctaacactgtttgccctgttgcaggtgagttgtgtgaggagaagctggacttctgtgcccaggacctgaacccctgccagcacgattcaaagtgcatcctaactccaaagggattcaagtaagtcaaaagctacctttttgctcacagtcagggtaggggacccattattttaggagcccttctcctccttcatccttagcttcacacctctgctcaggattaaagggacctattcactagtatcagtgacattttttaaatgtcgatatacaatatggacttttttttttttttttttttttttgagatggagtctggccctgttgcccagctggagtgcagtggcacgatctcggctcactacaacctcctcctcccaggttcacgccattctcctgcctcagcctcccaagtagctgggactacaggcgcccgccaccacgcctggctaattttttgtatttttagtagagacggggtttcaccgtgttagccaggatggtctcgatctcctgacatcatgatccgcccacctcggcctcccaaagtgctgggattacaggcgtgagccaccgcgcccagccccagactttttgtttagtacactaaagaaaaatgaaaaagtgtttccttttcatccatgattttttttgtgaagtcacctaaggcaatgagcagcctttgaaaatgcttacttaaatttatttgaaggcccaaccggtgacatttgtaatgtcttctatgtgcttcattgtctgaaggtaagtctgtggtaaaatagagaatttgactttaatgtaattgaagatgttacggtctgaaacaatgattggactatccaaggtgagaaagatagagtgaccatatatctcaggctgccccagggagtcccaggctatgcctgtgatgatcactgtagttattgatagtgtctcttccaacttaaatattttttgcatggggtgacaaagcattataatcccgctaagtgtactcccttaagtgaacacagaacttcaaaaaacacttcctttttcctccccagcaatattcctgaaatatgtttgctatgaaattacgtgatttctttgccaccatcctgtaatattttaagggtctttcaacagcaacttctctttttagagctggcagtagtttagagatcatctagtcttcatttaaacatgaggaaaccatggcccggagaggttagttgactgtccagagatcttaaggttatttattggcagagctagagctaggatttatacttaccagttgggtgatttttctactatgtgttacctataagaaattttatagtttattaacattacagttggtattgtgtagcaaataggctggattcttaggaattacacagtcgggtacaggggttgagctgtgctttcatcagacagctagcaaatagcattatctgttccttcaagcaatatttattgagtgcctgccatggccacagcacatggtaataataccatcttatgattttgtagtcctttatagctattcaccttcacttaattcatcttcttagagaaatgacccaagctcaattgccatagaattcagggaattaacaattacacaggtcgggatgaattttataagagaagatggaatttgagctggattgctaagatatttgtacttaccgaacagatcatcagatattttaagtcgggtgggagagtggggtcagaatcgccagatccccactgcttttcaaatatcaatctaaattaaatatttattctcaagctttcttttgacaatgtgcttttgctttaatttggtttaaaatccaaaaatgtagaatatgtaggtacagttgtagcacctgctaattccctacaatgtctttttgaaaaaggaaagaataaatttgattctattttgcattatattttagtttacaaccctaggcaaaaacccagtgttattccattttcactttatacaaaactttacattatattttattcaaccaaacactgtaggtaagttgtttttagtcttcatatcaatgatgcgctcacaatttaatttggcaaattgaaaacacatcacttacataataaatatcatttcttagagaaattagctagtaaggaaagttttccagaactgctcatctgctgaacagatgtcacagtactttgtgtattgtaagtataagataaagtattagtaagacttaactgaaactattagaaagtgagtttgtctgcaaaaagactaatccttaattaaatatctcctctcgccatcaaataaattagacactcttaaaagtgcattttgctgcattatggactaactcatttggaaacccactgttttccattatagtttgtaagctcgtttcatagctgtatgtaggtagtttagcagaaaacggttaggtcagtgtgtgtgctgttactcccgacattgtgggaaaggtagctgtggaaagaaaatagacgtaaaaatcaaattctgtgaagctgctaaagaaaatctctactgacaaatgttgtttagacaagttatgctatgctacttcaacttcattttcttattactaagctaacagagctggttttacttttattgctttattatatacctcataaatctcccaaattgctttgagatatttttagactatgatatgccataagcagtattttcaaacctgcatcttacatagccagctttgggcttctaaacagtgtattttatattctttgcttcttcctctctccttgtcagataatagagttgaaggaatgtgataggttttattgataatacaaactcaggaattcttatttaaatttttctttctgttttgaaactcagtctgaggagcaaaagaaagacaaaaatgttggacataatgtaactccaagctctaatggtcttgaaaaatagtatttggagagaagggaatataaaatagctcttagacagccgctatggtggatgtgttgttctcttatctttcactttgatttcttttttcagataaataattcagagtgtttcaaagcatttcttcttttttttaatgcttggcacttcaacagctctgctcacattaacattgatggaagttctcttctcgggccttgtccatctctttgagaatgtatatggccacttagagtctatttaacttcagacttgttgtttactttgctttgctatgatttagcattaaaaccaactggctgcaaagcaagcatgcttatgcagtgagctcattttatttcttaattcatacatgcagagctgaaagtctgtttgctactcttagaggctatatactcccatttgttttaattcttccgctctccagcaactctcaaatcctgatttagcattttcagacaaaaccttaggcattcagtaatgccacattcacttgggtgtttttaattatccttacttcaaatcctaatagctttgaaatagaaaagtggataattaatacagactaaaccataaaagcttttatagaattataaagactatatagagaattattttaaaaaccagccatttatagaacgtgcattatatataaaaactatactaattaatttacagatggatgcgtttaatctttaaataaacctgtgaggtggaattatatacgtgttaaagatgaggaaaataacacttacagagattaagtaatttagtcagtattatatatactttatgctaagtgaaataggccagacatagtaagacaaataccggatgatctcacctatatgtggaattttaaaaagtcaaacttatagaaaaagagagtacaagagtggttaccaggaattggggtggggaaaatgggaagatgttggtcagtggcacaaattttcagttacaagatgaataataagttctagagatctaatatcacagcatggtcactatagttcatactgtattatatacttgaaatttgctcagagagcagatctgaaatattttcaccacaaaaggaaaagggtaactatgggaggtgatggatatgttaattagcttgactgtggtaattatttcacaatgtatgtatgtataaaacattaccatgtacatctttaaaatataaagattttatttttcaattatacctcagtaaatctagaataaaataaagttgataacatacaattaagaatgaagccggggtacaaacacagttctgtaaaacctgaattctgcaaagcctgaattctgcagagctaagttatagttttctcatatatacacacatatatatacacatatatacatacactgctacatacacaatacatatgtgtgtatgtatatgtatatacacatgtacatacatatacacacacatacatatgtatgtgtgtatatatgtgtatatatgtacatatgtacatattctgcaaagcctgaattctgcagagctaagttatacttttctcatatatacacatatatatacacatgtgcatatatatacatatatacacacatacatatgtatgtgtgtatatatgtatgtacatgtgtgtatatacatatgtatgtatgtgtgtatatatgtatatgtatgtacatgtgtatatacatatacatatacatacacgcatatgtatgtgtgtatgtatatgtgtgtatatatatatatgtgtgtgtatatatgagaaaactatgacctagctctgcagaattcaggctttgcagttatgtgtatatgtatgtatatatgtatgtgtatgtgtgtgtatatatatatataaagtcagtgaaccctctcttaaactcaaatcaaaaacactcttggaagccaatgtgtaagcctaataaatcacaacaggagagtgttgaggaaaaggtggagggtagagggaggcttccagaagacccctcctcatagatggccatacctgtagggattctatggtcccctataggtccacagtgcagtttgaaaactgctgcacgtgccacactgcctttcttcatgcagctataaaatcctgcatccttggtatcataactagagatcccagtggtcagcactagagaagtacaggtttaaagggagcctgtggaattaattattcaacagcatagtgcagtggttagaaatacaagctttcttgttagattgcttgagtttgattcctggctgtggcacttagaagttgagtgtttgggggcaaagtacttcacctctttgttccttagtctcctcacctgtagagtgggcaaagtaataccacgaatatcacaggactgtggagaggattcagtgaatccatagaagccacatggttagagcagggccagaggaagtgctcagtgaatgtcagctgtattattactcctggttcctcaccatcaatgcagccaagaccctttaccaccatggtgaacaggctgaaaactgtccgtgggattggccccgtgaattttctatcagttcttctatcctaacccattatgtcagtcccgttcttctataatgagtatctggattcattgtgaattagggtatttaatattaatatatttgcttttcttaaaataataccttgttctgatgtatctagtctctattgtaaaattaaaaatgttaatctttttttaaatatgtttaatatttccagtaaattttacaacatagcacttttataatctcaatgatcaaatggattaggccaaactgaaaatatagggcactgtaagcaaacaaaatggggaaaaagaaaggaaggaagagggaggagagtgggtgggagggagtgaccctgctacaattaccctgttcttatttgggctgtggatgttcactatcaaggagataaaatcactatttctctggtagatcacagtgatagaacatggaacatactgcagaacagttcgattttctaggtatccattaatgtgggggctctatgagcctattctaaataagtattttaaagatggtgccattgtgtctagataaaatgcattgtttacttattttggctcagttgggtttgaaaccattacctgcttgttccaacagatgtgactgcacaccagggtacgtaggtgaacactgcgacatcgattttgacgactgccaagacaacaagtgtaaaaacggagcccactgcacagatgcagtgaacggctatacgtgcatatgccccgaaggttacaggtaaaagcagaaatgaataagacctagtgttcaataagacctagcacaacagggtgactatagtcagtaatagtgtaatcgtacattttaaaataactaaaagagtataactggattgtttgtaacacaaggataaatacttgaggggatggataccccatttaacatgatgtgattattatgcattacatgcctgtatcaaaatacctcatttaccccataaatatatacacttactaggtacccacaaaaattaaaataaaaaaattttaagacaaaaaacgtagaacttacagaagcaaagagtagaatgagggttaccaaagaggaggacagagggatggtgtttggggagatgttggtcaaagggtacaaaatgtcatttagacaggatgagtaagtttggaatatctgttgtacagcacagtgatgattttgtttaatagttaagaatacttgaaaactggaaaaacaaggaagtgcacatatataatatacagttatgttatacagctctcaattcagattggcaattaagtaaaatcgtattaactaatttttttttctccttattcttcagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcaggtaagagatctctctctatggagagatgatcggatcttaaaattcagcttcagagaataaacatttgtggtagcttctgaatgattgatagtatgtcttaaatagacagttaaaaacagaaaatgctccttgtgtggacagcgttagtaatttttctcttcaacatttgtattttcaagacaaaatgaaaaacaaatatttttattcattacttgataagcagacagtaaaaaaaaaaatatgtctctttgttttgtgctcagacaaaaacatttgattcatttgcttttatggctctgcagttcagcctctgcatgggggaggcttttcttaggaaatctgcagctaggaagggtgcaggcgagaaagaacacctggattcaaccaccagcacctttttttttgttttgttgtttttttttttttttgagacagagtcttgctctgtcgcccaggctggagttcagtggcgtgatctcagctcactacaacctctgtctcccaggctcaagcgattctcctgcctcagcctcccgagtagctgggacgacaagcatgtgccactatgtctggctaatttttttgtatttttgatagagacagggtttcaccatgttggccaggatggtctcgaactcctaacctcatgtgatctacccacttcggcctcccaaagtgctgggattacaggcgtgagccactgcgctcagccaaccagcaccttttaactcttcacccagaactttgaagaattgacatgaaattaacaaactcaaattttaagtctttccaccaactcactgtatacctttaagcaagtcattcagatccctatggaagaagctgcactagattaaagataataaatatagtgtacatggggcaaattatgtctacatatttgttttatctgataagcaaaatcatttaatatatttttaattcaaatgactttagccagtttcatgtagacaccaccccttttttggtttaccctgatactctagtgagggacaggggatccttttgaagtcaggaagaagagaatcctggaaggcatgattctctaccttccagtgtttgccccaccaaattgttatgagaaccacacagtgatgttggggcttaagtcttaacttagctaattaatcctttaaaagccaaaatgggccaaagagcaggataaaaacaaagatttccccctacacatggcataactgtgaagaatttgttgtttttaaatatgagatataaaaatccatctttgacaatgtagtcatttttcacagatgctataaataaagcttataacgggagcaaaaggagcagtttagcgaaaatctgcagcaaagaaagttctaagcacatccaacatgtttacttgaggatttcttattgttctttttaagtttcttcatggatttatttgcaacaaagcaatttaagaacaagtcacctttcaaggaataatttcagcatcgttttctcatagccatcaggaaaacataaaccatagtaaaacctgttcacctcacttagcagtctctttctgatcaaatacgtttggttgcgtacacatcctagtaatgccagggttactttctactagattgccacagatgaagacagcggaatcctcctgtataagggtgacaaagaccatatcgcggtagaactctatcgggggcgtgttcgtgccagctatgacaccggctctcatccagcttctgccatttacaggtgaagatctctcagttacgggtaaaggtgaaaaaaattgcttaatgaagaactgcttctcctctatcattttattatggagaggagagagactaagttggccccagcaggttttaggatgagggtattagtgaaaaacctggcaggaacagagggcatactcaaactggagagtgtgaggagggatttgtaaggggactgctatgcacaaagaggtgactgggatagtatagtaacctggggctggaaacaagggatgcagggaggtgttgctacccatatgcctgaaggatcaagaggagggagcagttatggaaactcatgctctgtaaaggctttgtagagaggcttgcctgccagaagcctcgacctttaatagacgtttgcagtaagttctcaaggaaacaaccagcttttgaaatacacaacctcactctctttcctcccaacaatctcctgtctgtgttccccacgggccacactgcatgccgggaaagaaggaatctatagactctagtaatgtagcttgcacatgagcttcctggggctcagagctgggtaaagaaagttggaagggagctccagagaatcaaatgaagatatccagcactgtgagtaacttcaggttgccattcatacctcagaggtttattgagcacttactatgtgccagacctgtcctgagctttaaggaacaaagcccctgctcatttggaacttacgcagaataagcaaatggattcatacaatgttgtcttagggaatcttgaccatccattttggaagttttctaatgattaatgatattaataatatactggagacgtgaaatgggtggtattcgtggggtataatttttagtccttattgcataagactaactatcagagcccctctgttggaacccaacaccaattccctaacatcctgcagacaatttagctatttaattttttcacatgtagaaattcaccctttagagaagggatcacaaactcctaagtagtcaatttttccagataagtaacataaatgattaaagaggtcaagtgcaagaaaataatatgctctcacccttttattctgtaaaagatctaaatttttacataagtattattttattataaatagccttgatgttggcaatataaaagaagtggttgtgactggaatgaaccaatagtaaatatttgtcaaaacaggatttcatctactcagttcttcgtggagaaaatatggacttaggtttttccaaactcttgacttttcaggaaaaaggcagaaatctggggtttttttaatataaattttctctcctttagatatcagtgtgcatttttaatactatatataatgaacaaaacatatctgtaggtcagacacacttggcaacaaaagaataggcattgattatgacataaagtggagacactggcctgcatgttattgatattctcatatgtatcaatgtgctttaaaagtctgcacatcttatttgatgcttcataatagttctgggaaagtacaagccacttgtagccatgaatggaatttgatatccaccacttgtgaatatttggagcatggaaacaaacacataattattggtttccaagttgaatacaatacttattttatctccaaatggtgatgaattagtgccaagattttagatattacgaggccttaaattttcttgcctcaatgtgtttcagcccataaaaagatttcagaaatttgtggttcattttttttaatttttttttaatttattttatgtaatggtgcagcacagaactctcagaagccatagtaaaggtttttggtttggcttattaaagctagcattcatatcacatatggcaaaatatttctaaatactttgtagaaacccaagtgattatatccaaacaaggacctaccataacgagtttgtttgagtttatgttcattgccatttcacctaacaaaggatggagtgtatcttgtgacatttataaagggactattatgttgcattttttttttttttttttttttttttggagacagagtctcactcagtcacccaggctggagtgcagtggtgcgatcttggctcactgcaagctccgcctcctgggttcatgccattctcctgcctcggcctcccaagtagctgggactacgggcacccaccactatgcctggctaatcttttttgtatttttagtaaagacgtggtttcaccgtgttagccaggatggactcgatctccaacctcgtgatccgtccatttcatattctttattagaagctgcaagcccatgtttctggtggtggatcatctaatagagatacaaaatgtgaggcctagagcaaatacagctttaatttaattattgccttttggcttatgaccaaaaaaattttcttgattttccaatccagaaaagctatgaccttattttttaataaaagaggcaacaattaccaagaattcagatatgtagatatgtataatacattttattaacatattaaatatagaatattatttttatattgagaaaataatataagaaaaaaggaagaaagaaaggaagcaatgaagaaaaaagaaggaagacaggaaggaaatgtaaggaagaacaagttcaaaggagataaatataagcacttacattttcatgtatttgcacaaagaaaaactagacacaaagaaatagaaacaagacttctgcatgaataccattttatatccatttgatttttgagccatttcaatgtcattaccactcaaaaataaaattgaaataatagaaaaagctgctgttctagagatagtctggcttgattcaagtccagctctgttatcaactaactgtgtgtcttggacagattgcttcagctccctgggcctcatctggcaaatggggataacaaataatagtgtcctttttgtgagattacggtaagaattgtacgacatgataaatgtaaaatatttgcaacaatgctaggtaaaccataaacaatgatggctactggtatcacaaattcaggatgtccaaaactgaatttatttcatttgcttcacccaaacctgtgttcccattgcattccttctttcattgaaaggcatgacaggtgcaatggatctactcttaatcctctcctttcctttaccttcaatttgcagttttacataactcttagctctgatacggctaattttttggccttttttcaaatgccagaaaatgccaagcaaggcaacctctgtcctgggccaggcctttactacagtgtaaaatctttgatgaaagatagtacttctccatccctgtagtaaaatctatcaataacagtgttgcaatcagctgtcccattagttgctaataaatattttgtctgggtgaagtacattttcaaattttgatttgtttccacttaagttcagttttattgccataattctatgttatataaaatttactttggtaaaacattgttttccaaattttgcattatttaatatattattgggccttgcacttggaaataattttatacctcaggtgcatcatttcaattgcctgcttaattctccacattgaagaaaattgattttattttagcaaaatgaaacctaataaaatgaggggaaagtaataatacacttattaattctatagggtatttttggttaaaatttattttatatgtcaactattgtttcacataaatcagtatgaagacaattattttatgaaattatctctagactggtaatttgctgcccttcaaaaagactttcttttaatctagataaggggaaacattttttacaaaagttaatgaaaaatatgtgcttctttctttaaattcaaattaatgtcattttccaaaccagacagcctctttgaaaacacagccaactatgttaaaagttaaaagacagtagttaacatagcttgaagtgtgtttaagaaaactcaagatgtagtaattattcttttagcgtagaaataaagtagtatgcatattttctcatcttatctgttacatctggatagaagatcatggcttcttgtagacatgcctgctgttaacagcaccaagcatacaggcagtagtgtagaatggttgtttccaaaagtctgcattggaatcacctgaaaaacatgttaaaatacaggcgttgggcaccacccctagtttctgattctgaagctcttagctagacccgaaaatttgcatttttaacaagtttccaggagatcttgtactccagggactacactttgagaaccccttgcgtaaaaggaatatgtactttgagagctgattgtctgcatgtcttctcatatccaagttctacaacatcatgcttgatgctcacattgaaatcagccatattgggaatattcgcaccacaaaaatcagcaaagcctacaaatccaggtttttgttcttgttttttttttaacagtaccagttgttaaacatttgccagcaacctactgcctaaaggactctaaccagcaacatagatgaaatgagctgcctaataagggaatggatttggaatatggcgcacgggcctaatatttacagcacttagagaatagcataaagagggacttagtaattgtattagcctgttttcacactgctgataaaggcatacctgagactgggtaatttataaagaaaaagaggtttaattgactcacagttccacatggctagggaggcctcacaatcatagcagaaggcgaaaggaatgtcttacatggtggcagacaagagagaattgagaactaagcgaaaggggaaaactccagtaaaaccatcacatctcgtgagactcattcgctaccatgataacagtatggggaaaaccgcccccataattcgattatctcccactgggtccctcccataacacggggaattatgggaactacaattcaagatgagccaaaccatatcagtaatagtgccatgaatgaatggaaaaatgaatggcagcctaaatttaagcagtaggtcctcagacagggctggagtattaaatttttattctcaagtaggctaataatctgctctttcaaagtgagtttcttttcatctagaaaaacataaactttttttaacaaaagttattattgaaaaatatatgcttctttttttagattcaaattaatgtcattttccaaaccaggcagtttctttggaaacacagctagctactgtttaaaaataagaaaatcagatggaccaccttactagtgtacagtttttcatatttaggcaacctgctcaaattcaggggactttctgtcacctactgttacatttggttggctacatacactctgggttgtgcaatttacaggcttacatttcaacaaaaatacaaaagaaactcaacaaagattatctttgtatctgagaagttcagtctcattggggagacagagagtagacagaatctatatggtattcttgttttcaagatgtttattcagccattcttgatatgccatatggaaagttccccctgtttactagcttataaccttgggcagattgcttcatttctttgtgctttattttccttatctcagtaaatgcaattagctctgcttttcatgtttggttatgagaattgaatgaatgtaaagcacctaacatcgtgcttggcacagagtcggctcacgatattgagtaatgctgatgattcatggatactcttcctgctcaaatatctggatactgaagaataaatacccaagtgggaattttatagcctgacatctcactgtacagtatgttcaagtttagagaagcctttctagtttagtgaattttattcatgttaatctgttttaaaagtactgattaaaatattacttgaacaactattttctaaagctttcttttgaaaaattcttacaggtatatttagatatcttttctttttggagacagagtcttgctctgtcgcccaggctggagtgcagtggcgcgatctcggctcactgcaagctctgccacccgggttcatgccatcctcctgcctcagcctcctgagtagctgggactacaggcgctcacccctacgcctagctttttttgtatttttaatagagatggggtttcaccatgttagccaggatggtctccatttcctgaccttgtgatccgtccacttcagcctcccaaagtgctgggattacaggcgtgagccactgcgcccagcctacatagatatctttaatctcatttggcttcccattccttttgactaaagagataggcaagaatacttttagtatcactcccacttcacaggtgaagtatcatcaggccagaaacaccaaaatgagatgaccagttgagtttgggttccagttcctattccaaagcgtggaatatgtcaccagatactttaattttttttttttttttagatggagtattgctctgtcgcccaggctagagggcagtggcacaatctcgcctcactgcaacctccacctcccgggttcaagcgattctcctgcctcagcctccagagtagctgggattacaggcatgcactaccatgcccagctaatttttgtttttttactagagacggggtttcgccatcttggccaggctagactcgaactcctgacatcgagatccacccaccttggcctcccaaagtgctggaattacaggcgtgagccaccgcacccagcccagatactttaaaattttaaggcaagaagttgaagctcacataaggaaaaacagtcttttattaaactacagaaatacattatgtttatcattgttagtgtgttgtgtgtatgcaaaatagagaaagaaaatcagagacattttaaagcccctcttttaagccccaagtttctgaattatttttctgtagcagaccacaaacagttggggaactgctttgttttcatgtatccacttccagtatataaactcaagaaaacaaatctcaggaaataggtgagcgtagtaaaactaaaccttatagtaacagtaataaatgcaattcaaattcccagtggaaaggcccaaagttaagtggttcgcttgtagtttttgtgaatcataaaatatattgttccctagggagtggtgaaagagagtttatcaatacttatcagaacccaaaaggatgccatgcattacatgtgggtatgtaggagacagctgctatagactgaaaagtggattatggctttctagctcaggcagtcttactatgtagcaactgatgtgtcgatcactgcttttattttattttatattttattttattttattttattttattttattttattttattttattttttgagacagagtttcactttgttgcccaggctggactgcagtggcacggtctcggctcactgcaacctctgcctcccgggttcaagcaatcctcatgcctcagcctcccacatagctaggattacaggcacccgccaccacgcccagatgattttgtttgtattttagtagagacagggtttcaccatattgcccaggctggtctcaaactcctgagctcaagcaatccgcccatcttggcctcccaaagtgctaggattacaggcgtgagccaccacgcctggcccactgctttaattttaaacgaatgtgtagacaaaggattcctggacatcctccagtttatctcatgctagaaaagacagcaagaaataccaagttagaatgttattaactctgaaaaattctctttaggtcccatgtgtaaaatactatcttaaaaaccaaattggccagtcatggtggtttacatctgtaatctcagcactttgggaggccaagccaggaagatcacttgagaccagcctgggaaacatggcaataccctatctctacagaaaaatttaagaagtagctgggcatggtggcatgcagctgtggtcctagctacttaggaagctgaggcagcaggatcacttgagtccaggaggctgaggctgcagtgagccgtaattatgtcaccgtactccagcctggctgacagagcgagactctgtctcaaaaaaaaaaaaggaatctaaaatcatgaactttactgtacttacctgttaagaggtcaagatgaggcttcatttaattccagggagatataaatggaattaatctcaatgataagtcttgtggaagttctggtgtgatcagattagacatttaaagcttttagggagagaaaagtatagtcagtctatctcactcataatctcactcataattgggaaaataaaatccaaactcagtttttaaatccatataatttatatgcattcttcaaactcttattgtaagatcattacttttattaacaattcagtgttttttagtaaatgaatcaagttttgctatcatacaaggtaatttactatagaactttattcccaggctatttgggacagaaatcatgtattaaaagcttgttagtggtgaaaacacacgccatttgtctaggaataggtattcctcaggtttttgattgtaaaagtagtgcataataattaagagcacatacacttgagctggacaacctggcttcagaactgtttagccactaactagatgtgtcaccttggatgtcctcagtgctcacctcttgttgtgaagcttacatgaggtaatacttgtaaagttcttagtacctggcccttagtatgtgatatataatcctttgctcttcctatttgcacttctcttaaaaggaagaaaaatcacctaaggtcacactaaccaaagatgacatgtctaatgagagctaggacaagctgagcaagatttatctctcagcattatccttgacgatactgccactgaaacttccaactatgttttatgaaatgaattttcagaggtcttgtcttaaacatgcttgaagtgtaatgattatctatagatatcatctaggagtattgctaaaaacaattgatatatgttattcctaatacatctctcttgtatttacttaccacatattttcagaaataaataatacatggatgatattttaaattagcttacaattagcaagagtttaagacatgtactccaaaaaagagtaaaaaggaacagaggagggaataaaggagcaataagcaaagtgagttgatgatgaaactacctacctccaagttcccatctgacacactgcattagggtgtttaaaactgtaaagtgtgttaacttaaaccacacaattgtactgcatcaaacaccatcattgatgatgacatgactgaattgactaagaccaatatgtgaccaagaatccattccttggtaatatatgggtcttttctttgcaattttaaagagaaatggggggcctcattattaagatttattaaggttgatgttgataggacatccatataaaactacttggaaagctgtgtataacctcaaagtaaaaaggaattcacttctactctctccatgtctgtctttattttaatgttttactttaaaacttttagtaacttgaacaagatgtgcccccaaagaagttgttatatttctgccagcctttaacattatcttacaatcaatatttaaaataaagctaaattctttactaaaaaagattcagaaatggtattgaattatttgtatcatgatgatcgtggttgggtgggggaccgatatgatagtgatggtgatactaatatctaacattaatttttgctatgctgggtatctttcagtcattttacatagtcctcaaattaaccatggaaggcagaaatatttattagcatttactgaagagaaaactgaaatatattagtaataaagtaacttatctaaaacaaacacttaataaatgcaggaccacgattcgaatccaggattatctgactacagagtctatatgcttaaccattagccaatgttactacttggcataccctcttagaagagagtcatatttaaaaccactaatggtgtgcaactatacttataaaataattttctggtctattttttcctctgccaattgtattgatgttaagtgttaggataattaaatgtgtaaaaggcaaaaatattgattgacatatctaacatttagttttataaagttgtttcctgagacaggctatcaaagattcctgtacacgtggactcttctaaccacctaaacagaaagaatgtcaagtgttttcacaattctgcagagtgatttctcttgttctcaaatcaaaaaaacgttttattacctgtcagcatacaacggaagatgattagactccagtggtgagaaccatgcagaaatatgttaatgcatttttctatcattccctagactttgccattttacaaatttaaatatcagtgcctagaaatttaagcagtcatcttgtatacagagtattaagtattcacatttaggaataatctatcacatgctcccatgtttccatgttggagcctttttcagtcttcccagtatcccagcatgttagatctttaataatcaccattaactttttgatctcaacttccattatgccatgtttttcctgtatagggaaaggtaagtacgttcttaacactgcaccgtgtattggtcctatttcttctttggtcctgtttcattggtctggtttgcttttttgcctgctgtaacaccagagttagatatgcaactacactttaaaaccatgtaaaacatatttactaattgcactcaacttcatcttattttttaatcctcattttccatttacctttcttcatctttttgtctttattcacttcatcaatttctataagcccttccaaggtttttagaaggtgacagtaataattgttagacctggcccttgaaaattatagaaaagaatccagacagccactgtcattgcaatatttcctagatatcactatgttaagcattttatttaatctgttattcccatgtctccactgagcatagataacttcttcacagcaatatcagttgatgaaaatgcacagaaagtaagaggatattattaacaaatttcaaaaagtactgagatcccaccaagttgtttctccttgcatttgtgtgtgtgtttgattctggtaagtcctaatctacagttttttttaagagcagaagccagcagttgcctaaggtcgatgtgttagggtgtttttggcacaggcctagtttccttgtcttttcgtacaatttgaagtaatagtatcttggtaaatggaccttttatggaagttaaaagcaaatgtataaattatcctttgaaattgttacatattgagagaatgtggctggatgatgatgaaatgtagttatttctacttcttgtcataaaagaacaaacttattttgtattcagttcctgagaaactgaaatcaatcacatctccttgaaaatgcctatttttgaaaaaaaattcaactactcgtctttatcttcattagtgttagattgccatctcttttcccaaggagcacttatcaaagtttgtaatttaactaccttgctttaatgaaaagaaaatggaagaatcagccatttttttttccgttgtagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggtaagctgtcttccaaattcaggtggtcctgaaaccctgtgattctcattatggacgaattctgaagtttgttaatgcctaatatatcaggatttgtcattgaccaatagtgatcaatcattgaaagatggatggcaaagacagaacagaaagatctctaggtgggtgttaagggatcattttattatcccatctctctttctaacaaatgtgtcatctgggtagagaaagacattaattaatatttcttttgtgtcaatcacatatgctaggtgatttatacattatataatttaatcttatatttgatctggtctatggaaaaggaaagttggttagagattaaatcatacaatcaagaaaatgataaaacaagcttaatgcaaactggaaagtagatgaccccaccccagctcccttaaggaggcaaaccctatcagctcagtcaaatgttaccatgctggagcttctgcactaccagttgctaattcatctggatgataggataagtatcactgtaatccaatgactgactgaatgaatgaatgaatgaacaaattaaatgtacaaattgtattagaataacaataaatagttctgttccactaagaccttaaggtgaatgaacaagagagagggttggaaaggtaggttaggacttgaaatcatagagtgaagaccctgggctttatttttaagtgaaaagaaggcagatgagtgaataaatgagggacagagatataagcaaagttctgtaggagcccatcggagaggacccgcaaaggagagaggtcccaatcttgcctctatttggaggaacaaatataaactggaggcatagagtttcaaaattctggtaaaggagccagaaagcagttaatgctgaattgagaagcattggattaaattacattgaatttatttgaattgactgattaacttattttacagataaataagtaaaagctttgaacaggttagtgtacaatttcatcaccatgacagatattttcatgagtttcacatcattttctgaaaaataataacctatgctacaccattatctcaaccactcaaagccttcttttcagtgcctctaagcctaggacatttctgttttaataatttcagtagtagacagtcttaacattttgacagagttggattgttttagaaacagttggaagtctttggttcaattctgtaaatatttattgagtacttaccacatactaggaactaagtaaatggatacataaaggatataaagttgaagaagaaatgtccattctactccctaaaaagtcaagaatgcagaggcatcttcaagtaactataatgcattataaataaagtattgcatagtgagtctactcagcaagttgacttatctgattgcttcatgggaatcacagcagagagtctcattaaaaaccaaatcttccattcttgccagcactccagtttacagggttgcttttggatgggtgaagccaagtcacaagcatacctgtgatttgagagaaaataaattatatttattgagcacatgctatgtgcccaacacagtgctccttttatagccttaatgtgcagagatcttaggaaataggtatgattttctctgttttgtagtccctgaagagcaatctcaaggattttatataacttgtccaagtacacaaagctattatgtagtagacacctcatttaagtccagatctggctgactccaaagccacctgcattgccattcacttcttcacataaagcagaaagggaacaaatctaagtgctgtggccttttgttgtttatttatggacttttcgttcacttgattttattatgttttcattagaatccacttcattaaatctttcgaagcccctttagaatatagtataaaaccaattttaaaaatacagggggctgggcatggtggctcacacccataatctcagcactttgggaggctgaggagggaggatcatgtgagcccaggaggttgaggctgcagtgaaacataattgcaccattgcagtacagcctgggaaacagagccagacactatctcaagaaaaaaaaaaaaaaaaagaatacaggatgagactgtttaagtcagaacattcccccgccccccgccaaaaaaaaaaaagaggaaaaaaagttttaaatttcaaaatgaaaagtatttatccttctgaaggtagagggcctggaaaaattcaaacaacacctctgtccacccaggcctcaaggaaaccactttcatcccagtcccactgccagagatcaccatgggcccactttctccccgcttagagtgcagtctcaagggtgactcagattttcaaaccacaaggaacctgtaagaccacagccttgaatgctgtatggcaaaggcatgagaagcagagggagaaaaggagagcaaggtaactaagttctctttaaaaatagtgactacagctgggcgcggtggctcacgtccgtaatcccagcactttgggaggccaaggcgggtggatcacgaggtcaggagattgagaccatcctggttaacacggtgaaaccccgtctctactaaaaactacaaaaaattagccgggcatggtggcgggcacctttggtcccagctacttgggagactgaggcaggagaatggcatgaacccagtaggtggagcttgcagtgagccgagatcgcaccactgcactccagcctgggcgacaatgggagactccatctccaaaaaaaaaaaaaaaaaattatgtctacagtgagataccatctcacaccagtgagaatggctattattaaaaagtcaaaaaataacagctgctggcaaggttgtggagaaaaaggaacacttatatactgttggcagaaatgtaaattaattcagccattgtggaaaacagtgtggcgattcctaaagacctaaaaatagagctaccattcaacccagcaatcccatgactgagcatatagtcaaaggaatctcaatcattctatcataaagacacaggcatgcatatgttcattgtagcaccattcataatggcaaagacatggaatcaacctaaatgcccatcaattctagactggataaagaaaatgtggtacatataaaccatgaaataccatgcagccacaaaaaaagaattgagctgatgcccttggcaggaacatggatggagctggaggccattatccttagcaaactaacacaggaacagaaaaacacatactgcatgtttctcacctataagtgggagccaaatgatgagaacacatggacacagagaggggaacaacacacactggggcctagcagagggcggagggtgggaggagggagaggaccaggaaaaatcactaatggacattaagcttaattcctgggtgctgaaatagtccgtacaacaaacccctcgtgacatgagtttacccggtttgttatacggtaacacataatacactgttggtggggagtgtaaccctcatatacccctgaacttaagataaaagttaaaaaacaaaacaaaaaacaaaaaaaaccagggatgctgcccaaggaggactgcctgaaggtgttgcctcagcatctggggagaggcagccccttggtgagtatatggagaggcagcttaacctacccttgggttatcaactacccatgatatgtgctttacttgacacaattttttttgtttttctgagatggagtttcgctcttgttgcccaggctggagcgcaatggcacgattttggctcactgcaacctccacctcccgagttcaagtgattctcctgcctcagcctcccaagtagctgggattacaggcgcctgctaccacgcccagctaattttttatacttttagtagagacggggtttcatcatgtttggcaggctggtctcaaactcctgacctcatgtgatccacccacctcggcctcccaaagtgctgggattacatgcatgagccactgcgctcggccgacacaaaataatttagttttcatgtttttctgtctgtagtccaactgaacccttattacctaatggggaagaaaatcaaaaaataagccccatgcatggaaatccatgtatatgcaacaaatgtcctccttgtcctgccacgggacagaggacctaggcttgatacttggtctctttattgccattttgaggcctgtagaaataaggctaaaagctgtttgctaagttatctgttggttgattgattgattggctgattgattgaatgatttccaactaggccaatagcatagaggaaaggcttaaaaaaaatcatggatctggccaggcgtggtggctcatacctgtaatcccagcactttgggaggctgaggcgggtggatcacctgaggtcgggagttggagaccagcctgaccaatatggagaaacctggtctctactaaaattacaaaataagccaggcgtggtggtgcatgcctgtaatcccagcttctcgggaggctgaagcaggagaatcgcttgaacccaggaggcgggggttgcagtgagccaaggctgcgttcatggcactccagcctgggcgacaagagtgaaactccgtctcaaaaaaaaaaaaaaaaaattcatgtatctacttctgtttgtcaatgaagacctagcacgtgaaaagattgactcagaataattcctgattttatgatagcctattgaaactcaaatatacgtatgatgtctaaacattttcatttacaaattactctagtcaaagctgggctttttctaattgttagctttggaacaaaaaggaacagatttactaattgtttctctgtgctgtggaactttgccaatctgtatttattcttgacatgtgcacatatgtgtgttgtgcctatatcaaaatgagctattaaaaatagttttggaagaagttcatttttaaccactgaaaaaaggaccataaatatgtggtcattaaagtccttatgatggatggatatggttaaattagaaaaacttaccccagggcaaggaattttctgtcaccagtcctttcctggaaatggtaagtttcatccttttgaccctgctctagaaagcaacccacagcgagatggacatagactaaaggcctgtactcacagaacttcacagccaagagacttcattcaatacctgtcagagtgtaaccatggactacccaaatcacctgagctgcatgtagatatttagatttctgcacctctcctgttcctacaggatcagaacctcagaaggaggggagagaggagcctgtaaagctgcctttgagcatgcactgctgttggttcttatgtatgacaaacttaggacaacttctctggtccatatgctcatggtgtatagatgacaatactaagccccagagagaagaaataactgctccaagtgcacgcagaaccagaaatccttaccgtataacctagtggtttcgtacacctagctgtctgactgatgcctgctttgaatgccaatggatgagtcatttcctatgaatgggaaaggagaaggtggcataagttcagacccagagtgtgctacagttcttggtctttagaaccaacagaccccctgaagagtgagaaactgggtcttcctcagcctagaacttccagccagtagtccagagtttaggcacagctaaagcataattacggggttgtggggatgtggtggtatagccagcactctgaaagcttccagcaccctccccccttccctggatgggtgccttctgcaggatgccttccacggactaagggtctggcttaggccatggaaagattcttccgttttgccaaaatgagtgttaccagataactgtcactagtggaatgtatatatacaaagattgcaaatactctgtttttgaagggatttcatttttatttctgatttcttggactatgaagtcttcactcttaattagcaagaaagaaaaaatgatgtgaatgaggtgctgtcctgaaaagaatcaggagtgagtttttaggcattgacatcattgaccaagcttagggacgttgccaggagtgagctgaattagttgctaacttcgaatgtgggagggctggggtgaatggtcactgtgaaccccagctgtcagcccctgaaacctggtggacctaaccctgactccagagatagaggagttcttctcatcagcctaactctaacctgaactcactgggtcaccttgagcatgtcaccagggctttctgagccctagccccttgtctttaagataaggggtagaattagagcaccataaactgagctttatggagctccagacttccaggagtgtgtgcctggaggtggagggtggaggacaaacagagagggaacattcccttcccccagtcttgcctttaaggacagtagctctgcctctaggttttatatatttgtgtacatgtaaagttttctttgaagcaaattttaaagattaaccaccaatcaactaggtattttattctagttgtggattagaatttcctggagcatcttccaatacagaacaaaacaaaaacacacatctctacatctcttctccacttcacttccctaccaccctgcccaaatatcctgccataataggttggcagtgaggtcccaagcatcagtatttctgagtagcaaatggctcagaaatccccagagagcctgacctctgacctggtgttcctccccaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataagtaagttcctgctgcttgggagttgagcacacacctgaaagcctcaaagccaaaccaaaggaaggaaggaaagaagaaggggaggggacgggaagggaggggaggggaggggaggttcgttaggcattagcactctgtccctcatattttctcaatcatcctccattcttatatcacctccgttcattcttacctcctcttctgaatgcattcccactcctgtgttcctcctccctgtagatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgaggtaagccagccccactgggcacctcattctcttggcaaagcaagaggggtcccatgtctttgaaaagagagggagaaaaagtgaaaaaaaaaaaaaaaacaggagcaacagagacagagagaggggagtgacaggagagaatactaggtcttctcactacttgcagttgctgctattgatttattttcaagtattttgaaggcaccagctgtgaaatgaccttaaacctccaccgcaagattgtatacagccttcagatgcttctcacaagttgatttgttgtaaaagaaatgctcctttttacctgatggagaagcacatttactttactcctgtcttacctttaccggctgttctcatccgtatatattattaattcatcttctggcacagagaagatggtcctcttaattctgctctagttttagtacaaaatgacctttggccttagaatcgactgatttatcacagcaaatcatgtgggtgagaggaacggaaacaggctgacttcttagttcaccttcctccttctcctttgtctgcgtgatcagagctcgcctggcctccagctggcacggattttgttttgtgtgtccaagggacgagacaagaggaacgtgcccatggaagcttttagcagatgtctcttttttgaactacatacttcatactggggtaatttatgaagttaatggaatgttacttgtattaagtaacagattggataatattaaactccaggtctaataaataaaatggcatactctctgaaactgctccctgtggtaaacaaaaccagctgttagtagtgtaaaaacagaagatgtgtactttttttccttttttgcaatgaaagaaaatatttaggaatccaattttcttgtcactgcaatagcattgtatttatactctacataatagcattcactttgctgaaaatagagactaaaaagaagtatttttcaaagaataggaggccgtgccaccagctaataatatgtaaagcaagttacaaaggggaagcaaaggcttctgaattaagttgtggattcacagtcactctgcatgacttacagtgactgttcttaaaatgcttgtgctttttgttcttttctagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttg

SEQ ID NO: 37347 - DNA, 13226 bp, Homo sapiens
gattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattcaaaaggggggttattggacttagcaccacagtaccaatctttaatgttacgttagtactgcagaggaaataacttggaagttacagggaataacaataggtactagaaattgagtgctatgggtacgtattagatcgttagctcatttagtatcacataacactagcataaactgaaagtattgtaaatgtacagctctttggtttccgtgtgcagatttccaagttgatcgtgatgttgatccgggactcggtgtggtgacggcccgccctgagcacgaaagtgcacgctcttgacaacttccttatgtttggagctttctccaccaccacccccgcccattttcttgtaaaatttttaccatgcagatatgtaataactgcaagtaaaggctgaagacaatgtgagctgaacacggaactattacaaaggtttctgatttgttttgtaattgggccagtttctgtctgaagctcttaagcgagtggggcagggaaaggcggatcctaggcgctgaggtgcaggaaaaagaagcagcttctgagacaccttaaaattcttttgctaaaccgtctttttctgaaagtcatttaatttataggtttttttttttttttttttttttttttttggcagctttcaggttaaaagtcctccgggtaacggcagaaaccaaatagtcaatcattaaggtgcctgactgcacgtaggcaatagttatcgcaggactgaagccccctttgcagtacaatttatcctttcctagatgcccctgagtacggaggactggaggaggtagaaagggaaagaaaacctccttctggcaggatgtagcttctgctgcacaaggtaggatgatgacaaaaggttttcactgctggggaatggatgattgcgggagaaaaagaatctcggaaaagagtcgggagggaactaggagggagtggccagaaggaaaggaacaaatacttgagacgtgaaaaatgtgagatggatgaggctaggtttggagtcaaatgttggctgagagggagaatttaagtgatggatggatgatcattgtctaaaagaggaatgaatttagaagtttgtcctcatgccctcataaacaaacacgaaatgatggattatgggatacattttccataacatggcaagcgtggtacttggacggataaataaaagcctgagtaatattttctaaattcttaaaagtaagaaagagggtctaagaaagtaaactcagagccagggacttggcccatgttaaaccccaagcactacagctggcttttactcaacccgtggaaactgaccagggtatagagcctgatatatcttcttaggtgaaggtgagacaccagacctaaatctgtcatctcaagagtagaaggatgaaccacacatacaaacccatcacagatgaatgcaaataaaaaagtcagctccgaagttgggttctgagcagtgtagattctactgctaaggcttggactacaagccatcgatgcttacttgttcctggcattcataccatagggattcaaacacccaagctgagaatttaatttaggcatatcccaggctggttttgtgcccctgagcacccggtagaaacaaatacaagtcatctctggaaaagaagcttcattttacacctcaacaaattgccacagctaaaatatccccccaaaaatgcacaaggagcttcacaatctaaattaaacatcatgaaactagaagtatgactaatgaaaacaaaagcaacagacaatgggagctgggcgtggtggctaatgcctgtaatcccagcacttcgggaggctgaggctggaggattgcttgaggccaaaagtttgagatcctgtctctgaaaaaaaaaaaaaaaaaaaaaagcaacagacaatggaaatgaaaagggagaattaacaagatacagacttgaggccaggcacggtggttcatgcctgtaatcccagcactttgggaagttgaggcaggcggatcacaaggtcaggagttcgagaccagtctggccaacatagtgaaaccccgtctctactaaaagtacacaaaaaattagccagtgtggtggtgtgcgcctttaatcccagctactcaggaggatgaggcaggagaatcgcgtgaacccgggaggtggagtttgcagtgagccaagatcgtgccactgcactccaccctgggccacagaatgagactctgtctcaaaaaaaaaaaaaaacagactcgaattgactagtgtctttttgaaaaaagaaaaagaggccaggcacagtggctcacgcctgtaatcccagcactttgggaggctgaggcaggcggatcacctgagctcaggagttcgagaccagcctggccaatatggtgaaaccccatctctactaaaaatacaaaaatcatccaggcatggtggcatgcacctgtaatctcaactactcaggaggctgaggcaggagaatcgcttcaacccaggaggcagaggttgcattgagccaagatcacgcaattgtcctccagtctgggcaacaagagtgaaactccatctgaaggaaaaaaaaagaaacaaaaagtcttataaatatattgagggactaaggaaataccaaaagtgaccacatagatttgaaaaaagaacctaatagaaattctagaaaataaacatgtaattataagacaaattgaaatgaaaagcttactgcatgtgtttaacagcagccaattggacctaccggtagaaatttaataaactatgtaatcagatcttaaggaattatctgaaatgcagagataaaaatgcaaaagtgagtttaagaaacctggaattagggctgggcaaggtgactcatgcttgtaatcccagcactttcagaggccaaggcaggaggattgcttgagcccaggagttggagaccagcctgaataatatggcaaacccccgactctactgaaaatacaaaaaattagccaggcatggtggtgcgtgcttgtggtcccagctactcaggaggctgaggtgagagaatcacttgagctagggaaatcaaggctgcagagagccatgatcacaccactgcactccagcctgggcaatgagagtgagaccttgtctcaaataataaataaataaatgaaaagagacctagaattagtagtaaaatatgatctgacgttgacctaatcacagtaccagaagaaacaatcagggagaatgatgcaaatgtgagatttaaaagatcatggccaataattttctagaatggatggattactaataattaaaaataatataagaaaataaaaattgaaacctaatgtattgctcatcaaagcaagcctaggttaacaaagtaaatatttaaacagaaaaatgatacaaaaaaagggagtcactatgtgtgctgtgaattaattaagctctccaaatttttacagatgtaatactgattttcaaaagattgtgacttctgttacatattgacatatgacctcacactaaagcactgtttgaaattctgcatgtaggaggataattggataattggttatttacatgaattttgtgtctagctaaccttatcaaattctattaatcctaatcaatagtcgactgacttgattttaattgcatatagtactattagcaaataaaaatgttcgatattctctcccataactatttattgtttgctttaatcatcttactgtgctagctaccatcacaaacaatatgtcacattagacatgctaccaggtattgtctttttcctcctgttcatagaaatgacttcggtggttgatgatttataattgcttttgtgtgtatgtgcatggatgtgtatatgtagtcttcattgtgttaatgtagtttttggtttttgtttgttgttgttgttgttttgagacagagttttatctgttgcccaggctggagcgcagtggccggatctctgctcactgcagcctccacttcccagcctcccgcattcatctcagccacctgaatacctgagattacaggcgcacaccaccgcactcggctaatttttttgtatttttagtagagacaaggttttgttatgctggccaggttagtctcaaactcctgacctcaagtgatctgcccaccatggggtcccaaagtgctgggattacaggtgtgagccaccgtgccgagcccggtagtttccttctaatcttcttttaagattttttattaggtatgatttatgaattttattcgatcactttgacttctgaagaaatcatatgctttttcttttttaacctgttgccatgaagtatagatagatttctttgtgttgattcatgcttttattcctagtccaaatcttatttggtcatggtatactattattttaaataatacctgggtaaattttgttaatatttttcatgatttttttccatttctatttgcataaaatcattctatgattttttttttcttttagatttagtctcgctctgtcacccaggctggagtgcagtggcacaatctcggctcactgaaacctccacctcctgggttcaaacgattctcctacctcagcctcctgtgtagctgggattacaggcatgaggcaccgcacctggcccattctattatgttctattttgggcttacctttatcaagtttcattataaaaattatggtagctctataagcttaactgtggggctccccatgtctattatgttatctattgccgtgtaacaaattatcccaaaactaatttctgtgagtcgggaatccagaagtgatttagctaggtggttatggctccgggtcttccttgaggttgaagtcaagctgtaaacataggctgcaatcatccgaatccttgactgtagctggaggattcccttccaaggtggcacactcgcatatctggcaagttcaagccgacttttgggtggaggcctcagttccttgcccgttagacctctctagaggggtaactgattatcttcaaaaccaaacaactgttttctcttagcaggagaaaaaagaaagagaaaggggaaggaataagccgcaatgccttttgtgaacaagattcgaaacttacacacttctgccacactttttaaacgttatttatttatttcttagagacagagtcttgctccgtcacccaggctggaatgcagggacctgatcttagcttactgcaccttggaactcctgagctcaagcaatcctgcctcagactcccaagtagctgagactacaggtgtgagccatttcctccggcacatgttattcaatataaacaagtcactgaaatctggcacatacccagaagtagaattaagctacaccctttcagataagaatagtaaaagaacttattgaaatattccaaagccaaaaatgtggacattgaccccaactgcaaaaatacctcagcaaattccaaagtcttgaagacttctgagtagatccccccgtgggtgaggaggccaaccacaagcaacactcagtggtagcaggaggtggcaggggtgagggcaggaagcagtgcccctctcagtctcccagcagacctgccaccatgatcagccagccctctataccacccactggccagcccatcctggaagatgccaagtggacaagccagcactcagacacacagatttgggaaagtgaaaaaccatttagccctggggcttgaggcagggaaagggatgggatgggcaagaagtgcatggccatgcccagtcccaggacagggaacaaaaaaggacaagcctggagttattaggatgggcctttgtactgagtagcaatgtgtacaccatttgggctatcagagttcccctggacaggagcctcaacatccccttccctctcctctatgattctttacatcctaacttcttctgagaggggagagcaagggagattttatatatatatatatataattttaaattattgatagttcatctggattaccaaaatctgcagccctaccatagctagtaggctgcaaccctggtccccacacctaacatcttcctgctccccttccagccaactatgcagcccacaagaaggctctgcaggccccattgcccagcaccatcccatggaaggctctggtggtacccctgagccccaggagaaccggcaccttgatcttgtagggtttatcatcaccatgttctctctctgctgtccctaccatgcccttctgccatcttctgggagaaggaaaccaaaggatctaaaactggggcttgggggaagattctagcctctcctcactcccctctccccacactctttactccccagcccagagagatgctgctcatatcaggaaagactatattgaaagatgatttatgtttctctgacctttccatccctgggaaaatgggaaaaaaaatcaacaattaaaaaacaagaaatcagaaatcccccaatgaatccacagaaaatgatgtctatcctctccccttggatttttgtttttggaaatatttttaagttgccttattgtggagtgggaatccgaaatacccaaatgtctgttttccacgatggagagccaacccaaagagctcccaccttctctggatgtgcctggtcttggactccctagaatctttctctgggctgctgcatgtacacagcctctgtcctggaggcaagagtttgtggtggcttggatcagaaccatgcccaagatatccttgctattgcatcgtttgaagctgacatcctgtgtctgtacacagctgctaccgttgtgtccctgctctgcttgctattgcctcatgtcaggccccgtcctgccgtgacgtcctgcatcctacccatgaaaccccaaggccaagtttgtttcaaacttttggagaacaaacttggcctgcatctggaacatacttgttctcagctggaacatgtcccctaccccagagagaaaaggtgaacacccacagctgaggcttggaaatgtttcctgtgttgacctgaaagatctctgagacgtcaaggaggctctgtctctcttaaaaagtggagaaagttgccattctcctcctagggcctggtctcatcccccctctgtaagccatctatctctgcccaccctccaattgaccccacctgggaatgagggatgaaaaggaggtgggggccaggagggaaccctgccagctggtgaagccctgtggcaggaaaatagatgtggacatagagtatacctgacttctcttcttcagccactgactgggttgggctgtgaatgacaatggaatggctgaagtctgctgtcatcagaagctagggagggtgatgaaggactgacccacacagactgggatgtgtcttggatacagggataactccttgttcactctcagtgggatctgggcaacacagaggagtttggtggtcctgttgctcacttactcagtgtctttgaccctccttttcaactggttcctctgttgagcccaaaggctggaagtaggagacagtaccacaggctgacaaagtcttgcctgttaccttggcatctcattgcttttagcctgggcccttccttgcctttgacctcccagtggttagtatgtgggaagcccatttcagttcctatgacccatgtctcaaaccatggtctctgctatgacagtggaatctgaggcctttccctgctcagtctggtgcctgctctgcatcataccagatactggcctcctggaccccctcctccttccctttattccttctttccttcaggtcacgcagccatgtactgtatccagcaccacagaaacttcattgtttttcctatgctgcttctgggggcacaaagaagccttgggatgtgggggaaggctgttcttatctggggtttactcccaggccaggggggctgccatcttcttcacacacattcctcaaagaggaagcccctttggggcagggaggtaaggacttcatctcaacatagattggtggtcggcacgagcagagggggatacttttggctttttttttttttttttttttttttgacacggagtcttgttctgtcacccaggctaaagtgcaatggtttgatcttggctcactgcaacctccgcctcctgggttcaagccattcttctgtcttagcctccctgagtagctgggactacaggcatgcaccaccatgtccaactaatttttatacttttagtagagatggggtttcaccatgttgacgaggctggtctcgaactcctgacctcaggtgatctgcccgcctagccctcccaaagtgctgggattacaggcatgagccaccgtgcccggcctctttttttcttttcttcacattcttttctttcttttttttgttttctcttttttttttttttttttttttgtaaaatgataggagttaatgttgcaaagagtagtttacatattcaatttctgaagacacttgaatttaggaccgatgtatctgtgacaagcatgctagaagtggcaggggccatcagggctagctacttcatacccactatcctcccctggggatccaagacctgagacacaaagcaacagcctgccgagatctctcttttcatcatatctctttcaaggtttgtccatgccaacacaacctttgggcatcaaacatcagaaggtctgtgtgtctcagccctgttaaggggcaggtttctctttcacctgctcttgcacctgggaacaaatgcactaccagtagagaagggccatcagccctcccccagcctagaccgctggggctcagatagaggtgctaagcccctaggtcaaagttgttaaatatttttgtgttgttctatcagtccctttcctggtgattgattttacaaaagtaagtaagctgcttagaaggccctggaagtgaggagaagagccaaggaagatgactacggagggtgagggttgtttttttcaaaaaaggctaggtagagtgatctgaattatctggtaccctcctgaatggaatcctcccatgttgaagggtccttggattttccccagcccccaccctctcccacttcaggcacgttgatagtagaaaagataagaactcagagctatttctcattggagacaaaaacttgtcatctggctttgtagagaaggttgcaccttacgctcataatagattatctttactatgggctagggtatcatatttatttatttatttatttttatttttttattattatactttaagttttagggtacatgtgcacaacgtgcaggtttgttacatatgtgtacagggtatcatatttaaaaggacaaaaaaaaagcaacgtcaaatacttgaatgagcttgtattataacattaatattattgaaggtatctgctttccaggccaaattgattcatttattattatagtcctgctttagtcctttgtactttgtggtaattatgctttccttttcaataccaaaaaaaaaagtgtataaaaataaaaacttgggccaggcccagtggctcaagcctgtaataccagcactttgggaggccaaggcgggcagatcacctgaggtcgggagttcaagaccagcctggccaacatggagaaaccccgtctctactaaaaatacaaaattagccaggcatggtggcacatgctcgtaatcctagctagttgggaggctgaagtaggagaatcgcttgaacccgggaggcagaggttgtggtgagctgagatcacgccattgcattccagcctgggcaacaagaccaaaactccattttttaaaaaaaaaaaataaataaattagtaaaaataaaaatttgataaggcaaaaaaatgtaaaaaatttatgaacataatttaaaaccactttaccttttttatatttgaaatgcttggatgtaaaaagcatttgtgctttaaagactacatagaaatcaaatgtacaatcacctggctctgatacctttataaatggtagaacctttaagaatttcaacaattcagactaaaattgaccactacccacagagacaaagcccattaaaatcccctcataatatcctgatggacttttcccagatattgtaaaggacaaagtggtgccactacagtttatataaaacattatcccagcacatagcagctactttttaaaaaatatgcattgaatgtattaattcatttgagaaatcttaaactgcagtctgtaaagcaattctctagtgcatgattgttgttagaatgtccgagaaacagattgggcctttttaaagaaaacaaactgaagcagaaaaattaatacaataaaaattttaaatcttagaaaatattgcagagtatgaaaaaatttttaaaaatggaaaaaacaaattaatgaaatttaaattggacaagaagttaaagctaagttaataatttaatatataaaacttaagattaatgattaggtaatagtaaaaaaatgttccaagtgtaagattaacagattaacactcagcagagagaggtataaagaaaagaaatcaaatagaagaaattagtcatgaaggatttgtaaggaaattcatgaagtacgcaaaactccctaggcactggcttgggcgctgcatatacacagagagatatggtggtccttgacctcctggagccctcagttaagaagacttacagctaatggttttcatttacctttgtctttcactaaagcctaaaaaagtgtttctcatactctggaaatcttcagcaaagtcaaatgaacgtgggctcatacaggaactaccaaattaattgcatcaaggcaaacatatgtattctaatttttgagtaataaaatattgttttaaaatttcaaaatattctttataaatacaaaacaatattttataaatattatagccaagttacaattactttctaggaaattggggagagcatgagaaaaaaggtgagagaaattgagaagtactcagaaaaggaatggaagaagcaaactcctactaaaaaagggaggggccaggtgcagtggctcacagcaatttggaaggctgaggcaggcagatcatgaggtcaggagttccagaccagcctggccaatatggtgaaaccccgtctctactaaaaatacaaaaattagccaggcatggtggcatgcacctgtagtccttgagccaagagggcgtcactgcactccagcctgggtggcagggcgagactccatctcaaaaaaaagaaaaaaaagaaaaagaaaaaggggggtgagggaaagagcttggagaactaaaagaaacccacagcagaatgtggtagaaagatagagaaaaaacaaaaaggggacatgagtagatagaccttgtcatatacttggtgtctcagttgtgtgtaatacctgtcaaataataactgagatatttctcacatttcttgggttttggattaagtggattgatgaaaatgtcaccacatctgagaggttttctctgaccatcaaatgtaaaatggcacccttctatcctcattcttaacttgctgtatgcattcctcattattcttagcactatcttacatttgtttattgtttgcctccccttccaatcctgaaaactgtaaggtccataaaaacagggagttcacctgttttgctgcttgtttcctaatgcctaaggctgttccaggcacatggcagactctcaaaacgtatttgcagcatgacataatttctgacataattaaagtgcacaaatatctataactacaggaatagaggccactactgagttgtcacagtggttcaactgaatgagtgactcggattttctgggtttcactttcctcatctatacaaggaggataataatagtagattacttcttaaagttattttaagatagttcatgtaaagctcttaaaacagtgatggacttttagtaagcacttagcaatatttaacagttattatattttccttttcactgagttaaaataaaaatcagagtgttcaaatcttttcaggtcaaaaatgaaagggagagaatatgagcttttgaactatttgaatcccacccaagaagggtaattggagaatttgaaacaaagatcacattattcagtgatatttcttgactaagcatgacttattatgtgttaatgctactaaagtgtagctagaactgaagtagagattcctaatagttcattatagaagcacatgtagaaagaatcctctttgtatagaaaatattaatggtgatggcaaaatggcacctaataactaaacccttcttatttcttcaatcaggggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggagaattgt

SEQ ID NO: 37348 - DNA, 20291 bp, Homo sapiens
gcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtatgccgcagcacactacatcatctcgggtctccttgctcttctgcagctcttcattgctacccaagttatttgaataccccagggatgcttacccccgggcctatctgatgtcttttactgttgtgccaagaaatggaatctttaaccagagtggagctacccaagttctagaagatcataatgtgattgacttagtttcacagattaattcattttgcttttaccttctgaaataaaatatactgtttcatttttaattttaaatacactgtttcatttttttgtggaaggaaagaccaaatgtttacactgactctgaactagttatcaaagataaagatttagatttcaaattaacatgtcatgacaggccccattcctttgtctgtcgtttctaactcctttagcagtaaagtttgacctgaagggaagtgaggctatgtgtaactgaatgttccctttgtgtaaatattcataagttttctacagaaatattgtgtttgattacagtacagcttgctggaagtgtttcataatatatggcagacgtactattctaagaaaagttctgaattttgaaacatatctagccaaaaagattttaaataagggattaggaatttgtagttgtaatttctgaaggtgtgataaagaactttttctttcatatataagtgcgatgctctggatgatgttaaagtttgcttacaagataaagtttttaaattgagtaactaaaaactactcagaaaccttcgttgtattttttttctcctttttagtgagtcttggcatctctttaaaagtttatgcatgtttaatgcctgttggtgcatagaatttagaaccatttcgcttcactctttttcctactcttgttgtttatttcaatggaaacaagatgtttctgtaaagattcctgaattatcggatagacaaaaaggtgtgggagtgaaaaaatgaatggaacacagatttgagtatgtagaaaaaaatcttttaaaatatgttatactgataagcatatgtaccccaaatcaccaaaaacaggtattttaaaatatgtttggcttcaaaatgtgtgatatatattttaatgaaagattccaaattatgttgcattcaggttaaacttgaacgagtttgcatttcttagagtggagcgggagatattggctggtaaggaagatgttttaggcacttgaagtatttgtgatagcaagaagttgttccaagattaaaaattgactatgagtcaaagtaactttttggaggaaaatttgtaagtagtacaagtggtgataattttttaagttgccattaaaaaaatcttttatttttgttcttctgtagttcttactcagcataccacaaattgcaaaagactttatagataagtctagataaatttcaccattaaaaagtattaaaatgctagactaagaagttcatgtttcaatctgcataactggcttcctgctaagatttgtgactctaataagtaaggagatatggtaaatagccctaatctatgggagacctgtaacctcctttcattctgatgtataaaatgaacatgttgaagaaataattttgtgatgtttcttctttttaatgggggggcagtagaaatatggtcattttgggaagcagccaacagcaaattaaagtacactggacgcaaagagggcaatgtagcattaaaaatgaactccactgccaacagcagatgaacagtgtttgatacaaaaggtctctttttagtactaatcattgatttggggttgcttttgatgatatttacagtacatgaaaagttgccaccaaaatctgaggggaagagttaagataactatgatgtttttgcatctcagaaaaaaataccttcttactaaacaaaatataacatttaaaaattttgttaacatctttgttgaaatataatttacataccataaagttcggccatttaaagtccacaaatcaatggttttactatattcacagggttatgcagtcaccataagctaattttagaacatttggttcaaatatttaaaaagattattttctacatactcaaatctctgttccactcatttttttcagtcccacaactttttctatatccaaaaatccaggcatctttacaggaacattttgtttccattgaaataaataacaagactgggaaaagagtgaagcaaagtggctctaaattctgtgttaccaacaggcattaaacatgattcatcaactgactgatgaatgtatgaaccactttttgtttgtccattcatcagttcatggacatttgggttgtttctaccttttgtctatttaaataatggtactataaacatttgtgtacaagctttgtgtgaacaggctttcaattagtattttaggagtggagttgtggggtcgtatgttaactctatgtttaacattttcaaaaaccgtcaaactgatttccaaaggaactgtaccgtttttacatatctgccagcaatatgagtttcaatttctctgtgcctttagttacaataacaatataacagcccttgctattgtcttttaaaaaaaatacagccactctaatgaatgtgaagtggtgtcttgtggttttgatttacatttttttgtgaagactaagagtgttgagtattttttcatgtgcttattggccatttatatatcctctttggagaaatgtttattaagatccttttcccattttttaattaatgcacacattttaaaattatattaaaattaggcaatggtctgaccataaaaaggctgcttatggaatactgttatgttaaacttcacttacaggatgctaaatccttagaactgaggttttccccagaaaaagattaatggaaacatcagttgcttttcagacttgattctgcttcaaaagatgattttacacaaataattttaaaaaactttagtacacaacgaatcacttttagtttggtatgcatccacatttcagcatttagtagtggtcctgaacagaaagtgaaaaacacagcaatttttccaggaggtcaagtctgccaatttcagggatctgctgtgtaccccaatttctttcttaatccctgctgaggatcttgagaagcaggagcagcaccaaaaccaaggcatgcactggatccaaggttctttttgttccagttgtgagattccaaactagaccccagtggattgcaaggatgaccaaatgagagccctgcttaaaacttcttcaatttttaaaagcgaaagcaattacaagaaaatgaaacaatgcagagggatcatatgtgctttcaagtgtcttcatgtgctctttctccaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagagtgagtaaatgagattctaaaactaaacaagggaggtcagagactctttccaaccttacctgatggcttctggccaaagcaaggaagtgtcttggaaggtgttggttggtgatggtgcgaaaagacacttgagaaggagggaagaaaaagcagcgccccttgataaaggtgggggagagaagatatggggaaagccctgaattcctcatcaaaggccaatctcagagagtagcagggggttacaatctatgctttggccaagggcgggagtggaggagtgggggttaggatgatggcttggagcgggcatcatttaagacttaaagaaaccatgggtgcaggcaaagcaccccacacactaagcagtagtcccacaggctgcgacctgaaaccttcacatctactcttaacaagcccccatggctagagggctgttgcaaggggagaaggcagagaccccagaccatgtaatcaacagcaaggtgattgtgtgatgtgtcttttcccatatttaggagggtgagttttatgaatgactttaaatattatgcacttaatggttatgtttattacttcgtacaaaatatttctgaggccaggcacagtggcttatgcctgtaatcccagcactttgggagcccaaggtgggtggatcgcttgagcccaggaattcgagaccagcctgggcaacatggcaaaaccttgtctctgcaaaaaattttttaaaaattagcctggtatggtggtgcacaccagtagcccagctatttggaaggctgatgtgggagggtcacttgagcctaggaggtcaaggctgcagcaagccatgatcatgccactgcactcccacctgggtgacagagtgaaactcagtctcaaaaataatagtaatgtttgaggaaccattcaatttaagcaggtactaaagaagaaattaagggctcttccttactgaaagtttttccctgagaaataggaacttggcaactttatgcaaaacttcaaatgacttattattaggtcaataaaaataaaataatgttgaagcgctaagattgttaaagaagcttaaagatattgttatattagtgtttacacaataatgtgtcaacttttattcagcattatctccttgctttttgaggcaaatatattttgtataaagttttgagaatgtctgaggtgtttcctgtacctcttctgggctctcagtcttatcttggtatataaaaccattcaggctttaggggcatcgtttttttccagatagaattttccagatgagcctataatattccggaataaataacaaaccattgtttataaaatttaaaacaaccttgataagcctcaagattccctagcaggatcattgcaattcagataattggatgaggcacggtaacatacagtgctgaaggggaggtctagaaacttaattctgttgctaaaagacatgtggtcttgggctaatcatttaaaccctactagttagacctcagcattctcttggaaataaaattattgctctctgttctccagaatccctacctattttatagctctcagaaactcccagtgagcttcacaaggtatctccaagcagagttcagtgtggcattgtctcctgcagggcagaaatcccatgagaaagtggagtagtcatgacaagtgtgtgatttacagtccaccacaggaaacttgtaggattccttagaaaacaaagtgggttccaccgtctcttgggtctgttattccctcttaagaaacctttcttattattctcccttttttcctcttcttggcccttcactagcaacccaggccaactacacaacctgtttcctcaaagatcgtttccactgcctgtctttttcacaaccattatgacctcttcacagctgcagtttcaccctgaggccttgtgcaactgaagttgtctaaccaggacagttaactgtgcctgggcaacttgatacacttagcacaggctgcctaatattgttttctttttagcattttaactactttggactctgctttggattgcacaaggttcacttctttttctttttgtttaatagaagctgttgtgtgattagttaaagaggtaaaaggctatacaaataagtatttattgaacactgttccttgcccagcattatgttaaatacagatacaaatcaataagacaattctgaattttccagttttgtgtttccatggatattacaactcatagaaggttagagtccttaggtatacttcattgtattttatggtgaagcaaggatactgtgaaaaataatcataaactgtccaagtatgtaacttctatacacagtgcatttgacattctgcttgtataaatataagtactgcacttatgtatcttttcattacttacactgttctcaatgctatcccttgcattaatatttgcttttgaataaaaatccaacatatggcacatatcattttattagacatacattgtgtgtctctaagacaatgccaagccaaaatggatgcagcttgaattgttatgtgttaaaaaagcacactggataagagcttttacctctgagttataagaatataggatatttttatttctttatactctcctgcattttccaatggcctaacatgaataataataattttatataaatatatatgtatctatgtatacatataattgtatgtttgtgaatatgtatatccatatatctaatggacctcaggatatcataaatttctgcatcctgccttcaaaagtgttatgtgccattatctctataagaggtcaatcatcagaagcccagtaatattaaatgacttatcaggaattatttaagcaggaagtgatggaagagagatcagaaccaagatttatctaactactagtcttgtacttttcctgtttaaatgcaaatgacaggtggaatttgggactaccctttcctccagcattatagatgtgtgctgcttactttaggttaaaactagcattccagaacctaaagtgtgtaatccaagtttgtgtgtttgtgtgtctactgtccttagtcaatttaaacatttttatctttttttgtataccgaagaatgtcttacagagtaaaatgcttatattagactcagtaataacaccttaaagaaaactataacaaaaaaacattagcagtggttgcttctgggttattgggtaatatttgtcttctcatttacactttcgtatgttttttcttattttctataatgactacttcatagtttaccaagtcatcaaaattgatttatttataaaaaggatattgatatttctgagttcatgcttttttcttttcctttaagtaaggaaaaagttttattcaacaaagccaaatatatatatttatggtaaatatttaacattatatagtgttgcttttaaaaaaattctatcacagactcctttaataatctgttggaagttatgaaacctttccttagaaaaatacaaatatatgtaaagccacaaaatgttttgaagaatttctggaggttcacagacccctgaagctcattcatttaaacctccagtattgctgaaaggatgggctatgatttttatcagaatacttgggatgtttgtattaaatgcagatttccagcattgcccctgactgcctgaattggatgggaggagtggggcccaggaatctgcccccttaataagatagtccttccctaccctctaagcaaatggaatgcaaagcaagtgagaaaatctcaggacctacatgtctagagagctcgtattaagaatcctaagtaagaataacacaaactaaaataatagagaatgtccagtgccagtccttgaaattaggattctgagcaggagtttgttaggtagagaatgggaaaagggtgtgtccagctgaggaaagggcagagttgaacaggtggaagcatgggcacagtaggaagtatggactaataacaagttgcctgggaaccagaaataattaaataaaggcagctggaaaggttcatgcttaatcgcagtcctacaggaatggcatataatagtcatgaggccaaaaatagtgatgccagactcaggtttgtattgtcttgggaaaataatacttaaagcagtctcagtaacatgtagctctgttaagtttctcattgtgagagtggaatgggatcccatggacaagtatagaaatagtatttacctggagaaaagatagaggcactcatgagaactttggactattccagaattataaaatgttaaaaatagaagagactttatttattatctctttcaactttctcaattaaaaaagtaaaattctttggagtttatcaaatcttgtttattactatttgagttgttaattctgtaaagttgttaattctgtaacaatacagccaccaaaaagaacaagatcatgtccaagatcatgtcctttgcagggacatggatagagctggaggccattatccttagcaaactaacacaggaacagaaaaccaaatactgcatgttctcacttataagtgggagctaaatgatgagaacatatggacacatagaggggaacaacacatactgggaccttttggagaatggcggggggtggcagggggaggatcaggaataataactaatgatattaggcttaatacctgtgtgatgaaataatctctacaacaaacccacatgacacaagtttacccatgtaacatacctgaacatgtacccctgaacttaaaataaaagcataaaaaagttactataatgcatatttccttattttatggttgaaatggcaaataatgatgtgatttccctccaggtcacacactggcagagctgagtttggaaacagttttattacttaattgcttcttttcaaaaacattttagaggcagggccttgctctgtcaccaggctagaatgcagtggcacaaacatagctcactgcagccttgaacttctggctcaagtgatcctctcacctcagcctcttgagtagctaggactataggcatgtgccaccatacctagttaatttaaaaaaaaattgtagagacgtggtctacgtcatccacactgttcttgaatccctagacttaagcaatcctcccacctcagcctcccaaggagctgagattactggcatgagccactatgtctggctagattacttcttaaattacacaatgcccaacccagaacagcaataattgtgtgtttgtacattgtactatgtatccataagcaatctttgttcagatgtatgacagtgagaatgagcgttgggaaagctataacaacaggcggaagcctagtacctggcaccaggaaccagataaacaccatggtagtgctttggaacaccgaaatttggtagctcctgaggaaaaaaggagtaatagtatacagaaccataagtgttttcagaaaatatgaaatcaatgagttgtatcatatttgtggtaagtgaaacctagactttggaaatgacattcaggcattaggaatattagtagttctagataaatgtcacaagcccataagcaagtgaaagtttttgtcctggttaaataccctaatatagtacattttaattttcctgtttgttcacccattcaacaataattactgttgccatcatggtactaagtgcaggaaataaattaagagaataagactgatatgctttctagtctcatggaactcacaggctagacagggagatagccattaaaaattgaaatacactaatttaaaatcaaaatgtttaacatgctcttccatctatttcaaggacacttcccaccatctccacctggcaacacttatttatccttcagatctcagcttatatattatctctttagtcttcctttaccaccaaatataaattaatattttatttcacctaacaaacatttttaaatgacttttacccaaaagaaaggcaataaccaatgctggcaaggatgtggagaaaatggaactcttgtaccttgtttgtgggaatgtcaattagtacagccacaatggagaatagtatggaggttcctcaaattaaaaacagaaataccatatgatccagcaatctcactgctaggtatatactcaaaagaaaggaaatcagtatatcaaagagatgtctgcatccaatgtttattgcagcactattcacaatagctaagatttggaagcaacttaaattgcttcctaagtgcccatcaacagatgaatggattgaaaaatgtggtacacaatgaagtactatttagccataaaaaagaataggatcccatcatctgcaacaacacggatggaattggaattggaggtcattatgttaagggaaataagcctggcacagaaagacaaacttcccatattttcacttattcatgggagctgaaaattataacagttgaacttatggagatagaaagtagaaggatggttatcagaggcaggtaagggtagtaggggtgagggagtagtggggatggttaatgggtacaaacacagataggatgaataatatctagtatttgataacacaacaaggttactacagtcaacaaataatatatcgtacattaaaaaataagagtataattggaatgtttgtaacacaaaaaaatgataaatgcttgaggtgatggataccccagttaccccgatgtaatttttaggcgttgaatgcctgtatcaaaatttctcatgtatgctataaattatatgcacctacccacaaaaattaaaaataaaaaaatacgtacacagtgggaaaatatatattttctaatgatatataaaataagacaggggtctccaaccccaaagccatggaccagtatctgtccatggcccattaggaccttggccacactgcaggaggtaagcagtggagcaagtattactgcctgagctctgcctcgtggcagaacagtggttgttttagattcttacaggagtgcaaaccctattgtgaactgtgcatgcaaggggtctaggttgtgcactccttatgagagagaatctaatgcctgatgatctgaggtggagcagtttcatcctgaaaccatcctccccagccccgacccatggaaaaattgtcttccacgaaaccagttcttggttcccacaaggttgaggaccactgaaataaggctctaatatctagaatatatgaaaagaaactcttacaaatcaacagcaaaaatacaaataacctgattataaaaattggcaaaggacttgaaaagacatttctctaaagaagatagacaaatgtccaacaagcagatgacagatgagcaatgtcatttgtcactaagggactgcaaatccaaaccacaatgagatactgcttcatacctaggatgggtattagaaaaagtaaagtaagtgttagagaggatggtctagttatagatgtgaagaaattggaatccttatatattgctggtgggaagtaaaatggtgcagcttctatggaaaaaatgggcaattcctcaaaatgttaatgtagaatgtatggcccagcaattccactcctaggtctgtacactcaaggaattcaacaggcactcatacaaatacttgtacagaaatatccactgcagtactagtcacaataggcaacaggtagaaacaacccaaatgaccataaacagatagataaacaaattttggtatatccatacaatggaacattattgagtcacaaaagggagcaaagtattgatacatgctacaacacgcatttaccttgtaaataatacaataagtaaaagaagccaaactcaaaaagtcacattgtaagattccatttctatgaaacatctaaagtaagtaaatccataggaacagaaaactgagaggagggtggaatggtgagtgactgctaatgagtatgccgtttctttctggattaattaaaatattccagaattagatattagtgactattggccaaatttgtgaatatatttttaaaactactgaatgtataaccaagagggtaaatgctatgatgtgtaaattatatcttaatttcataatgaaaaaatattaaatataggcatctgcaaaatttttgtttctgtttctcacaacattcttattttttagttttaaaaatacaagataaaataatttcaaatttaaacgggctaatttccaaacccatatttataaacaatctgaatttatagaaggatgcaatttcaacagtaaatttaattttatggaaaagagaaaacttttaggagaataaaaggatgttcaaaaaatagaaaaaaagcagcctacatatcttaaagaaaaaagataagccacattttacagattttgaatctgtaaaatacaggttttgaatattcttgattcgagagttaactaattaataaaaatttttttgttaattttttttgagacagtcttgttctattgcccaggctcaagtgcagtggcaccacatacctcactgtagcctcaaactccgtggccccacctgggaccatacatatgcaaaaccacacacagctaattttataaattcatttttttttaaacttgcttgcaggacaaaataaaaattttaaaaatatattttttgtagaaaccaggtttccctatgttgcccaggcttgtctcaaactcctgggcccaagtgatcctcctgcctcagcttcccagtgctgggattacaggtgtgagccacagtgcctggccttaacagaaatttctaaaacatcaaaagatgcttctaaaaccagtcattcatgagcagttttgctgaacctttagaatccatgttggaacaaattttcatttcaaaaggaagtttaaatatagaagcagccaagtcattttaccaaatattcgtctgaaagagtatagaaatcctatttctagggaagcagaatactgaacttaaataaacatttgtgttccaaagggcagtcataacttaatgattctccttaaatgattaacaagaacatttaatttaaagtcaacctgtttacaacagagccttgaaatacatggttttttttaacagaacagggaaaaaatgttcacataaatactaacctgagctgctattactgtctggcgatagaacagaattcaaatgagttaccattggtagcctagtgaattatgtgagagaaaaagtcctcccacatctcctgaagaaggggagcttcaacaaacttcactaatttgaatgagaaagactagagagatttgtatcatttatctccgtatataacattaatagaaaaacactagcaacatatagtcagttacttgaaatagcctatttctgtaaccatccaacaggttctttctgcccaccgcacaaacaaaatcaactcacagagaccatggcattacagtaaagaaggactttgatgctggcgatgccacgtcagagacagagttattactcaaatcaatctcattcaaggcttttaggtgagggcttttcaaaggtagtttggtgagcagggggctagggtatagggagtgctgattagttgggttggagatgaaatcatagggagcagaagctgtccttttgctctgtgtcccttctgagtggggccacaggagtagttggctgatccaggtggagccacttgtcgatagacttgccaaaaatcctggaaaaaaaatctcaaaaggccaaacttaggttctacaatagtgatgttctctgcaggaataattggggaagttgcatattttgtgacctccagaataatggctggtttatgtctacaccttagcagaattcaggcacctctgtcctcctagtctggtgttctctcattagctttaaggcagttgcattttggagaagggctattatcatttaaactataaactgaatgtctctcaaagttatcttgacctaagcccagtaataattaagggcagctaaaagtaagttgggggttggttaaatcagatctctttcactgccataattttctcactgctataatttttgcaaaagtggttcattttgactttcatctaattattgagccttatatcataaatatattaaacattagtgatttctgacagcatgatgatcatcaacatcttggtcctcaaatatcagtgagactaaataatgcttcaatcctgttggtgtcactgagattgaagaaaggaagaaaccagtcagacaggcagttagggggggtccttggttgaattctttcacacaaaagaacagcctgcaggctcagataagggaacttacacagggggggcttgcctaagacgtgcccacagctgcacagataagaaaggctaaacaggtgacttgcccagacaagcccacaatggaaaattccatcccctaacacaggcacagtaaggggaacaaagcaatatggagtaactcaagctaagggcccgcatgtgcactaggaggacagggtggagctaccagaaattcatgccttatgcagatgagatgtccagctatcatcagtttcttataaaagcctttgcattcaactgtaaaaacagcaaccctcttccaggccccctcttggtggtggagagctttcttcttttgcttattaaacttttgctccaacctcaccctttgtgtccatgctcgttaattctcttgatcctgagacaaagagttctgggtgatacctcacagtgagagacttctacattgtggtgcattggcaagactaacattttggtgcattggctgggaaaggaaagatcagaagaatgagtaggagtggacctccaactctactttcatttctgaggcttttcaccccattttaaaaagttaaacaaaacactgggcccctgtcagccagttaaaagcttttagagtggctgccagccttacaagactcaggggacaggcttgctttagaggactttgtcaatccccgattgccctcatgtggtgggaatgttggctctgttccaatccagtttcctttcacagaggacctagccatctatgggactggaagtgagagacaggactagctggatttcctaggccgactaagaattcctaagtgtagctggggaaggtgaccacacccacctttaaacgtgggtcttgtaactcagctcacacccaaccaatcaggtagtaaagagagctcactaaaataccaattaggctaaaagcaggaggtaaagaaataatcaaatcatctaccacctgagagcataggggaaaggacaatgatcaggatataaacccagacattcaagctggattgggcaaccccctttacatcccctcccgttgtatcagagctctctctgttttcactctattaaatcttgcaactgcacattcttctcgtccgtgtttgttccagctcaagctaagctattgctcaccgtcacaggctagccgctgacttccacccctctggatccagcagggtgtctgctgcacttctgatccagtgagacgcccattgccactcccaactgggctagaggctcgccattgttcctgcacggctaagtgcccaggtttgtcctaacactagtcgctgggttccatagttctcttccgtgatccatggcttctaatagagctataacactcaccacatggcccaaggttccattctttggaatctatgaggccaagaaccccaggacagagaacaaaaggcttgccaccatcttgggagtgcccccctccatcttgggagcgcccccctccatcttgggagctgcccaccaccatcttgggagctctaagaacaaagaccccccaagtaacagaaggagaccctggggcaactgaagacatctggttggggctacacctcggtgttacctgaagacccctggattaactctggcccccaacagcccatcagggtatcggcatcaggacttccagacttttctatcgcatttccttcctttcttttcatggctatcatatctgctatcccttcttcgcatgctgtgttaagggactttttaaagcctggggagataatcttgttgggtaaagttagcaagtgccttagtaaccaggaatgtaactcaaaaaaattgctgcttctgtgatttccttgagatgggggaatttcaatatttcagtctagactttcacctattaaaggctttcttttcccctaataataagcattcatggcactgtgtgggaggatattttaccctgagtgaataccctcctctccatttgggttgttttttctcagtgtaagagctcagaaccgtccagtgagtttaagcagttcctttataagacaagttaagtttttcttgctaggaggcatattatggggacagcctattaagccccaaacctctctttctaacctctgcttggaaagtcagtttttccctaacatttcaaaccctacggcaccacctagtgggatgggatttttctctgtggggagccttgtcagccctttgccccgaaactctagttccctgattcctttccctcttacatccctctcccagtaatcagtccctatggcctatttgtaatcagaataactcccctttcagcagccaggagaaagctactctagcaagacagattttagcctcagtgctaaaatcatcagagggaggatggccagtcaattcttatgttattttgaggcatctattctgcatccagctatattggcatctaagtgagaaagggatcttatgtttagaagtcaattggtcccattctttaggaatttataactttgcctgggtggtagtaagaggatgtaagggatagatttaagacactcccccctttaaagggccttgcccaaattcaactaccatacagtctcttctgagcccctggggtacccccggagccttatgggccaactggatctaggaaattagcagggcagagagctagggtatcacacaggtaaacatggctactcctgctgactagctcctccagatccatgggtgaaggtcatgcttgcatccatgcatggcacctatgatggttgccaggacccagaggagacaggagggaagaggagaatggggatgtcctttttgtctttctcgccactctgggtcactccgaaaggaggaaggagacttcttctcccctctttcctagataggtaacaacccatcttcaagcctgcactccccttgagtgcagcctggatcttctttaaaccttagaccctacagttcactctgggaaagccccaacatcactcacatatagaggccttccaggatttatcccaagtatttaaagtctcctggaaggatgtgatgtactcttaaatcaaaccctaactgctgctgagaaacaggcagccctacaggtagcagagaaattcagagacaaacagcttgtctcctatagccagtcaaaaaggaaagccagtcaaaaagggaaaggttgagaaagagacagaatccccattcctagtaggaagagaggcagtgtctcttaaacaacctaattgagaccccagtgataccttagatgagtgcaaattaaaacattttcaaatgtgcatattagagggcttagggaggaccagagccaagcctcttaattactccaaactttccatgatagatcaataactagatgaaaatcccttagcctttttggaaaggctgagagagtctttagtgaaacacacctccctgtctcctgattcaattgagggaaaaggtagagagaggggtatcttagaatggaatgcaggcttgggactccataagcttgcagttcaatctagcctggtaaactggtcagttacaagctttgctgcaggactccatcttgttttacattttgacctataaccacatggcagtactttgttttagactctgccattttacaatggcagcccaggttcaatcctggcttggggaatgaatacttgcaagttaatagctgtgtgacttttgccatttgctcattctcttcccctccatgaacaacttctagctcctttcttaaatcttccttctctgagtttcctttaaaggttctagattttgtaaaagtgtaaccacacaatgggttcaccctgcccgctgcctagacagagctgatttatcaggatggggaaattgcagtggagagggggtgattcatgtgggactggctgtgcaggagatggagttctgttattgcttgggtctctctccctgagaatttgtggagcagagtttttgaggatggctggttgatagagggaggccagtgagctgggagtgctgataggtcaaatcagagataaaatcacagggagttgaggctaccttcttgtgctgagtcagttcctggtttggggtcacaagatcagatgagccagtttatcattctgagtggtgccagctgatccatcaagtgcagggtctgcagaatatctgaaatgctgatcttaggagcagtttagggagggtcagaatctgtggcctctagctacatgactcctaacccatagtttctaatcttgtggctggtttcttggttctacaaaagcattctggtcccccaggcaagaaggaggtttgttttgggaaagggctattattgtttttgttttggactataaactataagttcctcccagagttggttcagcctatgcccaggaatgaacaaggacagctgggaggctagacgcaagatggagttggttaggtcagatttcttttactatctcagttacaattttgcaatggtggtttcaaaagctgcttaccacccctttgaaagtaccttgtacactcatggttaaatcataaccttaattgaggcttcttgatttcacctgttaggttacttttggtaaagttcaaaaaccagaaatgttaattatttgatgtggctaaaattaggtaacatgagatttaaaaggattttcttaaagagtgcttagcttaattaaaactggatatccaatctacaagtatatgtacaaggcctttatgtttttctcttcttggatcttgtttttctggaacaggtttttttctcagtcaactgaattctttttctccactttgttttgccactcttaatgcatgcatgagaggccctaagataatttctgatggcctgggactccttgggaaaaaaatgaaaaggcaccacaggttccattttgggagaaacctccattttcctcatgaaaccgcaggaattagaggcaggtagatccctctcaaaatctgtttttgtcctccagcatacctgtttattagaccctagaaactgcatgctttcctagccctgctcttaaacagcaccacccagaggccaataattcaattaggagattgatgaacaaaaatatctgataaatactggatctgcttctgtttgcttgtgtagttatatatgtattgtgtgtgatgcctataaaaagagctctaattgattggcttaaagaaaaataagtgcttaaatcaaattttttaaaggaaatataaaagctgtaatgccttttagttcacataactttaatctttaagaaataaaaatagttttaaaaataattggtaaaatgcagatgtcaaaatgtaaataggtggcctaaatcatgtaagtcagatactaggtttgctaaatgtttcaaggttgtaaactgcctgctttacaagttggtaaggcctgggtacatacaagattaaccccacccctaactatgctggaaaaagtcagaccttatctgggcctagtacataattaaaacaatgtaccagttttacattaaagttaaaaattgccaagagttaccattataacatgtaaatgagactacgaaaaatagatttacatgaaaggtgtgtaagaacagtaaaatgtgtttgtggtaaaagattgtaaaaagatatagaaatgtaaatcttgcctagggataaaggattgttttaaaaccaatgtaagagtaaaatttggctttctctcccttgcacaagattttcatgtaatagtgaaggataatgaaaattttttatttgccttgcagataaactgccagggagaagaatgagaagacaggagacaaactgtttggaaagctaaatcttccctcttaatgaataaaggtttttgccttgtcttaaagtttctgagtcctaattttggcaaaataaataacttatggtaatctggaattgtattttgtaatattaagtgttttgaacctctaacatttacttcccaaaatcaaacttcagtttcaaaat

SEQ ID NO: 37349 - DNA, 50172 bp, Homo sapiens; identical to SEQ ID NO: 35852

SEQ ID NO: 37350 - DNA, 11472 bp, Homo sapiens
cagagagaagaagaaatatttccaaatataccaggctgatctttcgtagtttctcagtcttgctgtctgttgttgtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcggggaggccaaacttcctgctgaagctctgtggcctcttttggggtgggggcgggggtccaggcagaaagaaactgtctgctgctcaagacccacaggacgccgggaagactgtgagtaccgggcctgaaagcacttgggaagtgatttctctgaagaccgggctggagggagacaggggaaagcagcctgccacggggcagggagggaggcaggcaggaggactcccttcctctcggggctgtccttctggatggagggcccgtggtctggtggccagtggggagggtggcacagtggccaggttactctggtagtaagcgccctggccctctaggtcccagttctcagagtggccagaaggctgcagcctggagattaacaccaatgctggcacttgtcaccggtagagaggtgggacaaaaatagattcatcaagaggggtccagacttctgctccaaactttcagggtttccttcgttagtagtaatagctaatatttactgggggctgatttggggctaggtgctatgatacatgtctgatactcaatatggcatttgatctttagctgaactctctgaggcaggtaccatggttctcgtttcacagtcatgtggttgctaagtgtaagtggcagagccaggatttgattccatgtctgaggacctcagaatcgccctgtccacaccccaccaaactgttcaacaatgtactctattccttgtccttctaaggaaaaggatgtcgacccagctatcaggtcacccaggacactccaaagtcctgccttcctttgtccttctccatcttctctgaatctatcccagatctcaagtgacctttctaaatgggaagatatatcctggaacttcagagatatttagaaatgctcaaaactgggaagttcttcttacagtctaactgaaatccctcctatgatagctgaaacccacttcttccttttctttctgtcccttgggggatattgacagttcccatccttcctcccgccaaaggttctccctttggatgctgaatactaacttcttgctgaagtcatatctacactgaaccccacgcatggtcttaggaggatttatcatgactctataaactcactcagtgcaggcaacaatctcatcagaccattagagacgggtcagacctgaataagccaagtttccagacttctctgtgacagggaagcctctcctttcctttccttctgagctcctaaaactggtaaaaccaggttcctgccttcaccagcctcaggagtgcccaggggcctgagagggcactagaagccaaatagcagaggaggccatggccctgggcgctggggggggctgattagccaggaaggagccacaggaagcccccacaggtgcgatccagttcccccaggagagaaatggctttgttgtgggcactcagccctaggcttccaagatgggatttcccattggcttcaaatgatttatgtctcacagtatctggggtggggccaagtgccagtgacccttgcaggtcctggggaagcaggctgttggggcttttagcttacctccaggtgattctgttgctttacctgtgaatacatggagagtcttgttcaactgacgccaggtagaaaaaggcatgggctctcccattcccacaagatcacagaacaggaggaaaaggattgaataaaaagagttgaataaaacatctctctttgtcgggggcaatttctgcttgcttgtgcttttataatgtctccattagaatgcaggagaaactcacctcctggtgccaaataaaggagaaaaagttgtcattggatgtcacctctgccgatcgataggggaggtggaccagctcactgggaaggtgtgatgggtatccgtggtgcctgaccctggtctcttccctttagcggagatgcccgggtatgagggcagcctggctaaggggagggagtcaagaatctctgaatatttgaaacagtctagtagttaagagacgcctgagcagaaaatagagcactttgcagaaaatctctttggactaaggcctgtcacccggacactggctaattaaacaaacaaaaaccataatatgtttattactttagggacctggcaaggagaataaagtccccctgatatctggctaaaatttcccctaaattcccctaaaatttcccctaaaatggaggattacattgatagcttcctggtatttttggtagaaatggactctggttactttaaacaaataaaaacaacagcaaataaatttaccagaggctctaggacagcttgcggaaccatgggaaatcacgcggggaccatggctgggcatctctgtggctccaggcggcatagattgaggggctgtttcttgaagtctttgtcaagactcacactcctgggggagcgatcaggagcctagcaggggagggtggaatctttgcttgcattggggtggagtcaatgtccaggggaaaaacaaggagttgctgcctaaagaaagaggagagaaggaaagcaaccaccagcagaatgtgcccattctgctttgtcccaggtggcttcaagccctgaaataagaaagcagtcgctgaggccaccatgatgccttctttcttctttctttgcttgaagtaggggaatgttccttacaaaaaaaaaaaacaccggaatatggtaaacctcctgcctctcctgacaacctgcagctgccttctggggccctcctctcctttccctgcctgtgcccggcccagctagccctgccacagaactgtttctgggcagaaatactccaagtatccctgtgagataagtgccgtggaaggaggtgcatggatgatgcacatgtactgctcgctcaccgcatgggacctatgactgttgtagcaaatgatcataaacctgacggcctcaaacgacagaaatttcaccagaagtccaaaatcaccaaggtgtctgcaggctgcactccctgcagtggccgtgggggatgagccattgttccttgcccccgccagcttctgacgcactccttggcctgtggtcacatcactctaattgctgtctccctggtcatatcaccttagctttctcatctgtttaatctcccttcacttccctcttattaggacccttgggattacatttaggagctacatggataatccaatattgtctccccatttcaagagcctttatctttttttgttttttgtttttttttttgacggagtcttgctttgttgcccaggctggagtgcagtggcgcatctctgctcactgcaagctccgcctcctgggttcatgccattctcctgcctcagcctcccctgtagctgggactactggctcccacgaccacacccggctaattttttgtattttttttttttagtagagatggggtttcaccatgttagccaggatggtcttgatctcctgacctcatgatccgcccacctcggtctccgaaagtgctgggatttcaggcatgagccaccgcacctggccttcaagagcctttatcttaatcatttctgcaaagtcattgccacataaagtaacattgatagcttccagagactagaacatagacatcttggggggccattactgagcctattacatactgtgtgacctagggcaagtcactttacctctctgagccgtaggtcttttatctgcaattgcctctcaattgcacagggaaggcttacatggggtccaaaaagcaagacttctggaagttgcaaagctccaaatataaacaagagtgatattaatagttgagtaccttcccctctcacctgtcctctctttctgtggatcacctgtgaactgggctgatctcacttctgtttgcttctgtggacctagaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaaggtactgagctctcccggcctgcccaccccccaaccctctcctaagggtctggcatctgtaaggaaccctggccttctactcacccctctccttgaccctcattcaaggcagcagggtcaagacgatgctcattcttaggttctagggttcaagtgcagggaaggtaggatgaactgagccccactggtctgagattctaggacctggtggtaacagacacatgatctaggacgtggtggtaacagacacatgatgcccttctcagaagaaatagcaaagaatcagagcaaaggttccagtgcaagtttgatcccaggaggaatcagagaattgcagatgtttacagctcagctgcataattctctcccctctgaagcctccctgtcaggtgggcatccagcctcctgatgaatacctcaagagacggggagctccttgcctcactgaacatacatttcatgtttgaggttttctgatgtgtctgcattgagccagcatctgcttccctgaagttctgctcaggaatctcagagaatggtccatgcccttgctccatgacatatcaaccacttgagattttaaggaaaagctgtgaattcctaattcgtgttctatttggaacaaagacactcagttcccccagcctgtccttaggataagtctcagacctgtgctctgggcacgttccagcagctgacagcccccttctgactggcaatgggtctcccacaggatacttgggagttgaagcacaactgatttactaatatgttgatgaacctgttagcctctcccgggcctgctgcagcctcactcttcacaacgctgaagcgattccaggctggactcttaatctggtgaagcaccatctagagactgtccccaccatctttcccatcctggctcaactcaaaccccttctacatctgctccttttaggggaaagaacacagctctccaacccactcagacctagcttcaggtcctgcaaggtctcagcaaagtcacttgacctttctgagtttctcttctgcctctgcaaaatgaagacgatatggataagaaagtctcaggtttggctgctcgtcagaatcacatcagggagctttgaaaaaacacccagggcctgggccaaaccacccaagaagttctgattcacttgctctggggtgtagcttggacacgggaatctttttagaagctccccaggttgttgcaagagtagccaaggttgagaaccagtcatatagataatgtctaagaccccatccagcttctacaattcctccctgtgtccggggactgtggggtcatgtgcctttattgctggatgctgaagacaagatgaggatcccagtcctggatccctctagaggctcccaggggataatgggttcaaatgggtgttctgtgtgtcacccagttctgagatgtgtatgtgtgcatgtgtgtggtctcctcagcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcaggtactgaactggagggatggggacacatccctttatccctgtcaggtgtgtgagcctgttcctaactgtccctgtccccgaggctgagaaagatcaacccacttgaccaggtctcacagctggaatgagactgagccagccctagctcttctgtgttggagtcacacagacctgggtttgaatctgccgctaactggctgtgtaaacataggcaggccacttagcctctcacctcctcagtttccacccttgtaaagtggaatgctaatgctgcaccttgaagagctgttatcaagtcagagacgctgtatataaagtgccacgcttgatgctgagtggatagtgggcactcaaacaaaagcagtgattagtgttagtactttcattctacaacctcagtcaaatgagggaccaggcccagggccagatcctcaaagtggaatcccggtgactccccaggaaaccagggactcagggctggagtaacctccataaacaaacatttagatggtttttccatccttgcatcccaacatcccaccctccccctccaaaacacaaaactcaccaccatatcctttcctaaagcgatcagttggcccatattctgtctctcttccttccttctttctttccttcttttttccctttcttccctccttctttcttttcttttttttcccctccctccttccctccctctctccctcccttccttccttccttccttccttccttgtttccttctttcctcctctcatttatttattcaacagccattgagcacctcctgtgtcaagcctgtaggactcaagaggagagagctcatgcatgaacagtgcctagcagggaagaattggcaccggggagaagaacagaggaagttacaggggttagaggagggggatgttttccagctgacaatgatgggggtatcagaaaggctcttggtgagattgcaccattgcactccagcctggcaacaagagtgaaactccatctcaaaaaaaaaaaaaaaaaaaagaaaggctcttggattaggcttttaacatcaggcaggcgcaggatgcaaggcatagagaatgaggtgatataggaagcgggtatgcctataggacgaggcatggcggagggaagggctaggtggagacagggatcagagggctgactacagaaaatgacccatgatggggtgtatgcagctggaaaaggctgtcagggcagactaaggtctgttcccagaggcctttgatcaccacaatatggaattaaaatgtgagtgtgtatgtctcaagatatgtcaactttggctatgcattagaaccctgtaagagtcttaaaaaacaaaactagggtccaacactagacatatcaaggtggaatctctggtcagagatccattcatggagctcccaaggtgattctaaggttggaaattattgctgttggcaatgggaatctttagggcatgatcagagtttcagagttgggctgggaagatggagcctacaggtgtgtgggtccagttactagacagaggagccaaggccgcagcaagcactcacgaccaagatgtggcctgcagcaggggagatgctgacagtccggacttgatggctgatgggacgggaaggggcagggtgcctgggatggggcgtggaggctgggggatcttgagagtgctgaaggtcaatgagaagtgggtctgggcagtgcaggatggtcaggtgttctgtcatcgctagtatgactcggccccacccggtggagagaggtctcagggcccactggaggcagctcctacccatgacccctgcctctgcgttggcattcagtagcccttgatttatcccaatgcaagaaacaaattttcaataactggtaacattctccgggagtgatatgggccagagcaggctggttttcaggctgcctccctggtcctgagattgccagctcagaggagcatcccctgaatgaactgtcagcaggatgtgaaggaaggacatgctggagccactgctgtcctctcccctgccgcccaggcttgaccaggtgtggtgctgatagcaggctgcaggagctgggaggaagcagtggaaatgcccttcgtgtttttgccaagcagctgggttgtgggctagctgctccttccgcctatgtccatcataggggttcaagtggctggggctccaggctagctgggtgtcctctggaatcactgtgaagggccaagaagactctcatcccaccctccaactctgaaggtaggggccatagtctgccctcagcttttcctgtgagtcttagcctggagcaggtgagttctaaattccctcccattgtctgtcctggggaccttacactgcagggcttgggaaaaagctggttggtttcagatcattcagataactcaggcttagctggacccaggacaggagagaaaggatgcattcaggccccggcttctgggtttggccatgaagagtgaattcctgcccagtgtcttgccaaacaggcccagcataaaagatccagaggaaccctgagcaggcagaggatacactaggcccaggatggacagaagcctctacttcagagctcatccatagacctctttttaagaaggtaaagaaggagctgttgttgcaatttcatagataagtcaaaacatattattattaataatagcatcttccacttttttgagttcttatcgtgtgctgggcttctgtgctcagtgctttacatgcatcatctcatttaatccccatgacagttctcctaggcaggtagcctcacaaacccattttacaaggcccagtgaggttgtggcagttgccaaggtcacacagctcagaactcaggcctgtctgactccatagccacactgctatttaaggagctaggttagccaaggtcacagtcagaggcattggagagactcaggccaggccccctcaccgtcagctcaggatgctggattatatgctactgaggacctggcagtgtccaacagctctgaatgccagattcctgaggagccagcgtctccccagcctcagctactccctggctggctggggccctagatctgagtgcagcatctgcatttcccaggctgtgagaactacagtgcaaccctcctctgtgttgctggagtgaatgccctcagggcaggcagcttccagggtggcacctcatataaatccagggagtggccgaggcctgcaaggaatctggctcaacacctgccatttgggtctcagttttacacattttgatcttgcacatgatttcactagggcaaaattaagtgcatgaaggaatcacacattcctgggtctcgccctcagtgatgcagagtgggtagggacctgggctatgggggccctgtaggtattctgctgcagatgggggcaccacacttgcagctcagaacagagataaaaccagataaaactccgctttatgactgctttgcatcactttccagctggcctcatctgaacagggcagaaagttcctaataacaataatcaacgtcagaattaaatgtgtgtcatgctctgctggcacaaaactcttttcaatgcattctttctttcctttggatcccagtgtcaaatacccgcttgccaacatagtttgtttgctgtacacaggttgaaactgcaaaggttttcaattttaaatttagctaatattttactttttttttttttttgaaatgggatctcgctttgttgccttacctggagtgtagttgcgagatcatagctcactgcagcctccaactcctgggctcaggtgatcctcccacctcagtctcctgtgtagctgggactacaggtacaccaccatgcccacctggataatttttaactttttttgtagagataaagtcttgctatgttgcctaggctagtctcgaactcctgggctcaagggatccttccccttcggcttcccaaagtgttaggattacaggtgtgatctggtttctaacttctcttaaagtgttggaggtctggctattatagatcttctggatggcctgacatccattgcctggagggagtggtgactgcctgtctggaggcagctggctctctccctattgacaggccctgccacaccctggcaattcttcctggcaccaaggcaagagtcagtgggcacctgtcatctcattgctttgcctgcttcaccctctgacaataccttcatgagccctgtaggcaattgagcacatgatctcgatttcaaatacacagcccacttggcctgtgtccctccctggtttccttagatagctctgtgtgaagtccttctttcataatatcctttgaaaccgatattcacccatttaagtgatgaagcttcagggctcagaaagagtgagaaatttgccaaaaattctacagccaatccaagcagagccaggactccaaggtaggacctgcgcccaggtgtgtagcctgtaccccgagcagctccagcaccgccatccacacacaagacacaaatgagagcgtgctctccagacctgtacagcgcatggcctgccaagctttagaccaaagccccgactccaatccaggggcccgactacaaagctggtatttttctttactccatatcaagcccttggctaagaaatggggatttccaagcccacagctgctcttgtttctccccacagtgctcctacatcccaggcagcgtggacaattaccagacggcccgggccgacgtggagaaggtcagagccaaattccaagagcagcaggtcttctactgcttctccgcacctcgggggaacgaaaccagcgtcctattccagcgcctctacgggccccaggccctcctcttctccctcttctggcccaccttcctgctgaccggtggcctcctcattatcgccatggtgaagagcaaccagtacctgtccatcctggcggcccagaagtagagccatccatccatgccataccacttgtcagggcacaggggactggctgggcccccagggctgctccccacttgcagcacaatgccttctccacctgccctcccactcttccagtccaatccacgctgtcttctgttgcaggactaacctttgagaaatccttttgtgaagtcattgcctgctcaagaatgtacagtggctccccaatgccttggaggccataaggccagccagttctagctctctattacctgtccccactcaactgactcatacctgtttccggctgcatcactatgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaacaat

SEQ ID NO: 37351 - DNA, 12463 bp, Homo sapiens
ggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggtaaggcgcgcgcgcccatccctttccccactcccggaccccgcttcggagttgtgatccccgatactgcccagggaccccgctgttcacacctaggattctcacccccccagtctggattttcaggagcttcgattcaactccgggaccccagtaccattgggaccctgagtccctgccctggatctccgctcccccactccctgctccgatttttgcgtgggattccctattcaccccctagaacttcttcatagtctggagtcccctagacgagtcttgggggttctccctaattctgttcggcagttaacatttatacccagaactctgcctcaaagtttggaccccaaattcttctagatgatccctcatcctattcgggtattcacttcctatctgggatctcccatcgcccccccacctccgtagtctggacccccaatactttggtctgtcccgggatctactttccgggatcttgatccggggttcccattcagatccggagtcgccactccttttctaaacggaacaaggaactctgtgctactctgatattcctgtccctgcccacacccaggacccccttcctagagtgtagaaccgtcccccttcaggatccttagtctcaccgagtacttgggttttggaatctggttcccctctggatctaactaccagctccaacccgatagagcctcacattccagcctctcctttggcctccggtagacccatttcccattataccaggaaatcctgcccacgtggcttccggcctagccagagcccctgctcctacttggtattgcagaccctgtcaccacccacttcccagactggcttcctgtatgagcctcagccagcattggaaactctcccctaactcaagcccagaaccccaaacccaccccaccttttgtccccagcctgttagctactctgtgacccaaattgtccctgctcttatccagggactctcctggtctgattctaaattcaccaccccttcttctatctgaccacaacagaggtcccgaatccagaccccagaatcccaagcctgggtgatccatgtcccaccaccctctcagtgctcacgagccaatgggatgactaagacttaaaggtttaacctcctgctaccccaaatgagtgtgcctgcattacataccagtgtctgttgtattcctttttttttttttttttttttttttgagacgaagtttccttcttgtcgcccaggctggagtgcagtggcacaatcttggctcactgcaacctctgcctcccgggttcaagtgattctcctgcctcagcctcctgagtagctgggattacaggcatgatgcaccaccatgcctggctaattttgtatttttggtagagacagggtttctccatgttggtcaggctggtcttgaacttccgacctcagttgatccacccacctcggcctcccaaagtgctgggattacaggcgtgagccaccgcacccagccatgttgtgctcttaaacgaagggcatatacctctcagaaccttctagtgaggatctcttaccccaccctcccatagggcaattccccatcatttatccagaaacaactagaaggtccctttcccatccttccagaatactctggaatacggcattagtctcttcatctagctcccagtcccacttccagacctattccttaaatcctgagtctcctgggtagtgtacctgccaagcaagccactggagtgtgggaagaaagttctagcgcttctatttcttgccgtgtgtaacattttattatgaaatatttaagacttcctcaaagctccaaagactattcttgggaagacctatttctgtcacataaagaggttaatctttactactgtggagaatggtttggtcctgccgggtgggagggcccccctcctgcagcgtagtgtacctgccacaccctcctccctctggcacagagcttttcctgtcctgccgctgagaaccccggtggttgtagtggcatgtaagggaggcagggggcttcagcgtctccagcacaggttcaaggacaggcaagcttgggttccaatcctagccccacctcttgctgcttctttctttctttgatgtggcaagactcacaagaagcctccctgagcccatgtgaaacctgggataatatggccccacctccctgagacctttgtaagaatgaattaagactgggtcaggaaaacttggggcaggtttggaaggaagcattgtggaggggaaggagagattgctgtcgttcagagcacaggcctgactaggttcaaatctcagctctgtctgtatcactcacgtgctgcgtgactgccagggagctgtttgatcgctctgtgcctcagtttccctacctgagaatctgaatgatgtccaccccataaggttgttgtaaggcttaccttattcatttaatatttgtaatccttttggggcagtggctattatcatcatcatcatttaaataatttctgttcatggttaaaaaaaaaaaaatctgtagccacatgtggtggcacatgcctatagtcctagctactcaggagactgaggcagaaggatcatttgagcccagaagttcaagtccagcctgagcaacatagcaagaccttgtctctctcttttttttttcgagacagggccttgctttgtcaccctgagatggcagtggcgccatctcagctcactgcaacttccaccttccgggctcaagtgatcctcctacttctgcctcctgagtagctgggaccacaggtacacaccaccatgcctggttgatttttgtactttttggtagagacagggtttcaccatgttgcccaggctggtctcaaactgctgagctcaggcaatccacctgcctcagcctcacaaagtgctgggattgtaggtgtgagccaccaagcctggcctaagaccttgtctcttaaaaaaaaaaatttcaaagtttccagaagcggacaaatgaatcccttttctcagccccagctcgccggctctcctgcccagagacagctgctgttagtggtttcttctaatgagttgtatgacattgagattctgtgagcctcagtttccctaactgtaaggcaggagggtagtgacatctgtgggccctgcttgctggggtggcttctcccctgcccagcctgctacagcccctccccgataggaggtgtaaagcccaggctgggcaggctgccgcccccgccaactccaagaggccttttttagctgcggcctccctggcagttgttcagaggacacaggggagactggtggcagcccagcagcggattgcagggtggtgggcaggctccagggtgacacaggcccatcgtggagaaagggagttggagaggccacagctgctttttttttttttttttttttttttaagacggagtctcactctgttgcccagacaggagtgcagtggtgccatctcggctcactgtaacctccacctcccaggttcaagcaattctcctgcctcagcctcccgagtagctgggactacaggtgcgcgccaccatgcccggctaatttttgtattttttaagtagagatggggtttcaccatgttggccaggctggtcccgaactcctgacctcatgatctgcccgcctggcctcccaaagtgttgggattacaggcatgagccaccacacccagcaactttttttttttaagagatggaatctcactatgttgcctaggctggtctcaaattcctgagctcaagtgatcctcccacctcggcctcccaaagtgctaggattataggcatgggtcactgtgcccagcctgcagctgctgtttatctcatgaggtatagctttttttttttttttttttttttttcagacagggtcatgctctgtcgcccaggctggagtgcagtggggcgatctcagctcactacaacttctgcctcgggttcaagcgattctgcctcagcctctggagtagctgggattgcaggcgcctgccaccacgcctggctaatttttgtgttcttaggagagacggggtttcaccatgttggccaggctggtttcaaactcctgacctcaggtgatccacccgcttcggcctcccaaagtgttgggattacaggagtgagccaccacgctcgaccacgtaggccttcttgaccccttatacatataggggaatccgaggctcaggctggctgtgtcagtcccctggggtattagagtaggggccagctctgcctggccctgccttagaacctggggacacagcctcagataaggcacaggaatgagtcagcagaccattcaggtggcagtgacaaggacggagatggtaacagtgggacacacctactgagggctgttttggaagcattttccatagagttagtcattcagttctcacggcgatcctgtgagactccatttcacagaggggaagaccaaggctgggaaaggtttcagtgacatggccaaagttccatctcccgtcagtggcacagccgggtgctgtgaccatgtagtaacaaccactcccagttattgagcgtgtactctgggccagaaattaaactaagcatttgaaggacatttcctttttgaggccccagagtggtccccagagagagagagagattgttctcttgcacagatggtaatgaccctggccagtacaggaagggtgcgtgctgagggcccacatggctcgggacattttactctaatcatctccttagtttcttccaatatgagcttgtgcagtcagcattgttgactgtttgacagatgaggaaactgaggttacaggaggttaggggatggcccgggatacccagccggtacatggtggctgtgggctaggacccaggggccgttgccccaaggctgtcctccagcaccctcaccacatcgtcagatggtcacaggaggtcctttagggatcagtggtgcctcaggcagggagcatttggggaaggctctgttgaagctgagttttgggtgcaaaagcaggtaagggaaccgcacatgcagaggccaagaggcaagacagagcccgtactttcggggaacgatgagggccagtatctgcctgggacccaggaccaggatgccaggatcagaagtcccatctgaattcagaccccccaagatgtagtggggaggactctggtcacgtggtcaaatgcatgggcttcacaggcctccctggtggcagctgtgcctggattggagagggtcagcaattgaaggtggtggcacgtttcagggtttcagggtttgattagtggctctggatagagcagcctccactgaggttcaggagaggtgatggtggagccacgcaggggtctcaggagaggcctgtacaatccgatggggcccagatggaggtctgagggagacagggagtgaggcggggaccaggagcctgaggagatgaggcactgttataaggagaaagaggagtgcctggggagtgacatctggggctggggtgagcgggaagcaggtagacaccaagctggggctcaggagggcatgctgggctggagacagagctaagagggccttggcagtgatcctggggcaaggttatgggtggaacaaagaaacatctagaaggggccctggtgcagtggctcatgcctgtaatcccagcactttgggaggccaaggtgggtggatcacttgaggtcaggagttcaagaccagccaacatggagaaaccccgtctctattaaaaatacaaaattacccaggcgtggtggcgcgtgcctgtaatcccagctactaaggaggctgaggcaggaaaattgcttgaacacgggaggcagaggttgcagtgagccaagatcacgccactgcactccagcctgggcgactccgtctcaaaaaaaaaaaaaaaaaaaaaaagccaggcttggtggtttgtgtgcacctgtagtcccagctacttggggttgaggcaggttgagcctgggagatcaaggctgcagtgagccattatcacaccactgcactctagtctgcatgacaacaagaccttgttcaaacaaaactgaacaaaataaaaacaaaaaaaaaaacaagcatttgctgagcccgtgctttgcaccaggccacgttcctggttctgggaacaaaatggcgaacacgttcccatatttagagagcagggcttcattcattggaggggggcagtacccaaaacgtgataaataattgtcatatgatgttagtggttgctgatgttgaggaggcagggaattccagacaggggcagcgggaagttgccatcatcaggaaggtggttggggaaggggtcctcgctaaggcaacatggagcccagatggcacgggtgccatggagtcagctgtggggggctctgaaggaaaagcattccaagtagttggaacagccagtgcgaaggccttgaggttcaagaaaaaagtgggctccgcagagtgcagtagctcccgcctgtagtcccagcactttgggaggccgagagggaaggatcgcttgaacccaggacttcaagaccagcctgggcaacatggcaaaccccatctttactgaaaatacaaaaattagctgggcgtgctggtgcacacctgtagtcccagctacttgggagactgaggtgggaggatcgcctgagcccagggaggtcgaggctgcagtatgtcatcattgggccactgcactctgacctggacgacagagtgagaccctgttttttgttttgttttgttttgttttcttaaacaaaaaaaatggcctcaagaaaaggtgagaaaagtgaggggctggtgtagctggaaggaagagttaccaggggaggtgccgaggcagattgtgtagggcccatgtaggctgtggtgacaacttgggttctgctgtgagatgggagccgccagggttctgagcagaggacggagggacctgaccccacttgggtgtgcgctggcacctgtgggcgcaggggcggaagctgggagaccagggcacgggaggtggacgcgtactttttcctggggccatctccggtgcagggattgggtatggggcgggggtaagggacagacgactccccagagttgataggccgtccctgcccgcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaaggtgtgcggggcgggcggggcgggcagtgcgcatgcgcagccagagagcctgcaaccaggacgcatgcgcacccaatgcctggtcaggggaggaccccggtggtgtagttgaagagtgtggtggggggcggggagctgagggatggacgggggccacgtgggaggggggacaggcttggggggccgggcggatgaaacaccccaccggtcccctcctctgatctgccccaaggcccatgcccacgctcccgccaccttgatgctcatggcttcgtcaccacctccgccgtggatgggatgggcgctgcgaccacggcccgcccggccgcgctcgaggcgctccgcagccttgccccagcccactccccctctcaccctaccacagagcatggtaaataccaagcccgagaagacggaggaggactcagaggaggtgagggagcagaaacacaagaccttcgtggaaaaatacgagaaacagatcaagcactttggtgagtggggcttgtgggttatggggggcaaggtcgaggcaggccctttgcctccagggccctccagcaccttgccagcatcttcccacaggcatgcttcgccgctgggatgacagccaaaagtacctgtcagacaacgtccacctggtgtgcgaggagacagccaattacctggtcatttggtgcattgacctagaggtggaggaggtgagtggagctttccccgggactgtgaaaaggcgctgccatgaggccgccacttggtgacgctgtgcctgttcttcctggcagaaatgtgcactcatggagcaggtggcccaccagacaatcgtcatgcaatttatcctggagctggccaagagcctaaaggtggacccccgggcctgcttccggcagttcttcactaagattaaggtagggtccctgagctgccaggtggctggaggccccctccccagggaaccagcccacaatgctctaggtaaggccgactcctctccactgggactcaagcccctccagtcaccgcatcctagatcaggagagggtggggccagggaggaggagagaagtgggcagattctgccagactttaaaagtggaggccgggcgcagtggctcacgcctgtaatcccagcactttgggaggctgaggtgggcagatcacctgaggttggaagtttgagaccagcctaacatggagaaacctcatctctactgaaaatacaaaattagccgggcatggtggtgtgtgcctgtaatcccagctactcggggggctgaggcaggagaatcgcttgaacctgggaggcagaggttgctgtgagccgagatcgtgccattgcacttcagcctaggcaacaagagcgaaattccatctcaaaaataaataaataaataaattaattaattaaataaaagtggaggtcaggccaggcttggtgactgagtactatagtcccaactatttgggaggctgaggcaggaggatcacttgagctcaggagtttgagctgtggtttgccactgcactgcagcctgggtgacagagcaaaactgcattacaaaaaaatgtgggagcagtaggatgtgctgaaggtacccaggtgaatatgtgggtaaaggacaaaggtgagggtgcctctagggttttgggttttagttcatttttgagacagagtcttgctctgtcaccaaggctggaatgcagtggcgtgatctcagctcactgcaacccctgcctcccgggttcaagcaattctagtgcttcagcctcccaagtagctgggattacaggtgcctgccagcctcagggtttttttgttgttgttgttttgttttttttgagatggagtctcactctgttgcccaggctggagtgcagtagcacgatctcggctcactgcaacctccgcctcctgggttcaagcgatcctccagcctcaacctcctgagtagctgggactacaggcatgtgccaccatgcccggttaattttttgtattttagtagagacggggtttcaccgtgttagccaggatgttttcgaactcctgacctcgtgatccgcccgcctcggcctcccaaagtgctgggattacaggcgtgagccaccgcgcccggcctagcctctaggatttttaacctgcgtacctggaggaacagggctatccttaccgagattagggagaccaaggacaaggcaggctgggaggtggccatgttgagttagaggtgcccatgcagggacactgaggacatgagtgtctcagatctgcagtagagcagggctcccaagcaggtggtctttggcaaatgccagatgaggtccccggcgggggagcccaggccttggggagcccttcatgtaggtcaggaatagacttggggaaccgtggggcgcctctgaggagctgtggctggagggtcctgggccccccagtccctcctgagcgttgggccaggtccagtgagcactgcccaacccccatagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggtggggctccccggcccaggcgggcagcaggaagaccctgagcgggaccccccagggccacagggacccagcccctgaccccagcccctctgtacccccaggaactccagaagtgcttcgatgtgaaggacgtgcagatgctgcaggacgccatcagcaagatggaccccaccgtgagtaacccccgcgccccatgccttcccggcgggccgtgtgtctcccccagccctgtgtcccaagtctctgaagccggctggtgaaagtgcccctccaaggcttctccaaggagtaaggggggtcgtgtcaccttggcacacacccacatatattgagcacctactgtatcccagtatccagcagataaatgctgagctttgagcgcatgtccttcgtgactgtcactgttactgtgactgagtccagcctcagtttccttatccaaaccacattttctctcaatatcagctcacaaaatgcgtgggaaagggaggtgagcacatggcaggggctggtaaacgctggctgttaattggattttgtctacttgtttttgagagacagggtcttcctctctcacccaggctgcagtctcgacctcccaggctcaagtgatcctcccacctcagcctccccaagtagctggggttacaggctgacaccatgacatctagctaatttttttttaaattatgtttttataaagacaaggtctcactggctatatttttggaagtggtaatagacgttgaatctaagtaggacactgtttgatcctattcctaccacttggctcactggttgatcacactggttttctcgtctgtaaaatgggtctagctgcaggactggccctgagtttctagaagcttctatgggcatagccatctagaccaggttctgcaaaccgcagctcccagactcactgcctgtctttataataaagttttattagaacaaagaagccacactcaattgtttccctatcatctacaaccgatcttgctctaccacagcagagttgagtcgtgatggagaccatatggctcacggaaccagaaatatttagtctgtccctttaccaaaaaaaaatttgctggcttttgttctagattgcactatctaaatttaaattaaagttaaataaaatttaaatttccagctgggtacggtggctcacgcctgtaatctcagtgctttgggaggccaaggcaggcagatcacctaagggcaggagttcaagaccagcctggccaacatggcaaaaccccatctctactaaaagtaaaattagccaggcatggtgacaggcgtcggtaaccccagctacttgggaggctgaggcaggagaatcacttgaacctgggaggtggaggttgcagtgaaccgagattgcaccactgcactccagcctgggtgacagagtgagactccgtctcaaataggtaaaatatcaataggcaggaagccagcttggggatgtgcaagggacaacggggacaacggggaccaccggctggcggccccacctcatctgcctgccttctcctcacaggacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctc

SEQ ID NO: 37352 - DNA, 86085 bp, Homo sapiens; identical to SEQ ID NO: 36931

SEQ ID NO: 37353 - DNA, 14584 bp, Homo sapiens; identical to SEQ ID NO: 36091

SEQ ID NO: 37354 - DNA, 15604 bp, Homo sapiens
cacacacacacacacacacatcttccagacccatcccctgcctgccagctccacgagccagagagagacagagcgcggacgccgcaggaggcagtgcctggaccccagctgcccaggagaggtgaggggctagatggggcctgaggacactgtgccagaaactgtggctttggccaggccgaaggagagaggtacaacgtgaaggtgggggctggatcagcccagttcagcttacagatagggtgttgggggtatagaggataccacctgtctctccctccctcattctctccccgtgacccccaaatgaggtgaggccgtgtggctcccgtgggagcatgtctgtgtctgtgtctgtgtctgtgtctgggacctgcgtctggctcaggaggcagagagcagcagatacctgccaagccgcagcctcctgtctgggaagcagcgggagagaggaccgccttgaccagagaaaccccagtgccgcttccagttgctgaaagcagagtgcagcagggacccttgctggtccttcccctggaatgttgggctgggaagggaccggctgggaaaggcagacagttggacctggagcagctgtcttatcctgactctattttttccccagtgtgatggggataattgtgttagttggcttagagaggtggctccgtgtggttattctcttcccccaggtaccaccccaccccgagcccttgcttcttgcctgcctgctggtctgctctgacctccacccttgccagggcacagcccccggagggcaggggtgataagtcagggcctgccaggcctctatcttgggatacagggacttagggtggccttggctggtgccaagcccatgaatggcctgaccctggcacaaggagtccaggcggagataaggggcgacgctggcacccacaaggagacagcaggttcctgccaagctgccagcctgcaggctcttcccagggagaggggagggggacacagagcgagaacaataataaatacagagtgtgaactgctgcatccactggggctggggtaggagaggaggaagtatgcccagtggggggtgggcaacctctctgagagcctggcatcatgctgcctggctgtgatccggcaggggcctctccctgggaaagggggtctccagctttctgggggatggggaactggtttcccaaacctgactccatcccagagtcctctggaccctccaaattctgaatgtttcctcctcccagctttgccctgccgccccccatttccttgaagtcttctccaaaaatgtctgttttctgtgtctgcccatcttgacccatcctcacccccttcaaaaaaaaaaaaaaagacaggtatagacaggaactgcctgcccgtgtcctgggaaaggccagaggacagttttggccacagatggctctcccaggcttggagagacatggctaggcaatgttcacggatgcgcagggggattccctgagggggacttggggacactctcagatggctggtggggaggggacacctgccagccagtctggagtagagccccctagggggtagagggcgctcaggacctggctgagccagtcatgtccacggtcacaactggggcagccaggacccagagccttgtaggaatggggcttggggcagttcagacctttgtccatgctgagcagcaaaatgggaggctaaaagtagtagggagctcttctgccccacagccagcaaaatgacactcctgggctggggggctggcatggcacaccagaaagctgtggggtcacactgattggagttcaagttcagatgctgtatgtatgtatgactttgaccagtctattcctctctctagggggtctcaaaatgggaaagtgacttgcctagggtcgcacagccaagcacaggtgggactggggtgcgtatttggctctcccagtgccgtcctggtttccccaccaccacccaagccacagaagcccaaaggccttaaccacagcagttccccagggcagcctgggcatgtgacaaggaggactacagggtctcttaaataattaagctcaagtattggctggggcagccctcatgcacagacgcaggcacacaggctgtgtgggggaaggaccaggtttaatcaggtcacctcaggctgcaagagcagttcaggcactgatgtattttaaggagcatctgggaggctgggggagggggaggagccagggaagtgtcagctcctgcccgggggtcctgagtttgttttctcactctcccagggcccaccatgcacaagctcccgatgttcgggaagcccttccagcgtcatccttgtgttccccgtcctttctatttttaaaccaccgtacccattcctcccatctgctcccctgtgatgggggcttggggctgggacatttttattgggggagttgtttttaagcttagcagagttggtgagtgactcacccaaggtcatggtctgagtcagcgcaaagccagaaataaaagccccagtcctggctccccaggaattccacacccgactcctccttctccaggggagggtgggcgccaccctcaaggaatggctggtcttcacctccccagacatctccagagggcagatatgctgcacctgacctgctgtgagagctcagcgaggctcttcacctctctgagcctcagtttactctttagaagatgggtgtactaagccaggcgcagtggctcatgcctgtaatcccagcactttgggaggctgaggcgggcggatcacgaggtcgggagatcgagaccatcctggctaacacggtgaaaccccgtctctactaaaaatacaaaaaaaaaaaaagaaaaattaaccgagcgtggtggcgggcacctgtattcccagctactcgggaggctgagccaggagaatggcgggaacctgggaggcggagcttgcagtgagccgagatcgcaccactgcactccagcctgggcgacacagcaagactccatctcaattaaaaaaaaaaaaaaagaagaagaagaatgggtgtactaatggtagttactgcatcgggttcttatgagtacgaaatgaaaaaatggggcaaagggcttggcacatggtcagtatcaatagatcactagatggtggctgaggctcacatcaggacttccaatgctgcttttttaaaattattattgtttttgagacagagtcttgctgtgtcgcccaggctggagtgcagtggcgcgatctcggctcactgcaagctccgtctcccgggttcacaccatcctccggcctcaggcctccccagtgactgggactacaggtgcctgccaccacgcccagttaattttttgtatttttagcagagacggggtttcaccgtgttagccaggatggtctcaatctcctgacctcgtgatccacccgccttagcctcccaaagtgctgggattacaggtgtgagccaccactcttggcccccaagctgcattttaataatctgtttctgttccccccgctggactggggtgctctaaggacagctgttgccccacgtttgttgttctggtgcctgcactcagtttgatttcatttacatatgtgtttttgaaaacctcggaggagaattggcctgaccttcattagtcatctggaccaacgatgattcacgtagctgaagagaaaggtgaggtccagagaggagcaggtgcctgccccaggtcacacagcactgggtggctgaccaggctgcctttccctaatccgctcagactgagaggactcatggtcaagagaagaccatacagtcaggcgcggtggctcacacttgtaatcccagcactttgggaggccaagggggttgatcacctgatgtcaggagttcaagatcagctggccaacatggtgaaactctgtctctactaaaaatacaaaaattagctgggcatggtggtgagcgtctgtgatcccagctactcgagaggctgaggcaggagaatcacttgaacccgggaggcagaggtttcagtgagccgagatcgcgccactggactccagcctgggagacagagtgagactcaaaaaaaaaaggatgggtgcggtggtttacgcctttaatcccagcactttgggaggctgaggcaggtggatcacaagatcaggagtttgagaccagcctggccaacatggtgaaaccccatctctactaaaaatacaaaaattaatcgggtgtggtggtgcacgcctgtaatcccagctactcaggaggctaaggaaggagaattgcttgaacccgggaggcagatgttgcagtgagccgagatcatgccactgcactccagcctgggtgacggagtaagattccatctcaaaaaaaaaaaaaaaaaaaaagaggactatggccaggcacagtgactcacactgtaatcctagcacttagggagactgaggctgcagtgagccatgatggtgccactgcactccggcctgggtgacaaagtgataccctgtctcaaaaaattaaaaagtaagagagaaccatgacaaccatttcctgccccattctgcatccttttaggggagctgagaattggagcagagtcccagcatgggctgtggttcatctgccaagaaggctgagtcaccacccagagtgccccatgacactgcatccagcctcaggttatctccaaacagcctgacatttgtgtttacttctaggcccctttgtctgcagagtcagtcatttggggtctggccttctgcagggaaatgaagatgagcttggctcagagcccaaactcagggccgggggacagggggatgcacactcgccggggggcctttgacacagctctgtggctcctcccgacaacctgggtaggatgttatgatcagccccatttgacagatgagggatctgaggcacaaaaagggagagttggccgggcgcagtggctcatgcctgaaatcccagcactttgggaggccaaggcgggtggatcacctgcagtcaggagttcgagaccagcctggccaacatggtgaaaccccatctctgattaaaaaaaaaaaaaaaaaaaaggctgggcgcagtggctcacgcctgtaatcccagcactttgggaagctgaggtgggcggatcatgaggttgggagatcaagaccatcctggccaacatggtgaaaccttgtctgtactaaaatacaaaaaattagctgggcgtggtggcacacgcctgtagtcccagctactcaggaggctgaggcagaagaatcgcttgaaccccacaggcagaggttgcagtgagccaagatcacgccactgcactccagcctgttcacagagcaagactccatctaaaaaaaaaaaaaaaaaaaaaaaaaacacacaaaaattagctgggtgtggtggtgggcgtctgtaatcccagccagctacttgggagtttgaggcaggagaatcacttgaacctgggaggcagaggttgcagtgagccgagatcacgccactgcactccagcctgagggacagagtgagactctgtctcaaaaaaaaaaaaaaaaagggggagggtcaccggactcagtggctcacgcctgtaatcccagcactttgggaggccgaggcgggcagatcacgaggtcaggagatcgagaccacagtgaaaccccgtctctactaaaaatacaaaaaattagccgtgcgtggtggcaggcgcctgtaatcccagctactcgggaggctgaggcaggagaaaggcgtgaacccgggaggcggagcttgcagtgagccaagatcgcgccactgcactccagcctgggcgacagagcgatcctccgtctcaaaaaaaaaaaaaaaaagggagggtcacaaaactgggttgcagtggaacaaggatttaaactcaggcagtctgggtctcaggctgccctcttacctgactgctcgttctgaagggcattattcctggcaggagatggccccagaaggacacacgaaatccccctggagctggcctttagctctgtttgagtggaaacaaatgttctagaaacatatcagtttctctgctcttgggggagtttattttcccatttagtttctcagggaaagttcttttggaaaaactccagcctcatcttggctgaaccaggaacagaatttatattcacaggaagagcactggtttactgttagacagatctgggactctgtcacctgctgtgtgactttgggcaagtcactcaacctctctgagcctcagctatctcatctgtaaaatggaaaaattgtaatttcaactctatagggtaactgggaggttgaaacgtagaaaataatttctgtaaagacttttgcacagtacatggcattcagccaatgaaagcctcattttcacttgccctctttggcagcaatgctctggagagggggtctgaactggagggttgctccgtatctccatcttcccttctctctggtctctcgggctgctgggcattgtacagctcctccaagcccacgccctggcagggcccagagagggaaaggccctgtaccagctcacacagtaggtcaatagcaatacagagcctggacacaggactcctgccttcccactggaaggctccagatcatactgattcaaattctggctcagactttgattggtgtgtgtccttgagtgagtgatttaacctctttgagcctcgattttcttgtctacaaagtggggtaataatagcaccagccttgaagagcagttgcaggaattaaataaaacaagagactgtggagctttgaggggtgggcgatccttagggaagaagagaggatgaaagtgaatggtgggcttggcccagctcggctgggtctctccttcccccactccctcttccctcaacacccaattccacagccttgtctaggaggggcaggctctcgcccagcgcccagcgcctactcagtgcttcccacatcccacctcaattctcatttcatcctcaaaagagcccttggaggagagagtcttttttttctctctccctctcttttttttgagactgggtcttgctctgtcgcccaggctgtagtgcagtagcttgattaccactcactgcagccttgacctcctgggctcaagcagtcctcccaccttagcctcctgagtagctgggaccacaggcatgcaccactacacccagctaattttttttttaagacagtgtctaactttgtcccccaggctgcactgcagaggcgtgatctccgctctctgcagcctcgacctcctgggttcaagcaatcctgctgcctcagatgcccaagtagctgggactacaggtgcgccaccgccatgcctagctaatttttgtaatttttatagacacaagctttcaccatgttgccccagctggtcttaagctcctgggcttaaaagatcctcctgccttggcctcccaaagtgctgggattattggcgtaagccaccttgcctgttggaggaggaattcttgtgatccccatttcccagataaggaaactgaggctgcaatgggcgacaggggagaagcctgttctctctgccttgtggaagctgcctgtctcctgcccctgcctgagctcttgccctgaggccaactcgctgcctcctcttggtcctgtctttgctgtggctcttctgcctcccttctgctctctggtctctctgccacctgagagcccatcatggggaggctgccctcgaccctggcccagaatcatcagtgggttcttcccccatccctgcagcccacttagcatgaggccctggagccgcacagtcacttgggtgggaggtctggctggccagagcaggccccagctcagccgcgtctccctggtaaccaccatgagctgcatctccccctctccatcctcctcttccctccctgcccctccatggcctcccagcactggctgtcactgccaagcacaataccaggcctgggaaaactgcagttgggaggccaggaccgccctgctccctagagagagggaggcagggcctctgtccccatcgcctgccaaccctcacccaggtggggcaggtggcactcaaggagtgcactgcagggcgtctggtgcttcccagctgtgtcatcttgggtaactttgctgccccgtcttcttttttttggtaacagctttactgagatatcgttcatataccataaaattcacctgcttaaggcgttcagttcagttgtttttagtacattcacagagttgtgcagccatcaccacagccaattatagaacatttccattccccaaaaagaaacgttctacccattggcagccctcccctctccctccttcccagccctggtgaccaccagtggactccctgtctatgaggatttgcctcagagatggaatcatgccctctgtgtttttgggactggcttcttctctgtgaccttgcaaacattctcgcataatgtgtgcagggttcatctagggtgtagcgtgaatcagtatttcttcttttctttttcttatggccaagtgctagtctaccatgtgtctagaccataatttattatccattcatctgctgatgggctcgggctgttttcacttgttggctgttgtgaatgagcactggtgtgaccattcatgaacatttatgtccaagtgtttgtgtggttgcttttttttttttttttttttttgacagagtctgggtcagtcacccaccctggagtgcaatggtgtggtcttggcttgctgcaacctctgcctcccgggttgaagcaattctcatgcctcagccttctgagtagctgggactacaggtggatgccatcacacccgattaatttttgtatttttaggagagacggggtttcaccatgttggccaggctggtctcgaactcctgacctcaagtgatctgcccaccttggcctcccaaagtgctgggattacaggtgtgcgccaccacacccggctgtttgtgtggttgcttcttgaagcttccgtattcttctctctaaaatgaggataatgggtgaaaaggccaaacctggtttgccctgccaacctggcatgagcttagacagaaaagccccacttcagccttttcagggttgagggtctgtgaggcaagccaagcccggggctccagtgccttcctgactggagggggagggttttgggaggagggaggatactactccacctccacccctaggcatggcagagccagctcagcatcttggttcagaaaaattccacttgctgtataatcttgagcagaggccagaagacctgctccagtggactcctggactcatccaggcctgccatgcagggtgttcaggctttctgagctctggactccaaggaaccttacaggaaccttgtgggtgattttccttccctgggaactccaagctctggggtgggaggggtataaattggaggccacaggcctgtaaccccagcattttgggaggccgagggaggtagatcaactgaggtcaggagttcgagatcagcctggccaacatggtgaaaccccgtctctactaaaaatacacaaattagccaggcgtgttggcaggcacctgtaatcccagctacttgggaggttgaggcaggagaatcacttgaacctgggaggcagaagtgacagtgagccgagatcacaccactgtactccagcctgggtgacagagtgagactctgtctcaaaaaaaaaaaaaaaaaaattagctaggtgtgagggtgcatgcttgtaaattccagctacttgggaggctgaggtgggaggatcgcttcagcccaggagatggaggctgcagtgagtcatgaccatgtcagtgttccccagactggatgagaccatgtctcaaaaaaaaaaaaaaaaacaaaggatcaatgctagccccattttacagaacagaaaataagagtcagaagttaagagtgttgaccaatgcgctggacgagttggctcatgcctgtaatcccagcactttgggagaccaaggtgggcagatcacctgaggtcaggagttcgagacctgcctggccaacatggtgagaccccatctctactaaaaatacaaaaaatcagccaggtgtggtggcaggcgcctgtaatcccagctactcaggaggctgaggcaggagaatcgcttatacccaggaggcagaggctgcagtgagccgagatcgtgccaatgcactccagcctgggcaacaagagtgagactctgtctaaaacaaaaaaaaaaatttgaccagagccaaggctatgtagccagaaggtggaggatgcaggattcaaacccaggcctgggtgtggagcccatactcccacctgccatgttggagctgatgtgtggcttggcttgcttgaagtcaccaagttgtaggtgacaaagctaaggtttgaacccagatgtgtgactctgaaacaactgacccttatgccgaaccatattctagaccatcactggccaccctacccagccacctcccaggcccctggagttaagagaattgaactgcaaactggaaggacttaggggtcatatgacccctagttttgtttttctggtgaggactctgaaccacgatggggtcgtttgtgacttgaagtaacgccgtgaggatagcaggtgggaccagccctcctcactgtggccagggttcaggagctgctcccctggactaggctcacctgtgcctctttcttcctcttccagacggagcccgtggctggtgaggccgcagagcagggccaggccgggccctgcccgcaaggacgaccaaacccctcaccggcccctgggccccagagcccaccaggctctcctgctggccccaccatgacttcagagtcgacgtcacccccagttgtgcccccgctccactcccccaagtccccagtctggcccaccttccccttccacagggagggcagcagggtctgggagcggggtggtgtcccacctcgggacctacccagccctctgcccaccaagcggaccaggacctattcagcgtgagtacctgccccttgcccaggcccctgacccttgtcaggacaggggctgaccatccccatcctcttccaactcctgttgtcctcacctgggacaggggaactgtgtgtggaccttccagtaactggatggatgtttgtcccatacatccattcatccatccacccatccacccatccatccatccatccatccatccatccacccacccacccacccacccacccacccacccacccacccacccatccatccatccatccatccatccatccatccatccatccatccacctgtccatccatccatccatccatccacccacccatccatccgtccatccatccgtctgtccgtccatccatccacccatccattcatctatccatctattccacaaagatttactgagctcctgaccagtcaggatccataagctgcttacaatccagagggaacttgttcaccatccattaccacccagcagggttaggggtgaggacccagcatggggtaccagaggagatgatgtcctggttgggtatggaagatgtatcaggtgaagaagggagctggcgattctgggcagatggtacagcatgggcaaaacccaagacacggagttaacctttggagaggggtaggtaggcgggacaaagactaggcctgggcctttggggtaggtcaccgatgaggtggcataggggagtaatacgggtccatatgggggaggccaaaggatcttttgggaaggacagggtctcgctctgttgcccaggctggagtgcagtggtgcagtcatggctcactgcagcctcaacttcctggccttcagcaatcctcccacctcagcctcctgagtagctgggacgactggtgcgtgccaccacccccagctcatttttttaaaaaaatgtttgggccagacatggtggctcatgcctgtaatcccagcactttgggaggtcgagacaggtggatcagttaaggacaggagatcaagccagtatggccaacatggccaaacactgcaaaaccctgtctctactaaaaatgccaaaacttagctgggtgtggtggtgggtgcctgtaatcccagctactcaggaggctgaggcatgagaattgcttgaacctgggaggtgtaggttgcagtgagctgagattgcacccctgcactccagcctgggtgacagagaaagaccctgtctcaaaaaaaaaaaaaaattttttttgtagagatgggagtctccctatgttgtccaggctggtctcaaactcctaggcccaagtgatcctcccgcctcagcctcccaaagtgctgggattacaggtgtgagccaccgtgcctggcctcattatcgttgaatggggatgactgtgtggtttctggcctgggtcaagtttctcacagccctgaggcacgctcagcagaaagggcccagaatggctgtagggatccggggaggagttcctcaggccacagctccaatcccactaccctatctccaggacagcccgggcctcagctggccccgtgttcaagggcgtctgtaagcagttctcacgctcacagggccatggcttcatcacccccgagaacgggtccgaggacatcttcgtacatgtgtctgagtgagtcccctccacctccctgttcttggcccctgccctagtgtccccaatggtgcctcaaaaatggctctccaggcctctcctctcactggctgaggtctgtattcatggtgccttttctgtcctctgagtaggggctgagggtgcgttgggagaggagggctggggccagggagggagtgggcacgcagaccccagaagcctgggagccagcggctgggccctggatcctgttacagcatcgtggaggtctgagagggctaggccagctcctgagcctcttggcctggaaagggccttcatgtgggtgggccaggaggtagagatggatatcatgtctaggcctggccccacccacttctaatgccaggaggaccgggggaggtcactgagcttctcagagctttagggacctccccgtgccctttcacatctcggtccccaagggacccagaaagggaggtacagtttatgagtcccattttattttattttatttattttttgagagggagtctcgctctgtcgcccaggctggagtgcaatggcacaatctcggctcagtgcaacctccacttcctgggttcaagcgattctcccacctcagcctcccaagtagctggaattacaggtgccagccaccatgcctggctaatttttgtacttttagtagagccagggtttcgccatgttggccaggttggtgtcaaactcctgactcaggtgatccgcccgcctcagactcccaaagtgctgggattacaggcgtgagccactgtgcccagccatgagtcccgttttacagattcgagagctgaggttctgagaagcaaggcctggccaggcctcctggcctagggaggcttagggccaggctgcccccaaggccaggccacaggattgtctggggcacagggcctgctgctgggctaatacccctcttcctgcccgccagcatcgagggggagtacgtgccagtggagggcgacgaggtgacctacaagatgtgccctatccctcccaagaaccagaagttccaggccgtggaggtggtgctcactcagctggccccccacactccccacgagacgtggtctggccaggtcgtgggctcctaggctgagtggttcacaggccagctggccgggggttggggagccacacagggtgaacgggcagcagccggctccatgccccactgccctggctgatgagtccttcggtggcctcagtgtgcacgtctgtctgtccgtctgtgcttgtggctatgagcgtgtgcctccacccaccccacgacccgtgactactgtgcaagctggccaggaggtaggtggagggcaaggccaccagacctggcttcgcgctgtccactgcctctctcctcccctccctgccgcagacacgcaggacccgctcgccctcctgcttacccgtccccacggtgactgagctgcgagagcctgcgctgggctcactccctggcctccgcccctgagctgtcccgtgtcagtccctggcccggagccaggctctctgtgctacttacatctccctcccttggctgaggtcccccgccacagcctggacccttccctcagaagcctggccgatgggtgcttttggggagcctctcagcctctggcaggggaggaggactgacacggaggcacacaggcctctcactgccgaggccagccttccttcctgctctgctctctcagtgccatggagaggcaggaagaggggcctgagggcggaaggggtttggggctcccatttcgccggccagtccctcctcctcagcctggcagtggcgctgggctccttcccctgggctgtactgagccgagcccaggggtttgcagagggtgggggtccatctctccagcttggctgcagacctcctttaccctgactcacaagccccactgatgctctgggccatgcccggctgacggctgctgtggatgccgcgagggacggacacacgtccggggcacccacgaggagggcccccagcctgggagactggccctgcggcctccacgtcaaactctcttcccaaagccctaacagaccagtggccgaggtgtggctcttattgcatccatccctgaagatgtgtggctgttgctgtcacctggagtccttttggggccaagatgtgtgtgcacccggggtcgtggccattcactcccaggcaggggtgagggtggcctggcccaggaggccaggaaggagggccctgtctgcctccacctctgggtgcaccccctgcctaccaccctcccttctagagagcacatcgcctgaccggggagaagtggggccgtggttcgagggagggctggccaggggtgggacccttatgagactcagtctgtgagtaaaactgggggctcaaatgcccaggatgaggggatcagtgactgtctaggaggatcccttgccttgtaggtgccccaagaccgcagggtagaaatcagccgggatgcctgcatcccacccccggccccagggcccaccacataaaatctgggagcccagagctgctgaggtgtggtcagctcccctaaaatgggcacggcccagcctgtcccatgaggaataaaggcccctggcccccttgagagagggcttgttggtgagggctgactcctgggggcccccaaggctcccctcctgtggggaggccaccttttaaggcaccactagcagtcaggatatggtggcatcagccctggggcctcctgggtggcaggggggcagcagctctcctccccactcacaggccctgcagtgctcatttggaattcctcccaagacccctggccacccagaccccccattcttcctaacactggcaataaaccctcaactgtgacccac

SEQ ID NO: 37355 - DNA, 32812 bp, Homo sapiens
ggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggttcggctgcttcctcctcgcgcgatctccccgctttcctcccctccacccctactcgtcgcgggcccctggcctccggctctccggccctctccaggccgcggtcggctccgacggtgtttccctccttccctccgggcgggctgaggcggctcccaggctcccgggacaccgcggaccaacttctagtctctttttctctcctcgaagcgcttatctgcgcgcagccttatctccgagttatctcggcgcaaaggggcgggagccggtagttaggcaggcagagaaacttctttcttgctatctagccaggtctgtgtgtgggcattaattttagtgtggtaatctccgatgagccgaggcgatttggaagagcagcctggaggaggccagcccggctgcatttcacctccctcccccactcgctccgagtctccctgtcattcttcctgctctcccatttggggtcgcctcggctctggggcggtctcacgctcccccctccccagcccgttgcgttccccctccttttctctgctctccgctccaccccgctacgtccgattccggaacggtccggcgtttctgctgctggagatgaccgcggggtgggccgggtggcccggccggcgtgagcgcgcacgctggtggctgcaggcgcgggccgtgtctaaggtgtgcggcgccgcggggacgccggtggggctggcgattcccgccccacaagctctccgcattgcctctgctgggaaggacccagactgctgcccccgccctggcgtcccactttccctgggccgagttgcatttctctctggggctcgcgttcgggctggtcagcgcagtccgggaagctctgggagagccaatataggagaacgcggcggtttcgttttcggggacaggttgccttccttacgcgaagggttttcccgtggggaaccctcaccccgaggcatttcgggagaggggcatccgcagagaggcgggatgcggcggtgccgacacgcacagctacttaaattcttttgtgtgtcatcagcccgggggagacactttagggcggaaggaaagcctcagccagcttctgcagatcacccctgggatctggcgcgcgcacggagaaaggatgcggccgagggggtgggcggggaggacgcggggaccggagcggtgcctttgagggagggctggtatcccagcccttccagggccctgtggcggctgcgcaggctcccttcccctcccttattgatctccacgcccggggcagaaataggatctttgagaagtctcaaatgggatctttgagaagtcagatcccatttgaactagaaaaaggagtggaggcgaggtagcgtgcagcctacgctcttgttaacccgtcgatctcctaccatacccgtctcccccaccccacctcaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcaggtaagggtcgcgcctcaggttcggggtgcgggtccaaagcgctggggcgcacgggggacgtggagcagctgctccactcgggccctgttttcaggactttctcgtccgggtgcgcggaggtcggcctggtcccaggaaggatttgcaggcctgtggctgggtaacccagagtccggtagcgctgaggcgagttgtgccaagacttgagtctgttgtgccaagttcctttccacggatgagactaaatgcacatctgtaccttcgtgccttggggaagctcagggccttgatgagtagtgaatggcatctgctattggggaaaaacgaggctgggagggaactaacagcgcttgagccccatcgcagaccctactttgggtgagtggaagaaattccacgatgggagtaagtttgggagagtggcgggcacttgatccacccccaaacagacacacaagcacatgcaggctcacccagtttaactctccaaagggtgcgtgtttgtgttttcctagagaagggtatttagaagagcacaacagaagaacctagatgttcctagggaagctagttggcgtctcctctcccacaagggagagagggaaagaagagagggcacctggagtggtcagacttgtgacttcatggtgaaggagagctggtggataggcccttgggcttggcatcagctgggccttggtctggggctgctgctcacatggccaggctgcaactcagggatcctggagctggggcacctattctcccttcgaagtttagcccgccaatttttcagtttccaatttgactcattttttcctgtatctgggagccattagggggtaaaccgtgaaaacgctattgtcaaaaatacctggaaatacctcgttttgaaaagtgttttgtttactccagcacaggagtgtgggagccctgttaggctgtttttctcagatgcaacattctgcgtccttggtgctttcaactggcttatcttaccttatatttcacctgtttgataatctttctaaggaaacaacatctttttttattgtagtttgtttgaggggaggtgtgggggaggccccttgagtcacagaggtggcagagtggaggaaggcacattactccaaacagtcctaccccggtgtcttgtgtatcccaggtctgtgcttctcgtgggagcctcgacgctacctttaggacagcaagtcagtcctaggggccaggattccttaggataaaatgggacattcccaaccttgtccgcaaaagacacgctggaaatgcaagtggtctgaaagagagggaaccaatttgaacagctctctgatagcctgagttctttctgtcttcttccaagcgctgcaagacttggtctcaaaattccctctttttagttttgctctgtcgcccagtctggagtgcagtggctcactgtaatctctgtctcccgggttcaagcgattctcctgcctcagcctcccgtgtagctgggattacaggcgcgcgccgccacacctagctaatttttgtatttttagtagtttttgccacgttggtcaggctgtttttgaactcttgacttcaggcgatccattcgcctcagcctcccaaagtactgggattataggcgtgagccaccgcgcccagcgaaattccctctttttgcttctgctgcaaagctggccctggagaccatttttcccctgtgtgtggaatgggatcgggggaccctgttgagatttgcactgttggcttgggacttgagagtcagggctctcatccttacctctgcatagggacccgtgtttggctcccaggagcagagagatggagaggctgggaatctctaaggaggtaatggttgggtgtgaagcttattttgtcagtcggggagttccgtagggaatgtgcaagggtgttgtgagttgggtgaggggtagtatctgcagattgagccagcgcctgcagctctgcctatttcttgacacaccttagcctgatctccaggttcctttcctccaatcttccagcatttcatatggctgagagagtcttttgatgtttacagtaactggtcctgtatgagaaatccttttagaggcagtatggggcagttgtgggcaagttaatatgtttctttttgttttaaatttagcctacacttttcctaattttttcatcttctgggcacaccacagttagaggaattttctgtagacccagaagatttgttatttttttaagtatttttttaagtatgtttaaaaaaatgggaagggatttgggaacacccagcttttgcatagagtctgttaggaaatcaggaagtgactgggaccaagccagtattggggtgaagggtggggagcgagtgaccctaactttgcttgtcctcacaggtattctgaggccagcttcctagctagatttcctgtttcttagatttttttttttttttaaacaaaccgtttttggaggcagacactttaaacaccagagctaaaacctgagtgctgaacttgatcaacccgcacaatttggaggcttctggaaacccacactatgcacctctcgctgactgggtagatggggtgagcttactttggggtgagctcagagtcctcacactcctttatttcctgggtcctacaccctcctaagcgcctgcagaactgtgagtccctgtgtcttggtaccacacacagaaagacaggtggtggtgcccttctcccctgaatctatcactccccaagggcaccgcaaacagccatgttaggagagaaatggtgagttgaaaagggggaacttggtgagcaagcccccagcttttatatcttacagcttttataaagacagcatttttttttcctttttagtcacttacaggattatagctgcctggtgggtttgggaaagaggtagggagggaatgagagagattttattcaactaaaaataagcaagcttcctaggttgtatttatccaaagtggacttttaattaaattttgtctttgggttttcagatgactaaatagttctacctggggagttcacactgtcttctaataggattcttattgttcccagtcataggactgggttttccagggaatgccccactcctctatccagaggggctctgataggtaacattttaaagtcaacaacaaagacaaataccttgtttaacttcagtgtccttgaagacctgagcattttactgattaccgtagtcaatagtggcttttagggcggagaagaataaacctttgtgatgtgttgtaagttgcagtatccccatgacaactttgaactcgggttgtgtaggatgccagtttctttaaaacttaataagaaatgagaaaagagacttgttttgtaaatagtattaatggaattaaagtttttatgctaaagtcatatttaaatatcgttaccacacagttgatagtagacacaagcaataaactgcaaggggatgagaaagaaccaaaaggttcaccagcacataatcttaagctaaaactctgaagtgtaatgtttatttactttaaaaagtgattcaggaatgcttcttcaataatgcagaactaggacatttaaaccttctataatctaaagaaccttaaatggcggtctatacttttttttggtctatacttacaataagtacctttctcatttttagagacatttattcttccatatttaaccttcttgagaagtaataaatgttacatttactcttaattaggatttgtttttattagcaggtttaggttattgtgaattctgaaaactaaccaaagaataataataataaaattatgtaaaataaacacattttaaatcgattgctaactcaaaatgatcactgggaaggtcttggtaattttctcaatcagtaaggtatcaaccttttataaaaattttgcagatagaagcagttggacccacttctaaatcgggattttagcatttgatctttgtggcatgaaaataaaactctgtgcttaacgttagtgcatttttcccctgaaaagatgagagtaatcttctcatttctagtttctaactaacgtaggtgcctaagaatagtacttttaatttcacttgtgtatctttaattggagaagaggcacatatggacgggtggcagatgtagaaaatactttttaaaattacttgagataaaagttaatgaggcagcctcgctgtgtccccggatatttgtgggttgcagcggggctcagtggtcagtatttctgtgtggcttgctcgggtttggcaacgacgtactgtaatgatgatggatttcagtctttaaaagctccgggacagcctgagagtaggggtcaggggactcaagccgacctccccaccgctcatctcggactctgacgtcctctgcttccagcactgtctctttcccggagtctctactggggcgctccgggtgtgcagaagtattggacaaatggtcagtggagcaatagtgacgaaataaccctgctcctggctttgcggccaaggagaaaagctcagccgggaagggcacgggcagggaagccgggcaccggggctgggggccggggtccccggggtgacgcggggagggacgggtccggcgcgcccactcccgccctcacgcaccgctgtcgccgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtggtgagtgtgacccgccctgcccctggctcgcggccggccccgggctctcctggcccggccggccccgccctggctcggcctgccttgggcgtccccctcccaggggacaggtgcggccgctgcggtcccaccctagcggggacccagcggtaccatcctgtcccggctgttccaacgcccacccgctggcgcccaagtagaagttaccccgaaactggcctctgggaagccaagatagcctttccccatgtttacgcgcaggggatgacgtccgtaaatgacaaaaacaaaaacaaacaaaaaaggaaggtgcaaaatgttaccatgttttaagcaaaaaaagaaaaaataatctatatatctctaggtgtacttgccaaagcaccgtaataattctggtaagataggcaagaaattggtgatggtaacccgaggagaaaaacagtagacctaccgaggccgggcgaaggaagacttttttcactgtgtatggtttagattttatgcttgaaaaaccatgctcacttataccattcgtcccccaaatagaatatgccagaaatccacccactcacgcctcctcacagccacattcttttgggtgccgtttactttgtcctttccaccttcttggtcacttctacctcttatcctcaggtgtatccccaaataccatatcttggattgcccttgagcctggtgaaaatttatttgctctaacttttgttatttcaaaatcagagaactttgtagaacttgagtaaaagtgtggtttgtatgttcttaagttgagcattttccccaattcgcacacgttttactgtttttttgttttttttttttttttttttttttttgagacggagtttcactcttgttgcccaggctggagtgcaatggcgcgatctcggctcaccgcagcctccgcctccagggttcaagcgattctcctgcctcagcctcccgagtagctgggattacaggcatgtgccaccacgcccggctcatttttttgtatttttagtagagacagggtttctccatgtaggtcaggctggtctcgaactcccgatctcatgtgatcccgcccgcctcggcctcccgaagtgctaggattacaggcgtgagccaccgcgcccggccaccatgttttaaagtaagggaatcctgatttcagggattaatctcgtattgtcattgttatgtgtgcttcctagccggagagagtatttaccgctgtaatagagaaaataaaggaaagctttcaccagtcccactctaaggttaacatttgtttagcgaagtactcataatctaataaccctttaaagctaaatatgttacagttagatgccagacgtcttaagtatcccagtaatttatttgttatactctaattagcaggaacaaatgctacacatgttgtttgtgttaaatagattagagtgaaattgcatcacaatgtaagtctgacaccttaaagagaagcaattagttttatggttggttttgttttaatgcatttaaaataaagtggccgaggttaatttaatgagtgtatgtgccttaaactcgttacaacctcccacagcttaaaattttctttaaagggtacccttaactgcagtgtgtgactgtgggtttcatgttttcttaaatgcatcatattaaagaagaaaaagtagtaactggaaaatatcccacagaagttccttgttttcatataatagacaacacatgaacaatgaaaccgatttatttttctggaaaggcacattgagctgagtactaactgaactttcaaaggtaacattttctagagattgagcaaaaatttggtggaatagtagtcatttaggttccagttgcattataaatttgatctagtaacatttagatagtgccatttgttttgtgcatgtaccagtaaaaataacttagaaggaaaaaaaagaacagtttttagcatttctgaatcgttagctttctttgtgcttagcaggtgtcttggccataaccaaggtcagcaaatatgctttgtaaatgggttataaatgataccaattgaagggtgtgtcactatcaattaggtctccttgtgggcttcttatttatggttttgatggatctggcttagttctcagaagcagaatgttgaactcaagtttgtttagccagcactatagaaccaatcactgtgaatttgaacttgcaatacattgcaaaataagagatttatggtgtaacttgaattccttgtcagtgaggaatatgactgagatcacttgttacaaggaacttttataacccattcacctgcatttcacatgtttatgaggactggcttcacttatgatctgcagttgacagtcataaagtcctttgttataatggcaaattctgataacaagtttgcttcacattggctccaaattccactggaaactgtcataaatggctggtttataaagtgaaccttcctgtcccttgtttactgatttcacatttatgaagagaaaggaatcctttcctaaaaaattattttcttttaaccacaaagaaagaaaaaagaaaagcctggatgtgtaaagttttgttaatatgttgtcatcattttagcaaagcagtttcccaggtagctctcctgtgagccaagcatactcatttcaactaaaggcaaattgattcttagcactgacttcctagaaatgttgtagtgctaaaaggtttgccagtgtctctgtttataacttctctgtagagtgatgctaagtaatgcaacaggatgtaaaccataaatgcagattttaatttcatcttttaaatttcccagcaaaggttttggaagtctctgtcctgtaatctgtgaatattcgatacatactcaatttacatttctctcttcttcattctttacaattgatcttaacttcccaaattttgtaattttcaacttggtttggtcctgaatctttctctgatttttttttttaactatggaaggcttcacgaatttgggtgtcattcttgcgctggggccatgctaatcttctctgtatccttccaattttagtatatgtgttgctgaagcaagcatccattttttttttaactgaagctatgtcacaatttttaaagtaatttacagcatttgaaaggaaatttaagcttggcaacttaaaaacgagttttatattttgccattctgggtaagaagttatgttagcttattataattaacatgtagtaatctagaggtaataaattccctttaaggctgttatgggcataaagaaaacatggaaatgggagtgacagtggcagacaggtggccttttacctttcctggtaataccaattaaccctttgcatgaacgaaagttgagaataatactgatagggcaaatactgatattagtatcactgcatctaagacagtggcagcattaagattatgccataaaatttgctcgtatcctttgtaaaatagataaaacaaaaatgcaggcagcaggcaatcatgatggtaattatggaatgtattcaaatatatttcttttttttttttaaaaaaaacttttacccctcttctgaaagccatttctaataatgtactttcaaagtttccattaacgtactttcaaagtttctggtttactcctttacatatatctgagaaatagacctggtgatctccggttttcaggggaagtggagactgcccagagccatttagcacattagcaagtggcttgtgattgcatttcacgacctaaatcttagacctgtgactatagtgcacggccaattgctgtccacggtggggggtgggcggcagggaggtggggcactttcatgttaatgtctacttgtgttgttacttctggtgtgttttgagtataactctatttggccaacttttagaaaatcttttaattcccctaaaaaagataccagtagtatctgggaaactctaaattggagaagaaaccagggatgaaactctccttgatatgatgctggtaaaagctttgcatgaagttattggccaactatatgactgctcccgggtattcttgaattcacggagacaggctagctggagaagtaaatcaaatctatagggtccagcatactatgcaaacctcaaatttcttggcccagaaaagtcagtataagtacactgcaattttttttctcaaggaccatttcatttataataaaacagatacatacttgttgatgacagggacaaaataccttaatgtatgtatgtaatatatatatatgtcacttatatttttccacttatgttcttgtactgtttctagccttcatcacggcggcttggattgtcctgtgccaactgtcacaccacaactaccaccttatggcgcagaaacgccgagggtgaacccgtgtgcaatgcttgtggactctacatgaaactccatggggtatgccatgtattctgctcacttgtatatacatttagtatctggtttgtatgtgatatcagttacaaagaatcagcaaatgaaagatactcaagtgaaaaatttgaatgcatataatttattactgaatatgtttaatatattcagtgtacatactgaatatatttattgaattgaaggtgcttttaattataatatgaaatattaccttatgcaccagtaggaaacaaaaaatgctaccagttgaactattgcaaacgttcatttaagacacattccagttttagaaatgtgaaaatgtgaaaagtgtgtattttagaattggtaatatggtagtaactgtttttaaaaatgcacaattaaggaaatcaataaaaaatgcacaatcactagtctatatctcttaaaaattttgaatgtaatcagacatttgtgcaaaagagtaatgcatttaatagttatagtttgaaatatttcatagttcattttaaaggattgcacaaaatataataaacaactcaatcttaaaaagaaaaataaccttgcatctgtaggaggaaggaaatacatgatctctttgaaataatacttcttcaatgaatagctactcatttcaaacaataaacgttaagttgaaggaattaaattctccttggcaaatcatctcattctttctgaaggaatctctgcatttgatgaggaaagtgtagtctttgtgcacttgggatcttgagtgtgtataaaaattggattgaaatttatgccaagttctttttttttttttttttcttgttttgagatggagtctaactcttgttgcccaggctggagtgcagtggtgctatctcggctcactgcaacctccacctcctgggttcaagcgattctcctgccttagcctcccaagtagctgggattacaggcatgcgccaacaagtctggctaatttttgtatatttagtagagacggggtttcgtcatgttggccaggctggtttcgaactcctgacctcaggtgatctgcctgcctcggcctctgaaagtgctgggattagaggcgtgagccactgcactcggccgccaaattcttttaaatgagagcttttagtgccaatgttgggtctttggtttttcttcaatataatattaaatttatggcctatgtgaaaattttttaggtgcccagaccacttgctatgaaaaaagagggaattcaaaccaggaaacgaaaacctaagaacataaataaatcaaagacttgctctggtaaatatactaaaatgacgtttgactgtaaagtatttgccaaccttaacagtagagcatatgtatatttataaggtttattttgactgttgcaggtaatagcaataattccattcccatgactccaacttccacctcttctaactcagatgattgcagcaaaaatacttcccccacaacacaacctacagcctcaggggtaagtattaaaacagcatagactcctaaattactgggctgctctctagtaaattatctcaaattttatcttatctggtagtacaataatctaaaccaacagttcagtttagttagttgatacctaagaatagtttttagaggaaattacatttaaatgtcaacaaaatgacaaacttaagtactttacaaacctcttaattaagatcggtatcatttttttatggttaaattaacccaagtaaaagcaagaagttttggtttaaagtgttttaaattgttttatttccaggtttttatcagagttgctatatatattatatgtgtatatttatgtatttccgatgtagatcataagaactatgaggccagtggtttcatagattacagtgcccataacagttaagtagcttttgtttatcctatcaattccagcctttttttctttttttatcatccacccaaagcaaagctcatcataaagtgttatatgctgctgtattcactatttcctttgcccaattgtgttcttgctgggagagcttgccttcttctaatgtaccttaattgtactggcgtttatttcagctatgacaaaacctaggagtgatttgtgccactgtggacaggagatgcctgggtcttcgtgaggatcacagacttagtttcttataaagctgtgaccaaaactcagtttgcctctagtagagagcattttcccaccctaatgtttcccaaatttacctggaatgcccttctaaaaaatactgggccttccctcagacgtcagtgagctccaaggcagggcctgcggcaagcaggactttaaaatgtgtccttgtgacccttgggactacactgagacaagattaggactaaacaccagcatttaaatgcctatttacttagtaattgttttctacatttagttttctcctgaaattatttggggtactttaaaatactacagattcctgggccccaccctggattttccaagtcagagtctctgggtgtgggacttggatatctatctgttgttgaacaagtgccccaggtgaaattggaactactgccccggaggtgtttgggaaccacagacctggtttctttccactgtatttttactggctttaacaaacaaaaattaaatatttaaaacaaaatgtttaaactgtgcttaaaattatatttgatatttttctttgtcctcctacccaaattcttttgagccttttctgtaaggaaacaaaacgtctttttagagtttcacaagggaagaagccttttagttgtttttttttttgcagactcatggtaaagaatgtttctaggctttataaaggtggactccatgctatggtgttgtgttttacaggcaggttagatgtaactgaggattgaaagtggtaaatagaacatgtttcttgggaaatgaaaagattatttaataataattattttttttttgaggctgagtcttgctgtcaccgaggctggagtgtgcagtggcgcaatctcggctcactgcaacctccacttcccggattcaagcaatcctcccacttcagcctcccgagaagctagaattacaggcatacaccaactcacctggctaatttttttttgtatagttagtagagacggggtttcaccatgttggccagggtggtctcgaactcctgtcctcaagtgatccacctacctcagcctcccaaagtgctaggattacaggcatgagtcaccgcgcctggcctaaaaatatcctttattatgccgtagtcctcaggagcaattatgtagctagaggcaaaacaatttggttttctaaagcagggagggagccgcctctctcctagctgaaatgaggactgctgccagctccaagtcacttttgttggtggtacagtccagcttaaatgtggcaaaaagactaatttgaatgataaattgcactgaggtcgatatatacccaacaatgggcttcggggacttggaaccattgtgggtggagtcttgtgattttgtgacgtaaaatttcaaaatttgctattagcaagtcctatcggttgctgtccagcgaaaggagtgaaaagccagtgaaaagggccatggtctggctagaagaagggccttgggagttccatctctggtcctaggcttattgtcccaggaactctcaccagggacagagcagatggaggtggcttgctggtcaatgcccttcagaggaaagatcagttccccaccagaggccaggaggcaaagcaacaaggatgttaaggatggggttggagagtactagtttcacaccaggtcttcagctgcaagcttccatccctgcggtagtctaggcagcctccacggggactgagaagctgggagtggctggtgtgagctgcagccagggggcatctctccgagctctccagcctctgggctgcgcagcagaaacactgactgccattaccagggcagggggtagggttgctggcctgcctaccaacctccccagttccccagggactgactcttggccttgttccgagggcacacacggctggtgcctgggcttgcagggttttatttcatggatgtctccaaaagcctctacctgctgtggccattgtggggaaacagctactcgtctgctggctgcctttggaagctgtccccctgtaagaatacctgtagtaggcttgagtggtgtccccaggttgttttcatggcgtgcctgcgtataactgtggatcccttcgcactttttgatgtcctctctgggtgggctgagccttcatgtgtatggcatggcccatgtggctgccgagtagctgtgaagagtctgctggaggagccatctgtgagcagctggtagaagcatttctaaaaggtgcctgtgttgacaaaggtgtgtcattttcccattttggtcacagtgcataatgttagagggcagctggctttgtgactgattgcctgtaggattttgtgaaatgctgtgggtgaagaaaatatcagatccacatagcaaggttgtatctggtgtttacaaagtatatgtattacatacacagcaccgaggttggcttggagtttaagcctcctaaggtaatgcgtccaccccacggatctccagtgctccctgtgactgactggtagaaattagtagtgcagggtgaccctcgtttgatggggccacggaactacaaagcaaagggcgatcttaggcaccctcccagcagaaggtggaactgggggccacatatccctccatttagagatgtaagtagcagtatcactgcctttctttaatgactgtgagttatagcaaggaagtaaaaaactgttccagaggcccacatgaaacatgctgtttactttaattccccactgaaaaatcagttgtaggagatcaccggtaggcattcccagcaggcttattgtaagtcctgggacatgacaggaacagggttctgacctgcctttcacgtggccatttaagtgatggcaccaggaccttagcatgacacagagtcctgagctctcttggccaggacgaaaggagccacaggagctgagtattgtggaaggggtctatcgtggttgtctgcttctgggagagggggctccagggctcccctcccctagcaggaatgaaggtgtgggcataattcctagtgcacggcattcttccaggataagttgtcctaatgccacgaaaatttttgtgctgctctgaagcctcatgtcttagctttatatacttgttaatctgtgccttcatgagacctgtgtctgggcaaaaaggagacattccttcagataagagtcagcaagtcgatgaccttgccaccttatgactcagtttctcttggttataggctgtgcatgtgctggaggcacagggagggcagtgtgtttctgtctgaaatcaggaggactcacggtcatacagccctgcttaaaatattgcctatttttttcttttgaaattatttttgtttattaaaaatgtatgttaaacttaaatttttgataaatggttgctttctgtggcaaaaatagtctttctttctggctaagaattttcttatccatgcagatttactaaaaaatgtatatttagttgatctaaatagatatcagtttttctttgggctgggtgcggtggctcacccctttaatcccagcactttgggaggctgaggtgggttgatcacctgaggtcaggagtttgagaccagcctgaccaacatggagaaaccccgtctctactaaaaatacaaacttagccaggcacggtggcgcatgcctgtaatcccagctactctggaggctgaggcaagagaatctcttgaacctgggagttgcaggttgcagtgagctgagattgcaccattgcaccccagcctgggcaacaagagcaaaactctgtctcagaaaaaaaaaaaaattttttttctttggcttttattctctatggattgtaagaatactaaaatcttttttttcttgaattccgtttattgactgaattgtattttatagttttttttggttgttatttaggagagaaacatggtaatgttctgtttctgcaataagatttaataagtagtccacaaatggtcctactcctcctatttctcctcctataactcaaaatttgtaaaactggaggatactttatagctcaatccccaaattttatagataaaaagtttttttcttaatttcttttgtaataggagggattaacttggagatgaaattagcaataatatctgaaaatggcagctacagaaaaaaagaaaaaaaaattagcaataagacaatgtctgagaacaaggagtcactgaacatattttgcctgcctaaaaatagtttctataaataattactttaaaaattaggccaggtgcagtggctcacgcctgtaatcccagttctttgggagactgaggctggaggatcacttgagactaggagtttgagatcagcctgggcaacatagcaagatttctgtctctatttctagtttaaaaaaaaaatgaaaaaaaagtaaaccctatttaagttaatattaaaactaccaatataatattgaaatcatcattaaacataaagtgttgaagttaaatggagagagaaatatatatgaccagcccttgctttactggtctttgttccatttgagtaaaacaaagtgccacatctggaattgtttaaaacatggaggtggtaggggtgggtagagagagacaggtatagatgtagatcttactactggtcagatttggacgtgctttaaaggagtgataactagagttggagatggctccgcagagtagaggaaattaaaattagttaggatttttgcaggggaaaaattgggatagaggtatccaggaaagaagaaggcataggaatctttggagctgaagggaaatagttagttcattgtgactggagtgtagggggtaagaagccaaaggcaggaagtgaggctggtagaacgggtggaaagtagatacttgaaaatatttcaaatcaacgatggactttatttaaatcctgcttcggtgacaaatgtgttttctgtctgtacactggagtccaacaattaggaccttcttactggagcgttctgtattttgataattgatgtaaacaaatgtagcatgctcctgcttgtcaagtttacaagcagagtttcctcctcacaattagggaggaaaaacatctgccagctgattctatgcgctgaccttctttaggcctgtactgtaatttctctgcctccagggatcctgggggcaggatggttggagtggctgcctggctacctcttctaatggaaacatattagacatggtgtattagggataggaaatgtgtttcctcacctttgtggggcattgctggtgatatataacttccacaaagagaggtggacaataggctgagagatagagacttaggttcctcgccagctgcatctgggcctggatgggtgggccttaaccactcttttggtctgtttcttgctagtaaataggcgtcatcgttcccgtcccctgtgtgcttctgggacactgtgtgcttagctagacctatttccctactgtagtcactcctgagctgcgtggtcgtttgaaggagttaagcacccataagtgcttgtggccaacagcagtgatctagagactgactcaagttaagattatttgatgtgctctataaggcctctgaagaaagcttaggcaggtaaatattttaaattgttttcatggattttatttcatatataatatttgcatcctgtggtggaaatagaaaaacaccttagtaggtcctgtagcttactatgcattttccagtgcaggggggttctttattagcagatttacactccactgtctttttcttcaagtaatggaatttttttttgatttactgtgcactatggttggtcacaaaattatagttcctgtgaaagagctgaaaggaacatttgtgaaggacttatgctgtgcttatactgttaagttgctcagaggaaagtatgaaggcgagctctgatgcaagagcctgctggggctggagcagaaaattagtgcttcatttttaacttgaatatgccacagagcttctagaggactcgagagccaaacagtggtggattggtcttcgattttctcatagtgatcttgctttgaggaagtttttccctttcctaatactcactcacttataagatagtgaacatagggaggcaggaaattagtttctatcaggtaccttttatgtgccaggtgttttagatacattttattttttactcctccttctaagtgagatgcagaaggtaaagaacagttccaaggtcacgtgtcaaattgagacgcgtggtttcacgttggccgcaggtctggctgatgcggtcagtgttgttgccactacagcgtgttagattaatatgcgatattagttcatttctttgaaatcttcagagagaagaaagaatgttttcttaaagaaattggactagtttgattaataattttagcatcacatatcctcccactgaaacaggtgggaaaactgtgagaagttatttgctcttgaccaagaatgtatttaagacagttaatgcaaattttcttatcaatgttatacttagaaatcaaatgtgtaatggtactaagaatatggcagttgggtaacattaagttaaaaaaaaagtagtaaaaattacttttgttgacatacctaatgtggttataacaaggttcttttaagagaaacacaagattgccatactgaaatccttctaatgctgcgatttaaatccatacacaaacaaatgctgttttggaacttttcagaatgttaaaattgtcttcaatgaatgtttatgaagaaattactgaaaaagcatttcttaatagtgaagtgcctgttttttttttcagtctatcgtccaaaacactcttttctaaatgagtagcaaaggggttaaaaaatcattaatctcccaaagggtctgtgagagagttatgtggttaggtattattattgcctcatttataaaccaagatccggagtgactccttaaggtcacaaaacaagccagtattgaagccgggactggaaccgacgtctcctgcctcccagtccagggctgttaccactcccagggagttgaccaatcatcacagttattaatatcccacttgccacatgctacaagccatgaacataaatattttgttggcattttatcttcatgctccctatgtgccaggctccctttctttctatgttcacagccccttctaataactcacgttcttgtctgaccacattggcctttgcgtgaaagtcacacgtcaccccggcagggaatgttcaagcatgcggatttgcatactttcattctgatctcaaggctttttctagacttcctttttttttttttttaaatctcgtgtgtgtgtgtgtgtgtgtgtgtgtgtgtgtgtgtgtgtgacagggaggatggtaagaagtagtttaaaaatgcattgtgtgctacatcaatatccaatggctttgtacattaggaaacagtaaagctttaaatagtttgtaacatatgtccacataatttatcacagaattgtggtttatttaataagtgactcattatcactatctgatagccagaatactggataaagaataagtgtgggcagaagttattcaccatttcttatagcctcatcccagaatacagctcttctttgcaaattacagattctttgcagttttctcccacccgcccccccaacgcctctataagaatatacaaaattgtcagaaaacatgaaataatgttacgggaaaacatggccaaatttaagaaatctggcttagattgctctgaaaggttattgctaaatgaatcttcgaagaaaacgaattcctttactggaacaaaagtaatttattatgcatttcatgggtgtctgccagaagagttactagcagtatgaagatccagtggatatgaattaagtacaatctgttagttctgttcatgtttagacctacctgttaattttctctgaaattttaataatttaaaaaagcatctccatagacaggtgttggcaatgtgacaattcaccactcagctacccatcacatcaggcttttttaaaggcccagtactcagaatttgtgagactgagcacaaagacattattttattgacctcatattttaagaatgatttggacaaatacataactaggcattgattctaatgtcctgttggggtcttacgagtaaacggttccaagtcaacatctgacgatgcttaaatcatgatccgacttgatggtgtgctgcctgttttggttgttggcctggcacggtttcaccagagctgggccacatgctgcagaaccatatttttattttattaaacacaagtattttacatttaaagctctcattaaatttagttgcttgattcgtggtgaagcctgaatatggtcaaaagtttattctgggggttcacggattagcagctgggaggaaacagattccagcagccaggcgctagctccagctctgtctgtgtgagtatagcaagctgccaaggttctgtaaagcctctgttttcctccttctactaaaggggaaaagtaattcctaccatctggtccttaggagtattgtgtagagtgagtgggagatgcctggagacctctttgaagtttaagaagaatagcactacttaaatacgggtcttggaagttaatagtaatcagctttatttgcgtggcattttttttcatcccaagatattagaataagatcctcactttcttaatggggaaatttagagacgtagagttattgtgttaagaaagtaaccacattttagagatttgtatttcactgatagcaaattttttattccttctgatacttagtactttcctaatgctttttgtggtttaagtgcattgtaaatgcttcttggtatgttttctgtaattaagatggagagattaagatgctcatccatctcctgaaaagtcagttttgttataaaaattaagatcataattcaccaggttttaaatcttgcctcaggattctgtcccacttaatttgaagattagaatagtgtaattcattctgattcatttagaagataagctttttctttagggtcctcattgacttcaagttgtgggacaaaccctctcccttgcaatttatatttgtacatgagtattttggtgataatcccagagtacttataaagtttggcgcctttcttcaccacaacatgcttgctgttgagtgtgcacagatacataaagcaatttgctcttttgtccagaatagattatgtgcatagaattgctttcgtcttcttgaaaagggcagcatcccttggtgtggctataaccttgcctactcaggcctagaaggggcgagaggggtatgggttggggcagagtgggggagcagccggtgaaatttccagtaaggaatttgtttgccgaattaaatatacaaaactattctgctgaatagttaggtcatcagttgaggtgacggtgactctctctctagagaaaaggtgtccatgttcctttgttttattaagctgttaagaattcgagagtttcattgtgattggttttcacatgtcctggtggagacagaatttgtgtgtgttcatgtgtctttcatgtgtcaccttctaaactattactgtcactttgtatctggtcctctgttacctccagccaaactgaaatgatcgtagtttatatagtggaagttacgatttgcaggaaagcatttcccctttgttggaatttatacaaagtttttaattcctctttggaggaaggcagctataaagcaccacaggagtctaacctagaggttacaaaagcagagaagagctttggcagtgagggacggctggcttcccctcacacaagaaaaagccgtaagcacagtctcactcagatgtgtaggaaggacggatcagaggctgggggagccgacagtctgccttgcagtgaaggaggcatgtgatcaccatcaaagtcttctgctctgggaaggatcacacagtcgtccttcagcctgcctggggcgcagtgttttctttcctcagaccgaaactgcatgaagagagattccagcaaggaagatagagcatgccccgtacactcctctctggttttcttcctcaaaggaaatttatgcatgtaatccacaagccgaagaacccatgtttttctttggaaaaggctacgccctttcagggtttccttttctcggctgtgttgccttcccatcagaagctgtctcttgccctccccattatgggatgtgcgaaatgaaggaaaacagagacactgctgggcatttgtctccatgagttgatccaatcagaaatctttgacttttcagatatgtgtccaaaaatgagtgaaggctcctcacaggaaaaaaaaaaaaaaattctaggtgatctaaagatgaactgtggctacttctcaggctagcggatattttccatgtcccaatctgtagcagcccaagctctccctgaagtcatttactcctttaagagggagttttccagcccagctgctctgcctgtctcccacctaacccggccagctttcagtgctaagcccaggctgggtctggccctgataacacattctttcaacaggaagtgcctccattttcagttgtctgtgggaagggtggagggcaaataagccttgaatggaaacacagagccgatttctgctccaccctccttgcactttgatcagggagagagcagggacctccgcctggcctgtgctgcctgccgaaaggagggaggatggttgagctgtgggcattccggagctctccctcccttttgttcaggaacgtttgtttaggttggtctaggttagtgaagtgcctgcttttgcagggttgtgatgtctgcgatctgaactaaagtcctttgaagggttgaattatttgtgggaaaatatatcaaccaattgaaatttatacgtgtgtttgtatgtgtgtgtattaggtccaggatcatagtatatttttctctgatttcccccctccgcccccccctcccaacacacacacatcgtgttgattctcagtaggcatctcttgactatcatcagtgagggaaagggacttaaaagatgaacaataacaggacaaagccaggcttcttaagaagagtagctgtgccaactctgaacgccttctacttttagaatattggtttagaggccaggcacggtggctcatgcctgtaatcccagtactttgggaggtcgaggcaggcggatcacttgaggtcaggagttcgagatcagcctggccaatatggtgaaaccctaactctactaaaaatacaaaaattagccgagtgtagtggtgggcgcctgtaatcccagctactctggagactgaggcaggagactcacttgaactcgggaggcggaggttgtagtgagccgagataccaccactgcactccagcctgggcgacagagtgagagaatatcggttttgagagctgaagttacgctgatgcatggagctgacgtgttgattgttttaacttgtatagaactgtgagattcacatgtgcgtggctggccaggccctggcctgtgccaggtggcagggagatgatttcaggggcggatgggggcccttctgacccgccctcctgttagtgcctcgactctggttccctcctattttttcaagccactttctgatcccatgaaggttggcttgtccctcaagtgccttgtgtttctggtactcatgtcttctattcatccccaaagttattaggttggtgcaaaagtaattgtgggttttgtcattactttcaatgccaaaaactgcaattactttggcaacaacctaaatagatttactatgcaattcaatttaagtattcaaagaaaaatattcaaagaaaggtatagatggctaatagacttggccctctcagctagtcccctgtttctcccctcctcccaggggacctttgtaatacttacacatgtgcatggataaattgcagttatgacgtgtaattcatatcttgctgtttttcacttaacatggtattacaggattttttccattttgctccatgatcttattatttttaataattgcataatagttcattgagcggatgtgccctgcttttctaaaccgttcccatattattagacattagattgtttctatagtttctactattagaagtaaccttgcaacggttggcttcctttgcggagcctttcccttcttttgaattatttccttataatacatttccagaagtgaaattatagggcgaagtagggtctaaacttctggatggctcttgacattgcagctaactgccttctgtaaggtgggtgtaccagaatttagctccgccagccatgagtgaggggactggtgttaccatgtaagtaacatcagcctttctttgcagtatttcatgtttaaatattattatatgtacacataaaataaggctaccaagcattgggcacaaatacttgccccattttttttctgacaggctcagctattgcttttaattgcaaatgagcagatttatttctaggagtgcatcactcatggaatttgaggtctgtctgccctttgatagcaggactcttggcctgccaaatagcttaacattttgtctgaaaaaaagacaggttattttcgccaattgcttttgggattgttattcaggtgtaagaataacattcagggtgttaacgtttctttaatgtgggttgttgaaaaagagtcagtgagtcaccaggtgtggtagctcgtgcctgtgatcccagcactttgggaggctgaggcaggtggatcccttgagctcaggagtttgagaacagcctaggcaacatggtgaaaccccatctttacaaaaaatacaaaaattagctgggcatggtggcacatgcttgtggtcccagttattcgagaggctgagatgggaggatctcttcagcccaggaggtggaggttgcagtgagccaagatcacacccagtgcactccagcctggatgacagagcaagaccctgtctcaaaaataaaaaataaaataaaaaagagaaagagtcatgagacttttgaatggctacagaacactttgatttatttttgcgaagaactgtcagtgacagtttgaatagggtcattctggaggtggttctctttgagctccaactgtgttccgactgcttctgcccctgcctggtgatggggtaacttgcttgggctgaaggatagaatgaggagaataaattagatccaagcctcttaaccttaacaataataattagataacaagagtagcttatactgacataatctttactgttctcagacactgttacaagggctttacatatattagccaattctttttttttttttttttgagatggagtttcacttttgttgcccagactggagtgcaatggtgcaatctcggctcactgcaacctgcctcagccttctgagtagctgggattacaagcatgctccaccttgctcggctaatttttttgtgtcagtagagatgaggtttcaccatgttggtcaggctggtctcaaactcctgacctaaggtgatccacctgcctcggcctctctaaagtgcagggattgcaggcgtgggccaccgcgcctggcctagccaatttaattcttgcaataatcttatggcataggtgcctctttttatcccactttataggtgtggaaactgaggcacacaaagctgtatgtcaggcttctggtttacctctcccacatggtctgttcactcttttgcttcatccttctgtttttcagctggcttttcttctgaacaggccaggtgaccacctctcttcatccgccctgcctcccattttgaacatccttctctcgccaataacaatagcttccctttacggaatgtttaacatggcaaggcaccttgccttcgcttttacaaacgttagctcatttaattgtcgcaaccatccctgaggtgggaaatgtgaggacccaggcacagaggaggctcaggggggactgcactcagcaggggactgaatcaggacaggacttgagagtccaagctgcttcccctccttctcatactcctgtgtgggctgcctttggttccttgcccaggagtccttgccctctgctattccttttctgactcttggtctaccttcctgtctcagccactcatttgttgttcatgataagcagccaacagtcgactttctaatgtgtatggatcctggctccccacaaagcctgggagctcctggggcagttgactatctttcaggctcctgatctagtgtctggctgtcagttgttgctttgccaatgtttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagctgggactacatgcccagctaacttttgtattttttgtagagacggggtctcccaatgttgcccaggctggtctcaaattcctgggcttaagtaatcctccctcctcggcttcccaaagtgttgggattaaaggcacgagccaccgtgcccagcctgcttatgcttcttgttgctggctgtggtggtggtgacagatccctctgctgtcttggcacttccctgccatttgagatgggctatttcctgggccagttcaggaaccctctccatttcagaaaataacacttgttgcggtgaagtcagatttagtcagaggcatatgctgatgtgcctgttttcgaataagaaaatcaatgcaaagttggacgtgagatgtatcattataaggaagctcactctaatagttcctttctaaataaataattcttttgtaattgaatatcatccttttgcttatttctttgagggttaaatctggatccacactggatttgcttctggtggagtctctggaattaagggctaaagttaatcactatgtttataagtataaccaagtttatggcattcagtttgttggacaggattattttagctttttcagaattgccacaagaatccatctgaagctttagacatctcactgatttttgtgaaatttgctttttaatgcacctaaaaccctcagtttaagtctttacatttgtgttatataaacaaaagtttgggtgtggggccagtgttgttgctggattttcataaaacctcatttctgctgggaaagggaaggagtggttacctgtggaggggtcgggtttggtctgtctggttgggaggaaggaagtttgggtgcttagactcagagggcttgctcgcctgaagtcctgcctcccagcctcatgcccttatggtgagggttgagagcaaaccagatcttgttggaaaacgagtagagttggacctcattcacttgcaggccgtggaggctcggcacacttcctttctgttccgcctgtgtctggtgccagagaaatgctgttttaaggatttaatgggattatgtatgtaaaaaagaaattctgtgaaaagtacacaatgtcctacctctgtcaaataacaagtatctggtaatttatagaatggagccctgaaagcttggaaggaataagagctcctgaacttttagaaggaaaaaggtgattttaaaaagtacatgattatggcgaaatttttcaaaaagcttctcaaaagcaactttattcaaactgttgtctaaacagattttagttattttggtttgattttactaaattatatgatgtttcctatttggcctttttcatgtgaatgggaggaatgggtggaacagggcaaaggtgaacttgtgcttcaagaaatcattgtggccaggcacagtggctcacgcctgtaatcccagcactctgggaggcccaggcaagcagatcacctgaggtcaggagtttgagaccagcctggccaacatggtgaaaccccgtctctactaaaaatacaaaaattagccaggtgtggtggtgcatgcctgtaatcccagctactcgggaggctgaggcaggagaatcacttgaactcaggagatggaggttgcactgagctgagatcgtgccactgtactccagcctgggagacagtgagactctgtttcaaaaaaaaaaaaaaaaaaaaaaagaaagaaatcattgccatgatcatggcagatagaggatgttagcattttctttataacgtggtctgcttcagacatggactgttcttgtaaagaattaaggtaaatgaggtagattttaaagcctgtatatgcataggtttattttccatgaagtcaatgttcaaaaatttcactgatcagggaatgttgaactgtgcagcttttctaaaaagtctaaaaagactttgccatcactggataagccttgttagagtgtgtgtgtgtgtgtgtgtgtgtgcgcgcgcacgcatgcgtgcgctctgcattttctctttggaaatgatcaggttgtgtgtgcatcattaatgcctattcacccacacagtgaggtttgtttcacagtcagagatcttagagcttggcactttttacaaataggatttcttcagttccccttccttttgtccagctttgcatcttgccagtggctcctgccctgagttctaaagtttcgaaggcttaagtggccagggtcaggtcagtggcactgtgtgcaatgcagggaaaggcccccacttgctgggggcaggggatagtaacgccggcttcatttctcctgccctgggtctgcccaggagcagctctggccctggctgcacagaccccgttcattagctcccatgtatttcactaccaggattgtaaccgcttctcaccttctcgtctctcctctgtgtccccctcttctgccaggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatg

SEQ ID NO: 37356 - DNA, 3194 bp, Homo sapiens
tgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggtgggcccctccgggacgcggacccctctcccgccgcgcttctgggtgggcccgggacgctgaggccccgccccacttccgggttgggccgtgggctggggagtcgtggaggcgcggtcctggtccccacccggcgcgctgggactcgcccgcctcccgtctgtcaccccctgcgcctcgccgggacaacggggtgagggcatgggggcgtggggccccagcctatgttccccgcggcactggcgcggcggccgcgccgaccgaagtccgggacgggggaggggcccgagcgccagcggccgggcgggagtctcaggagcgggttcccggtccctgcaggcggcctggcgggtggcatcgagatctgcatcaccttccccaccgagtacgtgaagacgcagctgcagctggacgagcgctcgcacccgccgcggtaccggggcatcggtgaggagggggaggccgcggcgccgcggggggcgggtacccagggcggcggcaccgagggccgtggggtcctgaccgccccctcccccaggggactgcgtgcggcagacggttcgcagccatggcgtcctgggcctgtaccgcggccttagctccctgctctacggttccatccccaaggcggccgtcaggtgaggcccggccggtggctgctgcgggaggggggctcggccgcggcagcccctctcacccgcctcccgcctccaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtggggaaggtcctggcgaggaccccggacacgcagggagtacggagacgggcggccccgctggcccggtgctcccggggcaaccggcaagctggggagggtctcctggacgccagggaaggccggcggggtgaccgcggggccctggggcaggacgcctgccacgaagggccacccgtggaggctgagtctatgctaaaggcagccttaaagtctttaaaaaatacttttataaagcagaaaacaaaatgacaccttcactgccaaaactggaaaagagcagcaaacataaagggagaggctgctcacagggctgccctgtgtcccagagcatggtccgtgtgggctgccctgtgtcccggggcatggtccgtgtgggcagcccagggcggccttggctgcactgcttcctggggaagagttcccagttccctccaccctggatgggccctgggcctgccagctagccaggacccacccaggtggcagccgagaacctgcgcctttgcttctctctctcaggtgaagttcatccacgaccagacctccccaaaccccaagtacagaggattcttccacggggttagggagattgtgcgggaacaaggtgagccactcgaccttcctgatagggctcagggacctgggccagggtgggaagggcctgcacctcccatcctgccttgggctttgtgcaacacccaccccccacacacaccaattcccaaccggggcctgagaggctgcagggtaaccccgtgcctgccttcccgcagggctgaaggggacgtaccagggcctcacagccactgtcctgaagcagggctcgaaccaggccatccgcttcttcgtcatgacctccctgcgcaactggtaccgaggtgtgtctgcatcacagggccccatctctgcacatggccagctcctctcctctccttggggccacccctgggtggcgggcacccaccttttgaagtgctgatccaggcccctcccggcaccctctgacccacctcacccctcctatatccaggggacaaccccaacaagcccatgaaccctctgatcactggggtcttcggagctattgcaggcgcagccagtgtctttggaaacactcctctggatgtgattaagacccggatgcaggtggtggggccgggaaggggaggggaaggggggaccaggccagagctagctgctgagcccctgcctgctgatgtcccccatagggcctggaggcgcacaaataccggaacacgtgggactgcggcttgcagatcctgaagaaggaggggctcaaggcgtgagtgggggaggggcagggctattgtccccacctcaaacctttcccggcctacctggcctgcccactctgtccccttcaggcctctgtgcctctcacttcagtatctggggattgccctgtgcagggacactgtgctgacctgccttcctctccccgcccctcctcccacccagattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcagc

SEQ ID NO: 37357 - DNA, 3537 bp, Homo sapiens
tgaggtctccattggaatctctcccttctcgtatctccagttgcatttgatgttaatacctcatagcaaatttatccctttttaagtacccagagccggcggtgtagagctctcgagcgagcaccccgcgtagtccccaagtgcgggactgggcctatgctactacaggcgctcgctgcctaagcctgtctgtgtgtggcagtgtcctagtcgtcctcccctcctccttcggcatctgctctgcattagtctgtcccaggcctccgcaggcgccgatgattaaatcatcatcattaaccagggcctgccccccccatccccggcagcaggggggagaatgggggaataagatcactaccaagtccctgggggtctctcactccccatcccccggcaccctctccgagactctgcaaagcccaagaaactccctccgtgaagccgggagaagacccgccatctggacgaagctccgctacgcggacgccgacagggcggcattacgaggagaggacccaggaggggcttcttcagcagggtcgtcgtcacagaagaccgacgaccctgagcgggtagcgggcacagactgccaggcctttgggggtaggagggggcagtctttcgcaggctccgaaagttagtcttgaggtcgcgtagggcctattatgatgatttctacaggaggttgaagagataagacccttccctgtgctcccccccccccactccttaattacggattgagcaggggaggggccggtggggctcaggtgagcacacagggagaaagggacgtgggcggggccttacagagggtgagcgaatccgaaaagacctagaacctcgttgctgggagacaagtcccgccctgcaggcggcaccggaagtggccggctgggatcagcctttaagatggcgtctcctcaggggggccagattgcgatcgcgatgaggcttcggaaccagctccagtcagtgtacaagatggacccgctacggaacgaggtgcaagggcggcagggttactgctgtggtcggccagcggtgcgaattggggcgggctaaaggacgggcggtggctggccgggcgcccagtgcgcctgcgcagagacagagtgcccagtgcgcctgcgtggttgcgatcgggttgccaaactccggttaggacgcctgcgcgttgtgtcgccgacgttgtgtagtctcccctgggaaaggagggtcaggcgagtccacgtgagggaagcccccgctgtgcgcggagccctctgctgggcggagggggagtgccagcccccaggagctaatccccggctgatggcgcagggcgcggggcttggccgtctagtgtgatgaaggaggcgacccccaaggtgggaaggcgcacgggttggggtttgagggtggatgattggtgacggagggtgtatcttcaggaggaggttcgagtgaagatcaaagacttgaatgaacacattgtttgctgcctatgcgccggctacttcgtggatgccaccaccatcacagagtgtcttcatacttgtgagtgccttggagactgcctagttcttccagtccctagtcttcaccaagctgactgccagcttctgtgcggcctgcctcacgcatccaggcaccccacccagcccatgaatccagtttccagagggcctgagaatctgcttttcttttcctgcagtctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgagtcaccaacctgactttgaggggcctcttgaggactaattgctgagtggcagcttgaggtgacgggtttggtaggactcacgtaggcagaaggccaaagatgagggaaggacaaaaagtgaggaagggctaatactttattcttttttttctttttttgagacggagtcttgcccaggctggagtgcagtggcgcaatctcagctcactgcaagctccacctcctggattcatgccattctcctgcctcagcctcctgagtagctgggactacaggcgcccaccaccatgcccagctaattttttatattttttagtagagacggggtttcaccatgttagccaggatggcctcaatctcctgacttcatgatctgcccacctctgcctcccaaagtgctgggattacaggcgtgagccaccgcgcccggccccgaagggctaatactttattctcatacttcaccttcttctaggtgaagagaaacggattcgggaattctaccagtcccgaggtttggaccgggtcacccagcccactggggaaggtatgtccttggccgcgggacagtaaagaccccagagcattcttcttgcccagttttgctctctggggaaagaggagtatggaatgtgtgccaccagccacctcactaccctatctttctcagagccagcactgagcaacctcggcctccccttcagcagctttgaccactctaaagcccactactatcgctatgatgagcagttgaacctgtgcctggagcggctgaggtgaggagaaggtcaggggttgcaggaggtgacagtgccaatgacccagagccagggagggtctaggggagaggctgagcagtgagtgagtgcctatccccttgaagagagtatatcatggctctgggtggggaagaggaggaaagataggattccctaacctgtgtctatttccccccagttctggcaaagacaagaataaaagcgtcctgcaggtgagaagggctgaggggagggcctctctaaggagactcacctcccatggtccttccctcacacaccttgccctcttccctcccctccctgctcccagaacaagtatgtccgatgttctgttagagctgaggtacgccatctccggagggtcctgtgtcaccgcttgatgctaaaccctcagcatgtgagtagtcccacagtaggtttcttgagggggagaaggggctaagaaaggagggacagagtctagggtggaccagggtagtttttgacctgccagaaagttcctaaaattatgcccccatctccctcctaggtgcagctcctttttgacaatgaagttctccctgatcacatgacaatgaagcagatatggctctcccgctggttcggcaaggtaagccaggccaccctccctgggatcacacccccttcagactccccccaaccatcctacagtcctcaggggaagggtgggctgaggggccctttgaataatataagaacattccccactgactactacttcctcattctctccttagccatcccctttgcttttacaatacagtgtgaaagagaagaggaggtaggggccaagcccccaccccatcccactccccttccctccccagatatttatgtgaaatgaactgcagctttattttttgaaataaaaacttttaaaaagc

SEQ ID NO: 37358 - DNA, 83039 bp, Homo sapiens
gcaggggccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccaggcaagcagcgagcacgcgcgtcgccgccgcgcccgcccctcccccccgcgctcgcctcggaacttgctgactgcgcggccgggaggagccgagccgggcggcggcggcgggaggctacagcgcgcgggggtctcccgcgtcccctccgcctcgccgggagctcgcgccctcgcccagccgagctcccacccccgcttttttccgaaggcgctgggcggcgccaccctccggccggagcccggcactgcacaaccccctccgactttcaatgttccacactccccggccagagcctcctcggcttctttttttccctccccccccttcccccccccacagctgcctccatttccttaaggaagggtttttttctctctccctcccccacaccgtagcggcgcgcgagcgggccgggcgggcggccgaggtaaggcggcggggccggggggccgcgtggggggcggccggggcggcggcggcggtgggggagggggcgggggcgggcagctttgttcgcgccgggcgcccgcgtcgccggtgtccgcgagccgcggcggggccggctgggctgctcgcatcacttggcgcccggcgcggcgagcgctacccgcggcccccgcgcggccctccccacaaagggccgcggagctgcgtggccgccgccgccggccgtggctcgcctccgcgggcgcggaaatttgttgcacttcttggggctttgtttatttgtttgttttttctctgggtttcttatttttttcgttattttggacaaaatgtcggtccgtgatataaaaattgagcgaggaaccttggtggcattgggagctttgcagaaggtgcagtttgaattctgcttttcccagggtggcagctcggtcttggccggatgaatcttcgctgctggccgtggaaacagctagagcagctcgttagttgatttttaaatttccaagtgttgtgtttaaaggctttacgtgcactgaggaggaatcgccaccttaaataagcatatgggcgattaacagggtgtgttttcctctcggaaagggaatttggtagctttgaccaatgtcagtgtgtaaatatttagacgttattagtgacttttaaacatttttcagcgagatctgttatttacagtgtgtcatatgttattaatgcttgttgcctaagttccttggcaaatctgtttcatgccttctgagaaagtagacaattgatagattgtccaagagacggaaaaaaatgtgagtgggttttctaacttgagttcggcaaatcccttaacgctggcgttgtgtgacacatcacctcccttgtacgtacccctgttgtacgatgaaataagtgtgaacacttttgaagctttttcattacaagacgattttagatgactagaagaaaatgctgttggtttatttcctagatttaacattttctcctcctcctcccctgttctctttaaaagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaaggtaatgtgtaaaagaaggatccagcacactttgtcaggttgtcttccaggtggttggacgcttttgttggttttacctcaatagcagtagttcagaaatatttacttcattatcagtttaattgtacttgaatgagttgtcattctttaggtggtatgtaagcaacattactagaattatacttttaagcaaacttaattctgtacttcggtaacttcagttaagagtgtccttgagtagagattagactaacattctgacagattgtttaaggagttggcaaggaaaatttggtgaacccaaattagatggtactttggggatgttccttttatgagtcataatcttctttaatgaaattgacacttccagagattagcagtgcctctcttcatgaaacttaatgatcagaaatgatcatatttgctagaaaatttgcaaattcaggcctttgctatatttgaaagcagatttaaaattgtgctgcaaatctgcttacagttttacaaaacatgactttcaatcgtatatcacaggtaactttcctggttaaattatgattatcccttcctgtgcttgtgagggcaaatcaaactgaaaagtagccctttacaatttgaggtgtcactagtgatagaaaacttgcattgtccttgggcctcttcactctgaaacttgtggatgtgcttgacaagttaatactcaacagcaggagaaacatatttaattggatgtaagtgaaagatcatttgtttcctattgattgatgttttctgatggagaaaaaaagattctgtcaatgagactcttatcagtggtagtagtagtggaatatccacaaactctagtaattatacataaaatgtataatgtttacagcattaaccaattttgacattttgttaatttttattgataactaaaggaaaaagaatataaaaactgatcaaatattgcattctgtggtgattcataaatactcatatttttctatggattttcacccttattgtctcagtaatgaagtattaataacttgataatatttttgaatggcagcagtctttgacataatttaaaattctcaatttggtatagtgttgatgcggaacatattagacacatctaaagttttgaaatcatcttaaatttgaatcaaatcagagaactgcttttctcccccttaactcaggcctatgtattttctcctctttctctcaatgtttattaaatttaagtgctgtacctaaaatcagggaaaacagaaatggttaaattagaatgtcaagtagtctttgaaagtttttcacaagtaaagatatttgtaaattttaaactttttttttgacagataaaatattgtcagaactgttaatgtgctcttgcagtagcctgttaatttttacctcagtaaaagtcacttcaagtccttgtcaaatattccagtgctttccctcctccctttttgtctcatttgcatataagcttgaaaagagaatttctttggtaaaaagtgttttgaaatagatattatattctttactgagtactagtggatgagtatttctccaatcaagtgtaaatgacttacttgtttgcagcagcaagtgagaaaaaaagctgcaaagtttctgttaagggatttgggttatgcctctgagaacaaagaggaagcagccatgttagcattactgaaggcagagccagccttgcatttaactgcatggtggtagagggcagtgtaattccctggttattctgtagactatatcaaatcctttttgtctcttctcatttcactaacagaattcagaaggagctagctgaaataacccttgatcctcctcctaattgcaggtaagaaatgaattttgttgttttggtttcaaattgtggaaaaataccaagagattgatgtattgtctggatatgtgtgcagcagaggagacaacatttgcttctttacagctttgcaagtgcattaaacaaaaattgtagaaggtgaactagataaaattgggagaaaaaatactttttagcataagtatacattgtggatttatgaatatactgattttgtgcttctgatattcatatgaatggtgctgatttttgttctgatgtatttctgtagagggtgttttttcagaagtatactgaagaaacttctaaaattttgctaagctttaaagttactgcttgtgtgtgcaatctgaactgaccttccacatttagaaattgctgaatgtggtgttacaaaatgtaaatgcagtaaataagcatatagttggttctgtttgatttattcagttactagccttaaggacaaattttatgggctaagctaatggttttagtggtcgttttctacagaatgcattgttggaattatttacgttttaagcaaatgtcctaattgcttgggaacatttttagtaattttggtggttggaatatgtgtatgaaaagcagtaaatgaattggaattgtgggaattcattttagtggaactcaggtagatgaatttaagattattggttggtataagatacattaaaagtagctggttgattattttttctctaataatttttttcatttcatttgtatagcgctctattctttttttaatgactatggcttacaaaattgaacacgcatagaaaacaatattgtagatagtttgtgaagagatatgtgctcaataatgcgagtggctgcaaggaattaggcagttttatggtttgataggacaatgttttcatgtttaacctgtatttttgctacaagttgtattcacttgggatgatcagaccctgtctctgaagtctgcttgtgatataatagggtataatccagttgcttcttattgtgtatgttaactggatcctcagataaggtgatttgatcctgatttatccgatgaatgaacagtttgcttgtatttgtaatttcagttcaaacaggaaacatgaatgtaaactaattttaaggagatggtggtatgtgagatctcaaagtattacttaagagctatgctgtccggtaatgtagccacttgccacatgtggctattggcctcttcagttgtggctagtccaaaatgagatgtgctataagggtaaaatttatacacattggattttaaaaacttagtacaacaaaaggatgtataatactgcattgacttaaaaaaagttcattaatattaaaataatattttggatatatttggctatataaaatgttaaaattaatttcacttttttactatgttaatatgttattagaatatttaaaattacgtatgtgacttgcattgtatttctattgaacagtgccgctttagagaacaagtaaatgaaagtattttccctccagccttctaaatggtgtgtcaaatctgtagccatttagggaggtcaagttaaatttgctccctggaagaatcacttaacttgcagagtgtattctgatatttcccattatgaaaaatgtaaagatctatcaattcagaactcttaaatgttttaaaattgcatgtagggtcaaacatttttaaaggtttctgttgattgtctgcaaatgaaacaaactaatgtacgtgcataaatctagagagcctagtagacatgtattaagtgccctcagagcaatagcctagtgttgcagttgccaaagaaatctactttacatgtttaactccggaatgtttcctcaaggtcactgaggattattttagagggagtagaatctttcaatgagataggaggtttcacttgtctttctctttatataccagatttcatttaagtccttgaaataatgcttcctcatttagtgatcagactagtgaaacatcaaaactttgggctttctgtgaacagtaacatggaacacctcatccctgctttcccttgtcacaacctgtgatgactatcaactgctgcaaatgacatctttcagttctcaggttcttttaatagatgagtttatgtgtggctgtggtatgtgaaaaacagacatacagtatgtcttagtagggaaccaggataagtggtttcttattatttggaggcagtgttttaccatatgcctcacatgtaaaatatccagatactttgtcttcaaattcttgtgggtggaagaagacctagtttttgtccttgagtaggaattggaatactgagtgtttagtaaaggtgttttagaactttgacaaataaaaagcctgaatttgtattgtatttttgccttcatgtcagatctgtgacagactgtggtgttatgttcttttaattgacaagtgcgtaaatgagaattttagctttacggtgattgtacagtttaaatttattaatttatgctataattaaaaatggaatctatattcataaattctagaatatgtgaattcatattgcctgagatctatgaaacctaatacatttggctttcgtgtgtagttatttaatcagaattccattacagttttgaatatgatttttacaagcttgtcaaagtacatgacagatttaattcttcctcagggaagaaatgtaaagtatatctgtgtacattcaggaaaaagttgaatgaaacacaagaaaactcagcaaaaccaaaattattcagactgggatgatttctctaaaatcccttcctgtgttttaattaatgaaatattctttaattagtatatagttatgtctagtacatacatacccagggtgatcttaagatagatttaattgaattgtgtatggctttatacatgttttaatatattttgatagcattgatatttcttttcccgatagtgtaaaagtttgataatgacgttatttccagtgatttgatgttattttaaatggttttaggtattggagggccatgggccatagtgtactaaacatagggatatgtttatttattggtttcagtttatgctgtttacataaagtataaataatttatacatcaatgagagtcaagggaaattgtgttatgggcatttccctatttgtatttattgagaattgttgactagaattgtttagtgatgtgttattaagacatttactttccatctgtttcccagagggtgtccttgtcctctcctagtcaccacttgtgcaaacagcgaaagtttagaaaggtactggatttctaacttaacccctaatttctttccatataggaagaagcacaaatatactgacgaatattttaagagtgtatgttcagattgaatctatactggagatatttgggggtatttgtattaataaatagtttcttgatgtgggaaaggccatattgggggatatgtattacagtttcaagttaatagtattaatatattgactagcaaaacctgagatcaggtgatttcgttgactttcttctttaaaaataaaaaaataatgaaatcataaaagaagcagttgtttctaaaccagtagttgataatctctagattcctcattagcctaattgtctgaggataaattctgctttcttctgagggttgctaccactttccatcattttctagggcggactagaactttgctacttaaaagagtgagctgctgactgtcagcatctgcgtcacagatgaggttgttagaaatgcagactcttgcttcccccaacccccaacccagaatttgaatttaacaagattcctggtgaattgtatatataagtaggtttgaaaagtgctggtactggagcaagactgtctggtttcagatccatgctctgtcactaacttgctatgttattaccttagatacattttggaatatttcggttcttctcctcagttgtaaagtggggattaaaatgatacccccctttataatagggttattgtgaggattaaatgacttaatgtgtttaagttttgtagcagtgtaaatcgagtcagtaaagtggccacagcaagataaaaatgggagagacagtgtagcctgtagtgatgtgctctcactgttgctggcattttctctagtgcattgacatcttatgtaattttatcttagtcagttcaccagataattgagtacaagtacataacaagcaatttgttttttaatgtcagtaaaagcagttcctaggaacttgcgtaaaaaagaaaattagcctaaaaacttcaggcatagatgaacaaatattgtattccttttaaaggaacatgcataagattaatgatatttaattcaatagagaatattatgattgtccagtaaagtataataaacaatttttagatgagtaatgattatattttccccttttaaaatagaagaatttgtgattttactgtgaatgggattatatcagcagttgtaaaattcacattctggattgctgttacctgcattacctaaccccatagcattctttccatgtctgtgaactaaggagaaattttgaaagcttttttctaattggcgtatgaaagcaggtaataattgaaataacatgtgatccctatattagctttgttggttgcttatagagtacttggttttaaactctctcacacatgtagatagactgctttttcttctttacttaatacatttgattgtttttgttttagtgtttgctacaagattgtatctcattagttatctagtccttttattttcaattcttcaaaaaaaaaggtcctggaacccgctttttataaaaattaaatcttaattggaagctcgactgtaaaacagataaatacagaactactctgacaaagtatttttcatcccattatgccgtgggtggtcatctacagatagtttgtattattagttttattgttaataaattcattttggcatcagcataaacctcaaaaatcatgagggtttttctggggacttgggcgttagtgataattttaaatggtttatgatcaaagcaaattgacgttttatttttcaacaagctaatagtttcttcaacacaactgtaataaagtacttttttcatgctgtattataatatttgtctgctttctgcaagagcgagtgttccttgaatggagagattgtctcattcatttttgtatcttttccttacttcacatggtgctttgcatgtgaaggtctgttaataaataaattgaagtctctcaaattgacatagaaatagcaattccaggcaaaacaatgacttcagagaaaatttattaaatatcctatacattctttacctttttcataattatgatacttaatatttaataacctattcaaagtttacctagctactgtttttgcttataagaggaaattgatactcacagtaggcctagttatttcctccatacgtgccagtgtagcagaaatactcagtactctgtgtgactggaaacattttccaaaagagtgaccaactgaaaataatattcttcccactaaacttcacatttttattaaggatctattaagttcaatgcagataatgtaattagaaggtgggtaaaacagcatgtgcttttaaaaaaagttatatgtttacttcgcagctacatgctcacataaccagtcatattcctctcataaccaattagtactttatgctctccttaaatgagttgctgtaacaacagatggatatgtttacttttcaggaaaatcagcaagtcttgcatagagtgtaaggacattcagattgagaatgaagaacttgtcctttcagtctcttcttccctatcaatatgagataaaaacataataaaatcacttgtaaatctagagaaatagaaagtgatttttttttccacataccaattttgacaggtaagtatatttgggcattttaattggaatctggaagctgaaacatcttcaaacttttaacctttcttttgccttttgatcagtggttctcaactgaggcaatttttgtcctccccttccccagccaccaggctaggcgacaattggtaatgcccagagatattttttgcttttcataactgaaggagaagggggctaccactgacattagtaggtagacgtcagtggtactgctgaataccctgtaatacataggacagacccccacaataaagaattatctgggccaaaatgtctagtgctgaagttgagagaccctcctatagatatttgttcctgtactttgcctcttgaatttttgaatagtttgcttttgactgttttcctgtcttattagtgatgcatccttaatatattcacctacaccttcctcagctgattcttcacttcctgctacttctatgcgtagtttacatatgtcttatattatttgtcatacgtgtgtgttattttttatgtgaaaccacaggaatgactaccttgagtacttgctaaattatggtcttctgaggccagaaatgcttacagcagtattttatttcttttaggtcttgtgccagttaattatatccctgcgtgatctagctttaggctggttatatctattatgttctactaggagtactaaagtaacatcatggagaaataacattggacagtcatcaaaattcagtttgacattgaattacacacaggttagaaatgtgtgctcttcatttgggttttattttcatcattatgacaatacacaagttacttcaatttttacaagttcacaatcctttatttgaaacccttggggccagatgtgtttcagaatgcagaaagtttcatgttttagaaaggtagtatgatgtgtttgtggtactttatgtaatctgttccacagtaatgtttctcgacattactgtttccacaccaaaaatgtattaatattcatacaggtggaataagtggaagctacaaatagtttcaagtcagttcacatttagggttgctaccaaattattttgtaacaaccttattaaaaaacctttgatttttttttcttttttttcagagttttgggattctagaattgtagataagcagttatggccctctataatagttcccccttatctgtggggaatacatttcaagactccctagtggatgcctgaaagttgagatagtattgattatatactgtgttttttcctatacatacatacctatgatacgtttacataagggttacaaattaggcacagcaagagattaacaacttcccattggcatatccaaactgccagcatcactactcttgggctttggagccattgttaagtaaaatgagggttgtttgaaaataagcactgcagtagtctataaccgattttgatagtggagtctgatagccaagaccactaccaagtgactagagcaagcttgttctacctgcggcccttgggccacctggtggccaggatgtctttgattgtggcacaacacaaactcataaactttcttaaaacatgagattttttttgcgattttgtttgtttgtttttttagctcatcagctattgttagtgttagtgtattttatgtgtggcccaagagagttctgctgctgctgctgtggcccagggaaaccaaaagattggacactcctggactagagcatatacagtatggataaactggacaaaagtatgattcaagcccaagtggatggagcagggcaatgtgagatttcatcgtgctacttagaatgaggtacgatttaaaacttaagaattatttctggaatttttccatttaatatttttggactgtggttgacctagagtagctggaactgtggaaagtggaactgcacagataggtagggactgctctgctacttctgttacgtgaccatgactgaaattacttactactcatgatgaaagggtattttcatttgctttgctttcttttttacctgtttcctaatagctgattttggtttctcagttgttgtttttggtttgttgggttttttgtcttgtaacttgtatgcttaagagttcttttctcttaaggtgaaactatcagtgtctactcgtttttaagttgttctttgtttactgggttgtttttccactttgctttcaaatactcttttaatcattccattcattctagatacacagtattacacagaaaggaagataatctttaattcttaaacacaagtattaagtaatacttaatactttggatgtattttgccttgcattatttaagtgcaattagactataaaaggagatgttaaatttttctggttgtgttgtgattacaaacaaacctagaaggctcagtggctcaatgtataaagatttatttctcactcatgtgaagaccactgtgggtccagggactatcttgggcagctcttctctgtgttgacttatatctgtgtatcttgtagctctgacatttggaacatatgcctcaagcaatcctcccacctcagccttccgagtagctgggactacaggcgcaccccaccatgcctgactaactttttttttctttttggagacagagtctcactctgttacccaggctagagtgaaatggcgcaatgtcagctcaccgcaacctctgcctcccgggttcaagcaattctcctgcctcagcctcccgagtagctgggactgtaggcatgtgccaccacactcaactaattttgtattttttttttagtagagacagggtttcaccatgttgatcaggctgggatttgctttttccagtgagtctctttggaagagtggctgctccactttacaaaacagaactaatgttctcagggcaacctaccacatttatatatttcattttaaattgatgacattaatgagttttatgaatcaaatatgtgccttgcatcttgtctaaatgcagtagtaaagttaaattgtaaagccttgggatttttatctctgttgacattctatcagttttataagggtgtatagagaaataacaaaagcttgtttatcacatctgttttggatgtgcccgtcggtaggtggtgataaagtaataccaatagtgaggatcagcttagggtcattcaatttgtaaaaatcccagttccttctttttggtccttgatgtatataatacttgttttaactttatggttattcacaacaaatgaagctttgaaaggaactgtggtgtagtctgccttttttggaagcttttggactagttatgccattccaaagtttttttgctgctttagtgttccagagcaaatatactctgtcattctgtttaacttccagcttgtctggggaaaaataaagacatctctagtccaaaattgcttttgggagtatagttccacatcttttggtctgaatgaaaggcctagggaaacatgaattttgttacctttttattttattttccttcacttataaatcatcatcatgatccccctttacatccatgcgtctcactttttataaacactgtttattccctttctgaggatggttatttgtagttagttttgccatttacagtcttataggtcctttacaaatggatcattttctcacattaaattctagtaggtcaagaatccatttattcagggtcccgaagagaatcgatctcagaagattgtggctacatattttttatggcttcctattgctttctgtagtcttcttaatttaaacagtagcaacagcaaaatatagagggtaccataaggcattggctttatgatttattcttgcctcatacttgtttcttagggtattggtgttatttgttagatttgtgatatatatgcttgtactaaatttacctggtatcacaatgagaagaaacctggcatttgaaggctttgaacgcaaactcagagacatgtaatttatatggaattcaatggcagttttaactagtgtgcctttaatttttcttcattttatgtttacaccagtgtccttgtaaaattttaaaagacatttttctcatcttcccaggtgcttactatccacatttccattagaagatgccaaatactcattttcttcttttgaaaaccctaaaataagcacgttgcaattatcacttttcccttctgccgaggtttcttaattttggagaacttgaaacatatgcaaaagtaaacaggctggtatgatgaacccccatatatataacctttatccagtttcagtagttacctaatcatggctaatctggcttcatctatgcctccgtccatttcaccctcccattattacattaaaaaaatctcagacatcatttcatctatatcttaaaacatgcaagtatttcactatgcactttcaaaagataagactccttttaaccattgtgacatcagcatgcctaaaaattttcagtagctccgtaatcagtcattgtttaggtttacaaatgggtgttgtccttccttccccacagttatttgagtgaggatacaaataaagtccagttgacctttgaacagcatggatttgaacgagtgggttcatttatacacgacttttttcaataaatgtattggaaaaatatttagagatttacaatttgaaagaaacttgcaggtgaatggtgtagcctagaaatagtgaaaatattaggaaaatattaagaatccacaaaatatatgtggatactagtctgttttatcatttactgctatgagatacacacaaacctattataaaaagttagaatttatcaaaacttacacagtcatttacagaccacacatggtgccatttggagtcaagagaatcgttaatgtaaatattaaatcgtaactgcataaaattaactataacatactgtattactgcagtaattttgtagccacctcctgttgctgttgcagtgggctctagtgttgcaagtatcttcttaaaacactatgtgatgctaatcatttctgtataaacagttcatcactccagtaaattgtgtattgcggtaaaaagtgatttctcctggttctcgtgtgtattttactgtgtttcgtgcaatactgtaaataacaccatgggacccatggtgttagtggcactagtgatgctggaaatgctcccaagaagcagagaaaagtcatgactttacaagaaaaagttgtaattgcttgacatgtactgtaggttgagatctgcagctgtaggtgcctgccatttcagacaagcttacaatattgataaatacagtatagtactgtaaatgtattttatctcccttatgattttcctttgcttattttactataagaatacagtatgtaatacatgtaacatacaaaacgtttctgttattggtaaggcttcaggtcaagaataggctattaagtttttgggggcatcagaagttatactcaggttttttcctttttttctaatctataaggttctcagtgttgtcttcatttttgcaatttatttattgaagaaactgggctgagtttccttagagtctgttttgcttattggatttctgtggtatagtttaatatctttcttcatccttagtgtttcttgtatgtttgggagttagatcaagaggcttgatcaaattcaggctggatttttttttttttttctgacagctaccactttttgtttgtttgttttgttttaacgaaacaaaactcctggtgtgcttttctatcaaaaggcacctaagatctggttgtttttctgtgatgttagcagccattggaatacagctctaaacagaaacttattctcatctcctatttggttacctggtcatacatggtaaaggtaagatatgtgcttaatttttttgtcttaccagttttttcttctttttcaaaataatgagttggtgtcctagtatccttttcagaatgattgtcacttcataattgtatttcaacccattgtagtacttcagtatattgctgttatcatctttatagaatttcttaatttaaaaaaaacttcagcttaaattgctttgctctaggaaaccttagagggtaaaagtcatatggacctatttggtgtataacaatgcgagtacatacattcaacttaaccattgctctaggtattattttgaaaactgaatacttattgaagctgttgtttcaaacatgacattctcctagccacttccttgtcagttgtcagagataattaagtcttggcattaggagaactgagagatctttattataactataggtctgctttaagttttgaattaaactgagggggtagtttaaggtagaacgcaaacctttatcagaatcaaattaatttgtcacaataattgaacttaaatattaaccctgttgttaatatacaagaagcatcctcctttgtttagtgtttctcatcaggggcatcttggttatttttgactggattgtgctttgacttggaagacattgaacatcctcagactctgctgactaaatgctatgttctggccaccaaaacctgcctcttcccccccatttccaggtatcttggaggggaggggctgtcacttggcacttgcaaattactggcctagattccacattgtagtgatagcaaatcataatgctgtaagaaaccaattttatatagcattactttgagtaatatataataatttgtaatagttgtgtttcttacataaaatgtatgttgaccaagatacatttgtgtgatttttactgcatatgtaattgtctgatatgcaaaaaaaaatttcttcctctagccctttagtttttacacctccccgcaattctgaaccctcatagtacatttgaactttgtgcatgagcttaatgtgtacgtatgcacacatggctcttataaatatgtgactctgtgtatccctttgatctttttattattaatgaatttttttttttccacttacagggaaacttgtgttcttaaaaggatttctgttaccccattgcctcaaactacactttttttttttacccttctaatctctcttcaattatttaacctctttccttttctaagagatttttttaagctcatttaattctttcatctttttctacttattatccactatccagcttcccatttatctatctctatttattttttttctgtccacttttgtgtcttatatttctttcatatttttgttatctggcttttcctctttcattttattttagaaaggtcatttggtaatactagctgttagtattttttcatatgacttattctgtttcttttttgttttgtatgcgcatgttctcttcagtttcatcttctttcctgatgtacttgaaatgtgtcttctttctcccactctccttagtatttagtatttcttcatgtatgtgatatatattcttttttcacccttgtgttgtttatcccttctcatctcccctaggctctcatgccacattgtatcacagctgctttttggtgatggatttcccttagaatcctagtggttgtctatcaaaagtacctgcatttagctctcttaatttatctttatttttatcttatctttattttttcttccattatgtagaaaagtcttatgttgtagcaaaagtattgtttcctattacctgagtaaaagttgggttttctagattctgcatctttgtttacatctctcgttgcctaggatggctttcatccttcaagtggtagtgatcttttaaagcctatttcagatgttacatctttttgtgaagcccttcctgcacatatctcttttgagagacatttgtactactaatatttaattcactggtattgcctcttgtcatgtaccctttcatcccagctgaaccgggcactaggactgggtatagctcttatatttctttatattttcatctcggtaaaatgccgtagcactaactatgagaataattttaattaacttagttgaaagtagttctgaaacttgccagactcaaagtgtagagcacaacagcaactgtgcttgaccgtactccttggtttacatctattgtcttgacaaaaatattaatagcatttcctttcacttttagaaatactcgagtttgtatgataaattttaggttcactttaccctcatgctataaattggtggtgttctggttggacttggtgaatcaggagattgtataatcaacaattacccaaagcagagattctgatttagtaggccaagggtggcctactaaatgtgcattttaagaaggcatgtctaaggattcaggtagtagtgtgagaagcagtactctgtttctggtactgaggctaatggtcttagttgggataaggagagtggggaaggggcagggggagatgatgaaattcatttatcctctgtgatgctatggaagaacaattaagatcatgtttcctacttgattttagttgctagtcatttcttaatctaagcaccccctataatttacctatgtcatcatgcaaaatcaccattggtaataatgtgggggcgggggaagtctatacaagaatattaaggccctgtgcgtgagcatgtctatagttaaagacttaatgagaaagcatcaaattgtggtgcaaacagctgaaagtagaagtaaatcagaacgtaataagatgcaactttggaggagctcaaagcaacagatacgtttttatccaaaaaggagtaaaacaaaaaaatcgtcaacggcagttccttcagataatcaacagatgattcatttgaaaaccataattaactaggttgtttgtaaaataacttttttcaatttatactttttaatgtttattaaattacttttctctatagatatgcagataagatgttttaaatgtgtaagtggtataaatgtcccatgtgtcttttattctagagcataagaaaagatgggaagctacctcaaacttgttttgaggcaaatgtagtatgaatccctaaacataacaccagtactgctaaatgacagttatctaatctcactgatgaacaagaatatgaaaattataaaaggtcgaatttatttattatgataagagaataatacccctccacaaagggtattacatgaccgcaaagaatggcagttcctagtactctgacgttccacagtaggctaaagaagaaaaactgaacatttcaagaaataccacaataccaaaaaaagcatttggtatagtttatctcctcaccagttgtgagccttttggttgtttccaccttttgggtactgtgaatagtgttgctgtgaaggattcacaaatacacatctgtttgaatacgtggttttatttcttcactgtatattcctaggagtggaattgctgtgtcatatgataatttctctgtctttgtgaggaaacattgaactgcttttcacaaaagctgtaccattttactttcccagcggcgtatgagggttccaatttgtccacatccttgccatacttattttttgttttttttcattataggcaccctcccgccctccacccctcccaaaaaaaaagaaaaccaaaatataaaacagaccttgttgtacatcaaggacatccacatgactcagataaagggctttggacttagacaaatggaagttcaagtcttggctttacaattgagtaactgtaaaagcttgagcaagttatctcctctgattctcagaaatgtgaataatacctgtttcatcattcttaagtgttttagatattatgtaactggtatattttacatataatgatataaaaagcagttatatggacaaataaacaggcatgtttatgaaagaacattttgaaaaatgaagtattaaaaccagttgtaataacaagatatacttttgaaagtggttctggcccacaaatagcaatgatcagtgatacagaataaagaatattaatacagtttggtgattgttttgtgtttccagctgccttttgcaatttttgttcttggcatttaacccaatttctagatgtattagatacatacatatttatagttttaaagttttgttcactaggtgttcagaataagactcactgtattataaaacaaacacctctttaaaaaatctattaaagtagctttctacaacatggggttaagattattaagtgacattgggatacatgaatagtgatttaaaaaactgttaatcacaacttctataatctaaacataagatggatgaaaatcttacattttgtaaagggttaagctattggaaaactttgcaaataggcatatatattactggttgaatctaaaatgttaacactgtacaactccagggggtaccattcatactgtactctgtattcagcatagcacagcacagagtaagtatagtataaatggtatcccctgagttgtatagtgtggtggccaggattagaccttaaagaataaccttttttttttttttttgagacagagtctcgctctgtcgcccaggctgcagtgcagtggcttgatctcagctcactgcaagctctgtctcccgggttcacgccattctcctgcctcagcctcctgagtagctgggactacaggcgcccaccaccacacctgactaattttttgtatttttagtagagatggggtttcaccgtgttagccaggatggtctcgatctcctgatcgtgtgatccgaccacctcgggcttccaaagtgagagtaactttttaaattcataagcaaaatcgtaaaggcattgattgaaactgttacgtaaagtaagaattcttgtgctttgaaaaggaacaaaattttaagcacattagcatttgatgtgtgtttaaaatatttgcatcaacattacaaataatgtatgttgtgcatcatcaactcatatcagtaatgaagatattaagatttactgtgatgagatggagaatatgacacactgactcttaaagaggcaaaaattggaaacaacttgggacaatttgcattacttggactctttcagaaacctgttgaaagttttgaaccactacttcagaagaatgcttaagaatttttggttttctgtactccagagttcctttaaagctctagtgttttagaaacatgagttactacatttaatgtaaattagagtgaggaaatgaaatgaggtaaaatatgtcacttaatcaggaaagagaggtgggagagaaatacagagtagcctccagaaagttgagagcttggatttcgaaagtagaattttcgagcttcttaaatggctggggaaaagaaacatacaattatgttttgccttgagtcccagaagtcctccaccccccacacccccaactgtgaatgtagagggtgggacatcaagaagtggaaatacaacaaaagagacaatttggagaagggatggattgatacagcaccagataagtaggtttgcttaagcataagagaaggaataggcagaaaagtgaagaaaaaaataaaggagattaggagcctgaaatggcctaagagccctgtcaaaactgaaggtaaggattcttacatgtaaaggccataggaaatctttacagggtattgaaaagaggagctgggatttcgaaggtgacagattagcatataaccagttgtggtggttatagagacttgggtaacaaattggggagggcggagagaaagagaacaagctggatgcagttcacctttcatatctgttaatatactgttttcaagtatggatgaggggattttaaatttttattattttttaatcatctaaaatggcaagactgtctttactattaagtatttgttgacgaaaagaaatgtgtttgtacatgtctttgctttaataatggaagtttacaaagaagttgtagttttccagctgttgcatatggagattgaagggcttgaatatcccaagcagcagacagtacagtatcatagaagcctagttggcattagctagaaatacatatggccttccacacctagcatttgctggcaaatgaaatagtagggatgaggttgactttatggctggcctactgatcacatctggaatgttttaatggatttctttttttactgaaaatgtatgcatatcacttgttggctgcataagagtactagtacacaattaacaatataatgccctttgatctagtttcatgtttaatctatattattcattaatgtttattttctgttgctcactgcgttaggtaaggcatcctaagaggttgtatgaaaaagtatagaaggataaagtacatagagaatgtttaagctggcagatacctatcaattcacaatactttttttgaagacaaacttaggaatgattacgaacgaagaaaaccctctaaattcatagatttgattgccatgatttacaacagtgctttccaataaaaatgtaatgcataccacgtatgtaattttcagttttctagtagccacattagaatttaaaacaaaggaaatgaattttaagatttttaaactcaaatatgaaaaattactaatgtaatataaaaattaatgagatatttcataatttttttgtacagtgtttttgaaatgtagtgttaaaatatacaccaccttttaaggacttaaaatagccacaggtagctagtggctactgtattagcagagatttacaattgctgctctgtgttctttcacttatcttcgattatcttttgttccctcttacctctttttattgtgcatagatttcaagaactggggcacaccccagtttgtgaaaagatggacaacctttcttggctagagataactagatgtgaaaggtctgaaagaaaactcaacacccggtacaaaaatgcaggcttcttttcaagggtttttgttttgaaacacatctctctgcccatgtgtctttgttgttggtatcttatgtagtacatgtgtgctttttgttttgagagagtctctctgttccttttgagaatggagtgtatgtcctgaacatcacttttgtgacaggaagtataatatatgtgccttaattagtattcccagatagaggagtttatttagtaaggagcttatattagcctaaatatattttcattggtgttctgagatgaagtgttatttgttatgagtttaatttttttatattaacagcgtttaagcaaacatgagctaataatgtatttctaactgctttatcacattatagacaatcttgccattagcagtactcatgtttcagatgacctctaatgagcaaatatggtattctcacttgagacatttctagaagtactttgtaaataactttaaatcaaattatttatgtctacttttgaagaacttccaggggggatgacgctgtctcaagatttaaaaacaatctaattacagttggactttatttgatataaattaagatgtagttagtttctggatttttggattgtgattttactcagtacctgaatgtcataagtcagtttgctggttttgaacactgaatttgaatattataaaactttataaaacaaaatttatttgtttgcacatagtacactgtggaaccagactgtattttctaagactcctagccatggacatttttattgccgtttactttttccttatatgatgaattgttacaagtatcacttaattgcagctatacatgcccatttgaatatgatttcaaatgcattacttgttcagtgtggtaggtactattctaggtaatttacatgtattgttgatatttctgcattctctcaggaagatgttactatctttttagaaatgagaagaataaattcttcagaaattatataactagtctaaagacagactaataaatgatggaagcaagattcagttttaggtctgtctgactgaaggtcatgctcttcatcacactgcctgcatcaggtgtgaatgtgtgtgtgggaaggtcttggagaggctggggtggagagttaagaaatatctaatactgtgaagttaaatttaatcagtacagcataatactttgcttttctcttcactttctctgtattacacagagtttgaaattaattgactcaaagcaactttcagaaattataatttttagagttgaaaccaatggtgcagtgtgtagtagttctagttgtaaaacttgataacataatgttaatattttaaatttcttatttgtatgcaaaaaattacctgattagctgtagcttaagaaacaatacagctgagtgtggtggctcgcacctgtaatcccagcactttgggaggctgaggagggcagatcacgaggtcaagagatcgggaccatcctggccagcatggtgaaaccccgtctctactaaaaatacaaaaattagctgggcctggtggtatgcacctgtagtctcagctactcgggaggctgaggcaggagaatcacttgaaacatggaggcggaggttgcagtgagccgagattgtgccaccgcaccccagtctggcgaagagcgagactccatctcaaaaaaaaaaaagaattgcgttaagtaacttttgatttgggactaaatatgtttaatacaaggaatacttgtcagtttatgtatatgtcctttgcacatgcttacagcatgtttctttttaagaaggctaaggcatcatagcctcctatattgtgaaaaaagtaatatatatatacgtagtaggtgacaactaaggcctttattgtttcttggccttttgccaaatgtaattttgaatgctagtgtttgtatgataaatcttcagacagacaatgtcttacgaagaaaatattttggaaggattttaagtaaaacccaaaacttttatttgcatatacttgcatactgtcagcctataagacaaactcagcactgtgtgtaagttacttttaaaaattgactttgaatgcctgtatcagaacttatttggttgcagcggcatacaactcaaaccaaaccagcttaagtaaaacataaatttgttggctcacataactgataaagtcagagtagatttggcatttggcatgctgtcagcatctgatttacctttccatttgcttgctttccttcctcttagttgactccatgattagacagactttctccttgtgatcataagataactgatagtacctcccagctgtgttcttcagattgagatgcagtgtgaaatagcgtgaatcttggccccagttttttcatcagaagtctaatgcatttcattaactccagctgagtatattatatccatatggttcatgcctaggccactgctctatccccaggataggaatggcattaattccattggaagcatgtagactgtgagaaggggtgcaaaggtgaactgggttaccacaagttaagtaaatgaagctgatgctgagtagcaaaattagtatgtatctttttggactgataggcattatctatttctccatagtccttacctcttcctattatgatggttcacttaactaatttatattacctgtgtggcaccttactgacatttgggtttgattcttctggtttataatttcctgttatctattgaataatttgttacggttatatagttatatattttttctatttaacagacctacatttttagctttaatcttttgtatatgtatttaatatttttgtgaatctgaagttacctttgtttgagttgtgaaatggcaaggatgtttataaagggtcaggttaattagtttttcaaatggctttaccaaacacaggtttatgtgttggttaaagctcagctggtagtcttgaactgcttctggcaatttcttagaagaggctgtagcccagattttggctcatgtgtataattatagctaagccaagagctgctgatgtaaacaccagtttatgggctaaggactgggaggctgtcatagttggaaccaaggaggtccaagcctagtccttctgaagaacagaattgggaggcatttccagagtctcttactctgacagcaaggcagaactggagagggtaaggaggcagaagtctgtagggtcagaattcgtatcaccaggataaaataaacagtgagagctagaattgagcacaaatagtacagaaaaaattccccagtcaagattcccttgagctggcattaggtttaaggccatagagtttgcttaaatagacatactttcacttgttttaaagtaaaggcacacctccctgttcaatgtatatgcattctgttcatattgtttgtgatttcagatttttgttgccttccaccttttgccgttccagattccatgaaggatactacttctggatctaggatggccagataaaatacaagatacctaattaaaattgaatttcaaataaacaataatttttataagtatgtcccaaatgtacatggagcacacttatatgcatgttaaatattaggaacatgctaaatatttctcgtttagctgaaattcaaatttaactgagtagtttctgtttttctgtaattaaacttttgattttgagataattatagattcatatgtggttgtaagaaagcagagagattttttctatatttttatttgctaaatttgacaaccctctctgggtcctttcatcataaagcaacccaacctccaaacatttgtgttttgcaaatagtaaatattagttagaaaccctttggatcctctgatacttcagagaagactgacttttgaaagatcagtttttaaagtaagatactactaaaattacttaaacattttcaatttctcagagtaaaattactttaaaagccatgcagaatttataatacctaacaatctaatatttctagcaagatactgcattggaaatgttaggaaacaaataatttagcttgaggcatctctgagcaggtaatattttgaaccattcagtctcaggtctctttcatctcccagtccttcaaagttcttccacctcctttgacctaaatttaatcatttttttttccagtagtctgtggtgactttattagtgatttcataactatgggattacaatttggataaatcagatcttaatgcccactgcccctttgagtaagctgagagaaagaagtgaccctgcaggttttcagaatttttgagcctaattaaaatagcttgctaccttatccttttccctcatctgtacagtaggtagtatggcctggggagaaagaaggctagcgtgttttccacgcaattacttagccctacatgttgctccctattgataatcagaccttgtgagtactttcatcattttataaatataagagagtagactggactccggaaaagaagagaaagtggagataagtaaaactgtgaactaagtataattgttttttttttttttctttctttatacttggaaatacctgggcaaatagctatagaacattgttctctaatgagatggaaattggagctggaaccatttgaccttccattggttgaactttggtctccagagttaccatcctggaaggggcagtgtgtcaatgtattctttctgccaagactgtggagggggcccaacagtgaatggaggccagtagagccaaaggtgctgctgcaggtttctgtctacactagtgctggacaggagaactttccacaatggtagaagggcttgatatctgccacatgtgggaaatcgaacacttcaaatatggctagtgtgaataagaaactgaatttataattcaattttaattattttaaatgtataaatagccacagctaacatttaatgaagtcttgaacccttatcaaggaaggtttctacaggaaaagtttgttaatccttattcttcaagcatccactgaaattaaagccaaacaaatacagtactttgtattctgaattgtctttttaatctggcttttaaaaaagtaggacttgaaaagtattgagatttaatcagtttaaagttgggcctgggtgataaaaataagcagttgtgacattatgggatctctgcggtatagacaaatatgatgggtatgccaatcaggcatatgttattttgcttatgatgttttgtttcttctgcatgaggattggatggaagctgtgcaaataattctgctaatatttattgaccaattactatgtggcaggcaatagtgtaagtctcaaagcagccttatgaatgttatcctcattttgaggtgagaaaactgaggtacagagagaagttcttccgaggatcacatggttggtaaaaggtgaaagcaagatttgaaatcaggcagtctggctccagagttcatgctcttaactgccacactgcactagtcttgtaaattgttcttaaagtggtcatagatgcttcgtatgtgcatttctagttctggctgaggtccaactggatatatacagcagtcctgactgggtaagggaatgtttccctgttccaagccatgctcagggcagcattaggggcagccccaggttctagcagagagaggaattaggcctggctgtggcggagtctctagtggtgagaggaggatggaggatttccttagtggactagttaaagggaacgtcagtgggaatgcttagagcaggtcagagagcactgggtgtgcctaagtcaggtatgtatcccacaagcaaatgttaaacagttattgagagtgatggtttaatttctttagagctaagcttgaaataattttgtagacagtgaccgtgattctctgttgcagtctttgacaaagtcagtcttgcagtatgtgcttttttttttttttttatcagactagggtataatttgttttatttttcatgggaatgtaaaattagttgaatgaaacatcattggatcttgatgcattaaatattatagcagtgctaaggatacttattctaaaacaacataaacagataaccatttgtataaaatcgttaaaaggtaaagaagtagttatttcttctagccagttcttctacattttgtcacttgtccttctcctttagaatgttctatctagtcccagattttcttccttagtaattgttaatgtaatgctagagtgatgttttccccaggtctgtaatatttttgatgctaagagattggacacattataaaacaaataactgaaaatcagtgaccttttatactatttatctataaaaccaactttgaattactaaattatcttaccatttttgtttattttggcatatacaccaaaataaaaaatgcagtttttacccattcacatgcagttcttacccattcttgattacagtaatgttttactaaccagaaacaaagtaagatggaagtccaccacatactactactcctaccataatggtgtaataattggaaaatatatatttatactaggctttatttatactaggctttattattttattttattaattatggttctctatatagttcttttttgttcagataaccaaatatatttcagtatacaccaaaataaacacttcactgcttgaggtcagtgaacatactattttctttattttagtgtttgtttttctaacttctacttaagtgataattgtgacaatttcttctgactcccgtactgtaaagtacaagctaagactaattcctttatgaaatgtaaaatgtactattttatggatttgttgataactagaatgtaagtttgtattaataaagtgcactggcacttagctatatactttataaatgctttttctattattaatgtatagcctatttttcttgataagctaacttttccagttttttaatactttttttactcttcatttattcttctcaagtgtatttgtattttgatattttaaatactatttctgctttgttttatgctacccagatatgtggttgcaagtatgaacagattctagtcacatgcagtttttacccattcttgattgcaggaatgttttactaaccagaaacaaagtaagatgaaagtccaccacatactactactcctaccataatggtgtaataattggaaaatatgtatttgtactagctttattattttatattattaattgtggttctctatagttctttttcattcagataaatcagtaggcttaatttcaggtgtgtcagctagttacagggttaatatgttactatgatactatttcttgtcagtcatattctgtattttcaatacagattatttttttgggaaggattatttttttgaggtcgtcactttagctggtaagagtagtgggtgtacaagtcgcgctcttattgcagctggcagcatgtcagtcttataatctgaagagtagtggttgatattcttagctgtagaagaaatcagggaaatcaaagggatatttgcatatttatagattctgcctatcctcctgaatctgtgttctctaatgtaagaaagatgatctgagtttcacaggtagatataaaaggaaaatagtagatagcagaatttttccaaatgtcatcttatactttactttttctacatttgtataaacagtgttttctggtgggacttcagaataactaaaacagcctgtgactgatacaatcaatttaggggcaaaaatgtttgctaagaagaggtctgatgttatagaatgttgaaaatatttacctcctgttgtcatatcctcctcttttttttttttttacattttgcatggatgtgtttattggcaacattcaaatctgcctcagacttttatgcgtgctttgagtacctctttgaaaaaatgaacctactgatttctttactagtgagtgtcttgaattaaaacttcctgctgaaggcttgccagcttcaacttcgcatcatacaacagccagagctttcacagacttatctaatataagcccttcacttaataaaattaaagagagactaggtgacttgagcacagggtcttgacttttttttttttaattagttagagccagaacaacaattcagatttctaggcttcagtcctgtcttaatctgttttgtgttgttgtaatggaatgcctgagacagtaatttataatggacaaaattatttgactcatgttatggaggctagaaaatccaatatcagggtgctggcaggaccttctttctaggatgctgcttatcccatggcagagttcaagagagagaggtgatggggagaaaacgggggtgataaggaggtagggagagataactgcacacaagggcaaaagggggccaaactcagtcttttataattaactcactctagggtggagctcccgcagcccagttacctctcagaggttctacttcctaatactgtcacagtggcagtcaaatctcagcctgagttttggaggggacattcaacccatataacaagtccagtactcttcccagtgcacctaaatcaaaactaagtcaaaaattttttaagaaaaataatgcactggctgcacaggaacgatggtatagaagtgccattttaactgttagttgctaggtaatgtctttctattctttaacttccagcttaatgccagccttgtgtgagctgtaacaatttaatcattcaggtcctctggcaagtagtgttatagaaattggatcataccattatttgttgtttttattttggcttttaaaatgaatgaaccatgtgtcctccttttaagtgattttaggaagagcaaatgataaggatggactgtaacattttttccagttacttaatttcactttaagaatagtgatttttatttgttttaaaatttcctgagtgagggttgttaggcaaaatggactccatagagtgtatcatattttcctgtcactttagtgtctcagaattaaaccatcattttatgtggaagcatagctccgctttgctctactgcaaggtagagtgctcagttattaggttggaaggaaacaagttaattgatgttttcttttgagagagggcaatatgatcagtcagcaactccaggtttttgtcacttgtgatgacattttttaatagtattcatgttcctttcttgcgtcaacacttactacattaacaacactgattagtttcagtaaatgtacatgtataacaaagtatacatgtactagtatatactgtaaattttcaaatataactgaagcaaatattttgtcttatgcagttgacagggtattggttagttacagttgtcatttgaatcagtgctgtcttatttacattattttctagatagtttgctatgtattttaggtactttaatagctctttaaattaaagaatgtcaagggatgtgtgtggctaggtgggtgtacacacacacatacatgaggtcgctcatggattcaggtttgtgagtgtaattgattttaagtcatttatttgacaaccacacattgtcacataagcacacaagaggtttaacatgtaatggccacaaagtaatctctttgttatctatgaagccggtttggaatgtctgactgagtaaaatgagtgcagtatattctgtgtaaactaatagttcaaaatatacatatacccatatccctagttgttagttatacagatatttagttgtaattacaatctaggttttgaattatggtgttaaaccatttggtggcatcacacattagactaaagttttattatctaacccatgtataggcatgaatttagagatactaacaagtattggtatttctcatattgaatatttatggagcccctactatgtgttagacattgcttggtatttagaatataccagtggacaaagtcaggccttgtccactcccatatagtccttcctaacaagggatcaggaagacatgcacattaatttttttattttttacatgggagtctcattatgtttctcaggctggccttgaattcctggactcaagtaatcctcccacctcagcttcccgagtagctgggactacagtcatgcaccaccttggctgactacattaatttttttaaattgcaaatatgttaattgcaacaaaggaaaaatactgagtgttatgatagtgaaccataggagttgtgttatctattgctacttaacaaattaccccacaatttagtggctttaaatggaaaacattattatttcatactttctgtaagacaagagtttgggagaggagtagctgctagctgggtggttctggttcagggtcttccatgaaattgcagttaaggtatcagcaggctgtagctgtctgaagacttgatgagattggaagatctattttcaaggtggctcactcacataaaaagctgttggcagaaggtctcagttcctcactggctgttggcaaatggccctagtttcttgacttgttggcctacctgtaggctgcttaagtgttctcataaaagggcagttaacttcctctagagtaagtgacctgagggagggaaggatgacatttccatgtaacctggacttctataaacctgatgactgggtttcaagagcgaatattctgaagcaggggaagtgggaagaagagagggagctcatgggtgtgtatatgtgtgcagcagatgaaatcctcattactttttttgacctaggcttggaattcatacagcatcacttctgctgcttttgttggaggtaatcagaaagttccacccaaattcaaagggagcagaaatagaccatgcctcttcatggaggaatggccaggttctgaaaaagcatttggaccaatattattcatgtggtcatttttggaaaatacagtttgctacagaagggagagcaagagcagatgctggaagatcagtaacatgcttctaatagtctaggaaggatttgatggtagtggaagtggaggttgtaagaagtagataatacaaaaggtgtgccgaagtatggatagcatctgttgattgaaaagatgtggatggtgaaggagatgtatatgtcagggatgatgcccatgtttctgacgtaagtattaaatgcagtgccatattcggagataggaaatcctggagggtgtaaagatggaagttttagtttttgttttcaatggttgtggttgtggtgggtgggggaacattttaagttcatttctgaacaaagtgagtttgagttacttaagggatattcagtggaaatggagtgttgctagttggctacatttcattctgatacaactcagagaagcagcctgggttggaaattatttgagtattttaggtgtatagatggcagtatgtatcaataaagttcacttaggtgagtgtaaacggagaggatgaaaagaggggaaaaaagctttgagaagagttaacttttaatgattgattagggaaggctaaggtcaactttcagtgattgattagagagggctacatgagcaagcaaggctgagaaggactaacctgagagattggaagaaaacaaagaggttgtatgtcatggaaacctgaggtagaaagtatttcataggtgtgccaggtaagttgaggactggataatctttattgattgttgtctcttggaggtgacttcagcagagctgttttattattttttaaatttttattgatatagttatacatgtttttgagatacatgtgatatatgatacctttatatgatgtataatgatcaaatggggataattgggatatccatcatctcaaacatttatctttatgttggtagcattacagatcttctcttcgagctactttgaaatatataataaattattaactataatttcccactgtattattgaagtggaagtgaagtcaatttagaatggtgtgaaaagtgagtgggaaggaagagaacggtgatgcctgatgaagcagcccttaagatgtgtggtcaagcaggcattagagactgaggtcaatagctgcaaagaaaaacgaagtacagagttgtttttttcttaattaatatttttttcccttttaagatggaaggggttcacaacttttatatgcttatggtaaggatctgggagacaacaaaaagggtggaatcctatacatgtgaatttagtataaaattcaggacatgcaaaaacatatttaaaaattgaaacagcatttatggcccaatattttaagcctacatatagtcacattaggacattttaaaatgagggctttatcacatagcttatatgtgttctttgtgaactaaattggtgacttgcattttttttattttaatacatctagaacattttgtcaataactacagtgtttactgagacaaagtagggatagatgatagtacttaatgatttttgcaataaagactaacaaaaacaaaaagactacttattaaaaagaccaagtggtgaaataaatgataaaagtataatctggaggaaatgcagtattaaaagacagtgtcagaattcttggaaaaatgaacagttttcattatatgataaaggtaagatgattttttactttaaattttttataataacagataaggatggaataaaagcaagttaattggttttaggaagtcactaggaaaaatcgacatttaaaaaataaataccacaaattccatcaaaggtgaatggtaagagaaaatcttaaaagaatgcacagaagcctggactggagtataatcactaaaatgattacatggtccttgttccatatactagagatgatacccacaaaacttaagtcactagttcagcaatttatagctaactatgctgcaagtgcccaaactagaaactgggtactcttctcaccagcaaatgttgtttctgttatatagtaccatggagcatgttagagcaatgagaatgagtccagagtaattagccatgaagattaaaatttgttcaattcaactagctttataaagttataggaaattttagaaagataaaataaccacatgctacttctggcattcatatggcagaccttgaaataaatactagtgaacaatgtagtgggcccggtttcaaataactgaattttaaccctgaatctgccactgatttcactttgtgagcctgggcaagacactaacctttaccttctttatacctttttggggtttaaatttttttttttaaattttttagtacagacaggatctcactgtgtagtccaggctggtcttgatctcctgggttcaagcgatcctgcttccttggcctcccaaagtgctaggattacaggcatgagccaccatgcttggctaatacctttttgtctttatcaataaaaatgacagggttggagtcagagctataaaaaaactcaaatttattgtcaccaactatgtggcaggtcgtatcattttcttaatatttcttatttaatatgtaacaccctatgaggctgcttatgtcagactcattttacagtttagcctagataacttgacaattacctggcttataagtaatggaggtagaatcccagctcaagtctgttgacccccaaactgattctttttgcaaagcattagtgtttcccaaaccttagttttgtacagctttaacaactgtcgccctatcagtctcacgactattatgatttactagaaatttttctttaaatgtgtattcatatattttacttaaatatatttcagaaggaaactgcttgataaataagaacaaaacttaacaaaaaattggtatgaaagtctgaaaagataaggaactctttctcccctcatgggcagtggggtggatatatatgaaagataggaaggaccaagggcccagagagagggaacctctttaagttagaagccagagcctggaaatgccataactgttctaagaattgtgcttgaaactggcaatttgatcccatctgattgagaactttatatcacagacagagtagggagagtgaggagcagctggatttgatttaaaagagaaaactggaggtggagacagaattgggccaggaatgcaacctgtgttatagaagggcctgagactgatagaacattccctgagagtggggagaaggttaaagcctgaaggaaggacatagggatcgggagtatggaagaatcacaggggctggaagtttacattaaagtgggatacagtggtcaagactcctggaaatagatgtgtgcaggtaaaggctgaggtccaggaggggccagtgggacgagtttagagcagaaccagtaaagggggctcagaaatgaagccttagggatggttgcgtctgaggttgggatggtaatttttgagttaggggcatgaggggggtggaaaccaagcatgatccctcctggattaagccaacactttttcttctgaaactggactacgaatgtgacaattctgagcagttttctccaagggaagacagcgtgtatgtgtattgtctaaagtcacctcatggaaatgcggtaatatgcataccatccttttgggaaatgtagctttttctagactggattcatctatgccttcctactctggactcttccttgatccatttttttttttaatacggaagtgtcatatgttgcttatttaacaacagcataaaaggtttttttgtttttctttgtttgtttcctaatttgtttaagtaatagttagatctagtatgctttggacttaccttgtctttcagctccgaactaaaacgggtatctgctaactacaggatagggggtttaagatgcttttttaaagggagtgattgacgagggccctgttgctacaggattttttggttagaggaatcccagcttcatgtcagccatcatcttccagctcagtcttctgagcgtgactctcttttttctgtatttcttttcacagtgcctttactttctgctttctctttctacctagaagaccaccctaattttgttttcgttgtatttttaacctagctctacattatggggctgctacagtgattgtgctttggcttcacttatgcctgtgggactttcattttctttactcttcttggtactgctggctgtcttctaaaatgaatgttcttgaatgtataataaaaacagttatactctagtagcaatttatgccaataaaatataaagaacactaattatgtttagagattctgtccaccttggaggaatgcattctggtgatgtacctgtatacataaatacatatccacacatataagcacctgtgtttacacatgtgtttaatatttttatctctgtgtgtgtgtatatatatatatatatttgacctaggaagataatatttttatctgtgtatacatatatatttggcctaggattgtacagtttatctgggtgcagatacctatctacctttcagtgcagttaatctattcttgatgagcttttgtgcccgaggactcaggggagtatagtagtaaaactgtgccctttttatttgctgatctccctgcattttgtttcaatttctgtgttttttttttttttttttccattagtgagctgattctgaagagcttgaaggaagtcattttaattgaaggagttagggtttcttcctcacactttcccagtcctccaggactcttcatctttgatttcatacagttggtaacatcttaacaaatgaccatagtataataataaatatgtataattattttcttctgtgtctggagggtctagaaaagctcatgccttttatataggggagtgttattttcctcataaacaattacctgagttggatgtcaggatagatctaggttccatgctctcagatttttcattgtaaagtaaggaagttggaaatactacaactcttaagttcctttctagctctaaattttttttttgagatggagttttgctcttgtcgcccaggctggagggcagtggtgtgatctctgctcactgcaacctctgcctcccaggttcaagcgattctcgtgcctcagtcttccaagtagctgggactacaggcatgtgccaccacacctggctgattttgcatttttagtggagacagggtttcgtgttggtcaggctggtctcgaattcctgacctcaagggatccacctgccttggcctcccaaaatgctgggattacaggtgtgaaccgccgcacccggcctagctctaaaatttatgagaatacgggtccctgaaattcttagttgatagacgctaaatcattggaacatgttcagccggtgctcaaaatgtgctgcccataaatgtcactcagaagcatattaaccttgcattaatcttttttctacctgtaatataaacttttaaactttcaaaattcagtgttcagtgtcatttttaacttggcggttgtttcatcttgttactttggaaaccacagcatatattttattttggttttgcattttgaaggaataatagaaactagaaaactcaggagatgggagcttcatttgtaattatctcaaaaattattttcattggggaacacaatgtaccagtgatttttttaaaaagtctacttactattagtttttttaaacataaaaatatgagctttattgagataattgacaaatttaaatatgtatagttaaggtatacagcttgatattttggtatgtatattttgatacatgtatattgtgaaataatcaccataagctagttaacgtagccttcaccttacatacttaccattttcttttaatttttttcttttttttgtggtgagaacatttaagatctactttctcagcaaatatcaagtgtatgatacaatattgttaactgtagacacgttgctgtacattagatctccagaacttgttcatcttgcatagctagaattgtgtaccttttgaccaatatctccccatttccccatacgtcaacccctgacaactagtgttctactctttgcatctctgagtttgactactgtatttcttatctgtttttgtgggaaggttgatgtattagtttcctggggctgccataaccaagtaccacaaattgggtgactttgaacataaatttattgtctcacaaatctagaggctagttctccagtataagatgtggacagggccgtgctccctctgaaatctgtagggggagcatccttccttgcctctattagcttgtgtttttgacgtcactctacctccattgtcacatggctgccttcttcctgagtatctctgtctctcttctcttcttgtaaggacataacccataaagattaagggccaccatactctggtataacctcatcttcactaattacatctgcagtgactctgtttccaaatatgctcacattttgagatactgggggttagaacttcaacattatcttttaggggcctacaattcaagctgtcacagttgattaaaagattttgatccttaataataatgtaataaaactagaattatttcctttgtttttaattcatagtcatttcaataataccactacgacttttccatctgctgagcaaatcttatcaaatacttctttgtttcttgtgtctaagttcaaataaaagccatagtgtggattcagagggaatgcctaaactagtcttcatatagagctaagggaaaaaaggtaaatggttaaagtgggtttcatatgtaatgcataaggaaaaaagtaaggtagtcataaaaaatagacaacttgaaattcacctcattatatctggatttccctgacatgggtaaatctagtgatatggttgtaggtgactggatggattaagttttatattaagtttttagagttagggaatggtagaggataggaaaggggaatttttatccttcctgttttgtaatattttagttggacatgtttcaatatttgtgtatgcatttgaaactgatgaaagggttattacatactttgtcaatcatttcttaccctactatatgtgaaaagtagtaattatttcagggaaaggtggtttacagaaataggataatagctacagcaatataccagtcttcgtgggctttcacatatagtaatgtagttgcgactacgaaacatgagattagtcaggattgtgatgtttttgctgacaaataagatattaatcctaatggagtattgttttcccttgtgaagtcatatattcatttaagttacatttttctgtctttatccgagtgttaaaaattgattatccagataacctcaccattacagtgtttcttcttttctcttcttttttttttgttttcttttctttttttcctcttttctcttttcttttcccctccctccctcccttcctcccttccttcctttctccctccctccctctctctttctttttctctttctttctctctctctcttcctttcctttcctttccttctttcttttattctttctttacaacttttcttttaaatatactcccttccttccttccttcctccctccctcccttccttcctccctcccttccttccttcctccctctctccctcccttttttccttccttccttccttccttccttccttccttctttccttccttcccaacttttcttttaaatatactatatctattaatgtctgtggtcatggaaccatataaagtaatttagcagtttttgaccagtggatttcttaatacttttgcagactagctttctatttgtttttattttatctttttcaaggattataagtaggttggaaaatacttctgggttttgctttcttaagtgatttttaaatgcatctaaaagtttagagtaaaagtgcccagaatccttgaccttagtcttccttctatgtgaaaccaccaatttttcccttttggtcacttttttactgttaagggtaaaaactgctctgccttaaaacttttgtgaaggtaaaataataatgtacgttaacattttggaaattgtaaaatgcagtacagatgtaataagatagcattaacagtaatattggaaagtaaatggaacattaaactttgatgtcctatgattaatattgttatggcaaacatactataagtttaggagtcagactgccatttttttatgaatgttaatagttattttataggaaatgtaacctttttggttagactcttgaaaataagattagtattattgctagctctatttcaggaagatttatcaaacatttagaaaaataaacacagttgattttcattattctcggtggtgttatgttccataaagttgtcaaacaccgaattagcgaatactgaaccattactcctaggggaaataaaagattatctttttttgatcttctagttaattatgtaaattaatacataaccattttatgtttctgttgaaaaacatcttctcagtgtatattgttgattcattaacatttaactcgtggccaacagcactataaccatgcctgaaggaagctcatctaaacatgtattttatcagtaaagcatgtcacagccttcttgcacttagaaacactagatagcactttagcattatgttggggaccatttcaaacaatgaaattactaacaaaaagcacaaaaatgcaaaaagcatggtactaagtaggctgcaaaaaaaaacaaaaaacaaaaaaaaaaccccacaggtttacagaaagagagctgaaacagaagacagagtgctgccttgttcaacctcagctgggactcaaatttttctccactctgcgcattgtctgtaaatgactgcaaaagcccctagtattgatttttggcttacaaataccagatgtccttcaacttacaatggggctatgtcctgataagcactactggaagtcaaaaatacagttaatgctggtaataaaccagatagtccccgaccaacagtggttccacttaatgttttttacgatggtgagaaagcaatatacatttagtagaaatcacatgcattcagtagaaaccataaccccgacatgagtaagttgtgaggagttccttgacttacagtggggccgcgccccaataaacccatcctaacatctgaaaatcattaagtagaaacatcaggaaccatctttatatttttaggagtaggtgaattcacagacacaaaatccccaaataatgagaattgactgtatgctgaatagtgagaaaatgatttggattaagttagtattttagttgttaaaatttgatttagttacttttatcttgaatttcttaatctttcatagtaaatagaacatcctctacttttgtcttctgatttctcaaacaatgtatattgccacaaaaactccattatcaatgatatttgttacaaatacttaaaattaatgctttcacctttcatttgataataaggagtttgctacttaaaggaatcatgaattgctttgtggcacaagaagacagaggaattcggccagtgtgaggcatcccttactttctttaacacagccgcctgatagaacagtagccatgctctttaagtaactctactctgacaacctcgaaggatttctgggcataaaaattgggggcatccaatatagcaaaggggttgagagcatggactctatcttggtaccatcacttaccagatgtgtggctttaggttcattacttaaattctttgtgtgttaatttttaaatgacgatgataaaatatctacctgataattttggtgtgagaattaaatgaattgatacatggaaagttcataaactggtgccctccacgtaagttcgtgctagataaatgttagctataatcattactactattattattatccttaatttaagtagactctttatttctccctactccttactgtcacaagtgataaagcaatgggaatacctgtgttttatatttcttttgcatttgtaacctctcccagtactcatgtttgttactaatatggttagtcatttttctcctattgatactgtcgttgtaggtcaggtaaacatgtatgttcagtccttcactatgagtgagccaaaagttcatatgaagacttcagcattgagtccccaaaggattttttagaaagttcattaatatcttcatttgtcttcttccaagatgagcctcttgactgactcttctcagaaaatgattgacactttatgtgagagtaaaacttaaagtgagctatgaattaatgttaaaaccagattacgaaaaagtaagacttcatcctacgattctaccatcctattatccactcaccttgtacaaaaacaaaatccagaaacattttcaaaaaggaaggaaaattcagtcaagtattttggaaactgagttccagtcatcatggagtaaacaagcaataagcagattaggtagcgctgcaataaattaaaattgtaacagagctataaattagattctgaatgttttctaaatttattttcaaacttgacttttaatatatgtgattattaagatgtaatggtgatgtgctatgtagatatgaatctgttacagtaatctatttttctcttaacattttattatgaaaatgtgtaaacatacaataaagctgaaaattttagtgactacttatatgctcatcatctagattctatccttgagtaatctatttttataaaggtattgatgtaactattttataaatgaaaaactacacactaaaaaccaaatatgtgatctccagcatcacagaaatgaaataaggatttttttttaacttaggtaatattgcttgaactgtagtaattcaaatgtagcaatttcaaaggtagaatttcccatgtattactatactgcttcacatcagctctattaataaaagtagaacagttgcaaaggaacttttatgatctgttttgacaggacagacaatttaaaaagttgttaataaaggtttttagaattcactataagcctttcatgtggctttagttagccacatggagatacgttctgggacgaaagttggaagtattctcaagaagtaaaaaataccaaataatttataggggcacgagtggtttgaagtactgtttaggattagagtgggtcttggcatttgtccagaaaccagactactttgcacaattatacttgaattcctaatcatatccactagcctactctcttaaatagaccacagaaaccttgctcttaacatttaagacaatggagtgtcttgctttctagaaatgcttttatttttattaccactatgcaaataaatgtaattttcacagtgtcataacattgattttgtcattgaagatattatctattttttccctgacagtttatgttaaaatacatttagctttgttaggtaagagaactttgatacttccttttcctctttattgtgtatacaggtatatttgggatatatggcatttaagggtattcttttagaagacttgtctaagttgttaatagttgtaaaataccacatattaattttttttctacatttaaatgaccatcgtcctgtgttactggacttgtctcagaaatgagggaaatatagggccattattaattttgtatttgaatcatatcattggctattaataatcttctacagtcacatctacatatattagcagtgaagaatcatttcagtgacaatttgttagtcttcaaagagaaaaaagaaaaatctgagtttcataccaagtcttctataagaacaattctaatgtcaatgtagagccctttcttttttgtttttaaaactctctaagatagctctactttatatggaaacaaattttctaaagagcaggcaatggatttatggaaatttgcacataaacgtgtaatcacattttgtctaaaaactgtaaaaatattttaacgtcattcaaaacatacgttaaatgttgagtaataccaagaagcaatttgatctcatttgcagggtcaacagagcagttaatacaatgacagtagatttggggaggcttttgcgtagaatcaaatctgttgggataatgaatacttaaatagttttaaacagcaggaaaagatgaaaaaacacactgaaaccctttggaggattaagttaaattttgaaaataatgattgaagctaatactttagatattctcatagaaacagaaaaaccagttgtttagtatagcaaatatagattacatattctgtagattgtcatggcatttttttgtaatctgattttttttttcaatttcagaagataatgaataaaccctaggtaactctttcatttccattcccttaacaaataactgcagtctctcatagaccattttgattcctgctggtttctctatcttgtttgtctgaaggtagagcagagacacctctgtgtattgtattttctgtcagctagttcttagatctttcaactatttttttttttttttaaatccttgatacatgctttccaaaggctgaggaaacagaaagtgagagaggggtgaaagctgtatataatggggattatctggagattagttaaagtttcactaatgccattaatttaaatatttgactccggccctttcgtgtatgagatttgttccgccattacttcaggtagatttcattacctcgactggactgcctaaatacaacttttgtgtcagtcaatatggttatacttatacttaatttacacatgctaatggcaatattagatctattgaacagatatcatcagtaaacagttaatgattgatattcaggtccaactttgattattgatcatataatattttgtgtaatttctgtggttattataaatatatgattgataaccagttattcaggcaatttgcatttataattttttatgtagattttactaatcagctagaaatatctcttcatgaaggtaattattagtaaaaaaatttgtgcagagaattgcgcagagtatcttaactttattctaacttatcctactactaggaatgttcttaataatctttattaaaaacttagtttcttagattgtctgtacctgtgttaaaatgtggtctacagccatttaaataaaaggtctctattttatgacttatgtgaatttcggatttgtaacgtatatatgtatgtatatttatgtttgtgcatttgtgcataagttaaatctttgactaaaagatggacctcaacaagtgtgggaaagtgttatagttacaatatcctgctttttgcttttctgtataagagacttggtagctgcatcatatatcatggtcatccaaacctcttgttttaaatgagagacatagttaatcataattaaaaatgctaaataaatttgaaataggaactatttgacccattaaataaaaagatcccaggaattcttagatgtaaagttatctaattcttgagatttaacttaaaaatataagtatttatttatgggtagttttaaatttgtctttcaagcattatggagattagaaattttgtgtgctttttttaaatttgaaggtccttaataaaacagtatgtaattgtgagaagcaagagtgctgcagcatgttgtgtcttttaaatatctttgagagtaacagaaaagcccaaattctctcctagtgtcgtttttaaaatcaagtattgaaactgaatatagttcagctaagctttctttgctgtcactcttaacattgccataactctactttcctagtcatttgattgtacagaaaaaagtaaattcttttactatgtaagtatacccttatcatcaatcatgtactgcataatgcatagaaaagaatacatgtaacattttttgaagcataacagtaacacaatactgatgatttctcacccagcttaaaaactagatggtatcattgaatctctatatgttgtctgtccctattcagtcactctatttcccttcacccagatgtgatcattattctaagatgttttcattcatttccttacttcttataaaaataatggtttctgaatgtattactaaacggcatatattgtttaattttgagcactatacattacataatgtaattacctattaatgtaattattataatgtaattatacttttttctcttaaatcttgttttaagatttatttgagtcttggcatgtagctatagttaaatttcatgctgtatacgattttattacgtggatatacttgtattcattgtagtagggtatattgggtgttccatgtttattttgttttttgtcactatgaacaatcgtactgtgaagattactgaacatgtgttctagtaatatgtgagtaaattctttcattgtatatctaagagtggaataggtgagtctcacagagaacgtgcatattcaaccatgcaagataatgccaaattggtgatacactgatacacatttccaccagcaaagtgcaatagttctctttgcgctgcaggtttatcaactctgacaatcttcagacttcttgatttttcctaatctatgggtataaaaatagtatttcatcatggttttaatttgcatttcctaataatgaggttgaacaatttttttatgtttatcttccattctcatttctgtgaaatgccttttttttgttatttgtccccctgcccccaattttgttttattaggggttcttatgtattgtggatacagatgccttttgtacatatatgttgcaaaaatcttctctctgttaatgacttggttcttttatggtatattagtgaaaagaactgaatttaaatggtagttaaatttatcagtctcttatatgattagcactttttgtgtcatggttaagaaattactttctgtcccaaggtctcgaggatatctttatttttttttcaaaggcttgcccttagtgttccaaatttatttggaattgattctttgaaaagggtaaggtagtagtccaatttcatttttctccatatggataactatttgttttagtaactttattgaatagtccagtggctagagtgccatctgtcatttcatgattctttttttgcctagttctgtgttgggctcttccattctattcatcaagttgtctatctctgcacaaatagtacatgatatagttttaattactataattctaatgagtcttgatatctagtaggacaagtatctgtattttcattaggagctgcctgacgcattcatataaaatgagaatcagcttatcaaattccttggaaaagtattcttgtggttttaattagaattttattgaatttgagaaattagaagtagaattcttaaaaatgttgaattttctttttcataaacatactgtatcaccctcatttatttaggatttctttaattctgattttgctttgtaattttctgtattcaagtattgtacatcttttgctaaatttatttctaggagtttaatatttttgatgcttttgtaagttttatctaaaaacttgttttttatctagcaaccttgtataaatgttctttttaattctaataatttgcttatacattacattctttgatttttatctgtagacaatcttttttttttttttttttttaagttctgtttcttactttactgtctaggacaaccaagtcataattgagcttcttttcttgttccatgttttaaatggagcggtataaacttgtcatctttaatattgatgtttggcgtgggtgtttgaaaaggtattctttatcaattaattcggtcccttttttttttttttttgagacggagtctctctctgtcgccaggtgggggtgcagtggtgcagtctcggctcattgcaacctctgcctccagggttcaagtgattccccttcctcagcctcccgagctgggactacaggcgcccgccaccatgcctggctaatttttgtatttttagtagagaccaggtttcatcatgttggccaggattttcttgattccttgacctcatgatccacctgcttcggcctcccaaagtgctgcgattacaggtgtgagccaccacacctggctcctctatttttccatgaaagtattttggttgtctttggtggtggtggtggtggccttatgtaaactcttcattgggcattaaattttaatgaatactttatctactaaagtaataatcatatggttttgctttaatctattaatatgataaattgaatatgtatatttttcttttgtatttatttatttatttattttttgagacggagtcttgctctgtcgcccaggctggagtgcagtggcacgatctcatctcagaatgtgtatatttttctaatgtcagactaactttgcatttccaatttggcaatatatattatcttttttcaatatgaacagtcttggatatgatttgttactaagagtcttacatgtgtgttcatgatttgagattggcttctttttttcttacacctaattagcctgtttttaatactggcctcagagaaaaaaaattatttttttattttttatttttgattctcagaagcgttttaagagtggaatgatctcacttgaaatttgatagaagtctcctgtaaaactatgtggacctggtggttttgtatttgggataaggtggggaaaaggtggaaattaactacaagtcccatctctatattgtataaccagtattcacttagtctgttctttttagtaggttgaatttttctaggaattagagcatttatttttttcatgtctgttatttctgtcttctctctgtcttgtcacaaggtttctatgttttattagtcttgacccaaaaatttaaaaaaaattttagtttttattgacactattttgtgtttgtgttgtgtttcactagtttatactattacgtttgttaccttttctatttacttgagctaattttgctgttctttttgtaattttttagattgggttcttaatttttagcttttcttctgtaatacaaacattaaagctgtacatttacctctaagtactgatttttgtggcctctcatactatttttttaaaaaatttgttaaaaattgcttttggacctaatgtattgttagattttatacatatgtccagtgtgcttgagaaaaatatctcttctctgattgttacatatagggtttgctatgttttcattaaatcatgttcatttattatgtggttcagatattctgtatcttcattttttccctctggttgtcaaaaacaagatacgtagaaatgtgtttgctgtattactttttatttatatattgctgtataatctttgctgtattactataccttgaggctattttattatgtagagcaagcttacaatgtttcagtagcatatatttttaccgtttttgtttttttgtcattttaaagtaccacattactctgtgtgtttttatttatttagtctgacagtcttttaagagtttggtttgtttgtattcattatgataggggtttgttactaccatttacttaacgactactttctgtttttctctttctgcgcccctcctccttgccttgcctttttgattgattgaggactgtttgcttattagttttggtgttttgttttgttttgctcataattccattccttctttacacccatttttggaggctatacactatttctgtatccttagtggttctgaaactttactgtgcttacttaaaaagaagtcgtaagttaataatcttaactcattctagtataagacaatgattgtgaaacagtttaattttaatcagctcctttcctgattaaatgtttccagactagtgacttttaaaatgccagttgcttctgtttaactcaaaagtttgtccggctcacaaatgccattttggaaatgccatgtagcctgttcttacaatctaagagtattctgcaatggaaaaccagcttcagggaggtgctccattaggaaaatctagaaaccaaaaactgtggataatcactttgctgaggttttcattccctgaagaagcaaaagttgctagtctccctttgaacaaattttatgcctagcttttcttgggtttagagggcaaaattaactttttttgttgaagtagtgtgttatgaaggctaaagcgaacatcattatttcaaaggaaaagtaaaatagaatatggtcttactcacctggtagcaattgcataaaataacgtgtatccaacattaatttttaatcggtaatatttttttcctctggagagccagcttctgctatctgataaaaaatatatattatccttttatatacatgggttacaaaaaagtcatttgactaacttattcaaatggcccctatttaacgaacctctgtagtagatagcgtggataagataatgaagtttcaaagaaacatttgagtcatttagtatttttcaatatctttatatcttaggactttctcatttgtcagtgtctcatttgacccatttctttattcttattctttattcttaactccagattttttaacttgatatttattttcttctaagaaaaatttaccatctctttgaaacactgtaatttggacatgcaaagaaaacaaagttgcaaaaatgtaattattaaatatgcctccttattcccaactgattcagaaccactgcaatttttgggcaagcgctttaatttaggattatcaaacactgtctcagcccaaaatctccttaagctgataagcaacttcagcaaagtctcaggatacaaaatcaatgtgcaaaaatcacaagcattcttaaacaccaataacagacgcagagccaaatcatgagtgaactcccattcacaattgcttcaaagagaataaaatacctaggaatccaacttacaagggatatgaaggacctcttcaaggagaactacaaaccactgctcaacgaaataaaagaggacacaaacaaatggaagaacattccatgctcatggataggaagaatcaatattgtaaaaacggccatactgcccaaggtaatttatagattcaatgccatccccatcaaggtaccaacgactttcttcacagaattggaaacaactactttaaagttcatatggcaccaaaaaagagcccgcattgccaagacaatcctaagccaaaagagcaaagctggaggcatcacgctacctgacttcaaactatactacaaggctacagtaaccaaaacagcagggtactggtaccaaaacggagatatagaccaatggaacagaacagagccttcagaaataataccacacatctacaactatctgatctttgacaaacctgacaaaaacaagaaatggggaaaggatttcctatttaataaatggtgctgggaaaagtggctagccatatgtagaaagctgaaactggatcccttccttacaccttatacaaaaattaattcaagatggattaaagacttaaatattagacctaaaaccataaaaaccctagaagaaaacctaggcaataccatttaggacataggcatgggcaaagacttcatgtctaaaacaccaaaagcaatggcaacaaaagccaaaatagacaaatgggatctcattaaactaaagagcttctgcacagcaaaagaaactaccatcagagtgaacaggcaacctacagaatgggagaaaatttttgcaagctacccatctgacaaagggctaatacccagaatctacaaagaactcaaacaaatttagaagaaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggacgtggagaaataggaacacttttacactgttggtgggactgtaaactagttcaaccattgtggaagacagtgtggcaatttctcaaggatcttgaactagaaataccatttgacccaccaatcccattactgggtatatacccaaaggattataaatcatgctgctataaagacacatacacatgtatgtttattgtggcagtattcacagtagcaaagacttggaaccaacccaaatgtccatcaatgatagactggattaagaaaatgtggcacatatacaccatggaatactgtgcagccataagaaaggatgagttcatgtcctttgtagggacatggatgaagctggaaaccatcattctcagcaaactgttgcaagaacagaaaaccaaacaccacaggttctcactcataggtgggaattgaacaatgagaacacttggacacaggaaggggaacatcacacaccgggacctaccgtggggtggggggagcggggagagatagcattaggagatacacctaatgtaaatgacaagttaatgggtgcagcacaccaacatggcacatgtatacatatgtaacgaacctgcacgttgtgcacatgtaccctagaacttaaagtataataaaaaaaattaaaaagaaatttcctggaactagcatgtcagaataccattttatgtccagcttaaagtttagtgtgaaccttgaattttatttcatttctatttatattcaggtttctaaagaacaagtttccatgaacaaatgtggctttcaacaggtgaaatgatttgagtaatagaaaaaaattagaatttgaaaaatttgaagaatttaaaaagttaacatatttgaagaatatgaaatactaacattagggaagattagtttgatacttttaatttaggaactattagagaaaggggaaagacaactaatattttaggtgattctatttagataaatggcaaaatccgccttggaaaagctacataataaatatacaagtcatttgtaaactattcggatcacttaggtgctttatggttagtattcatattttaaaattaatgtacattacagcaaaataactgttttgttttaatatttatatgcattctatataagggataaccttttgaattgtaaaaagtgaaacctacaaagtaaaacctacacctattatactatgatttgcatgatgtaaggctataaatgtatattcctttttctgaactattctttcaagggttgcagtagtactgtcagctgctgatttttctttttgaacttaaacacagcttttgtcattgtcatggaaatgttaccatgttctttattttaaaatgtatttataaaaaatatgaattactttttaaatagtaataactactcttactagtgatatatattactttcagtagatgtattatatattactcttagtaatattatatatgtatactttaataaacatgtaaaaagcatgcaatgctaagctcattagtaatatattagtaatgatacatagcaagcttgttcaacccatgacccgtgggtcacatgcgtcccaggacgtttttctagcccaacacaaattcgaaaacttccttgaaacattattagattttttttgcaattttttttaagctcatcgggtgtcattaatgttagtgtattttatatgtgacccaagacaattctttttttagtgtggacacccctgatatatagttgtacttgattgttcccaagggtttttaccacaggaacagaggaaggtcacataataggtaatataagctgatgatgaattttactcataatttaatggccagctgtctcagaatttaagatttattttgtttggtgttgaactctataggtataaagtaagcctccaatgtggtaagtgatgtcagtacagtgcattcttcaaacagtaaagtcaatcctgatttcttgagtggtatgtttgaaataccaaattccttattgaaatggacagaatgaaggacttggctcacagcaggcaacaggcaacatcttgtacattctaatttttgcaaagaaagaacgaagttggaggactcatactacttgattctgacgtactaggtaaacatagagtaatcaaaatagtgtggtattggcatgggttgggcatatagatcagtgaaacagaataaggagcccagaagtagatccacacataaatggtcagttgattttcagcagaaatgccaaggtaattcagtagggaaaggatttcgacataaagtgttagaataactgagtatctatacacaaaatacagcaggtccttgaataatggttcattcaacattgtattgtacttacaacgttcatgaggaaaaaacctgattcctggcaggggccattgtgtggagtttgcatcttctcccgtgtctgtgtgggctttctccgtgtattctggttccctcctaaatttcagagatgtgcatgttaagtgaattggtgtgcctaaattgtccccacctgagtgagtgagggggtgtgggggttatgtgaaagtgtgcccagtgatgcaggagcatcctgtccagggatggttcacaccctgtgccctgggctgctggaactcttcagccaccctctaccctgaactggaataagtgggtaaacaatactctaacttgttttttattaacttttcttaactgtatgtatagctcacatttatttcaatgcttgatattagaaatattttggtctttatttagtaaattttggtgatgttgtgaccagaaatatgacataggaacttaaatcttgtttatgtcaattagcctgtggttaaattggtttcagtatatgtcatttcacataaagttgcagtttccaagaacctatccacaacattaagcgaagacttactgtattgaaccttgattgtgacctcacatcatccatagttatgcattgtataatgacattttgatgaacaacagtcctcatatataatggtggttccagaagattatgatagagctgaaaaattcctgtcacctaattgaggttgtagtcatcgtagcatcgtcagacagtgcattactcacatgtttgtggtgatgctggtggaaacaaacttgtgctgccagcaaatataattatatgtagtacatacttgataataaacaactgtgttcctggtttatgtatttactgtactttttattgttattttagagtgtactccttatttttttaaagttaactctaaaacagcctcaggcagttctttcaggaggtattgcaggagaaggcattgttataggagatgacagctctatgtgtatgttattgctcatgaggaccctacagtggaacaggatgtggcggtggaagacagtagtgatatatatgctcctgagcctgtgtgagcctaggctaatgtgtatgtttgtgtcttagtttttacaaaaaaagtttaaaaaattaaataaaataacttttaaaaataaaaaagcttatagacaaatacaaaggaaaatatttttgtacagctatacactgtgtttgtgttttaagctcagtgttactacagaagaatcagaaagttaaaaaaaaattttaagttgacatagtaaaaaagttacagccaggctcacacctgtaatgccagcacttttaggaggttaaggggggaggattatttgaggccagaagtttgaggccagcctgggcaatatagcaagacaccatctctacaaaaaatttaaaaattagcgggcatggtggcatatgcctgtagtcccaggtgcttgggaggctgaggtgggaggaccacttgagcccaggagttcaagattgcagtgaactatgatcataccactgcactctggtctgagtgacaaagtcagatcttgtctctaagcacaaaataaaagttatagtaagctaaagttaatttattattgtggaagaaaagtatttttgtataaatttagtatagcctaagtgtttataaagcctgcagtagtgcacagatacatcctacgccttcactactcacccctgactcacccagaccaacttccagtcctgaaagctccattgtggtaagtgcccaatacaagtgtaccactttttatcttttatatcatttttactgtacctttcctgtgtgtttagatacacaaatcacattgttttacagttgcctacagtattctatataataacatactgtgtgagtttgtagcctgggagcaataggctataccatataacctaagtgtgtagtaggctgtaccatctagctttgtgtaaatacgctatgatgtttgaaaaatgacaaaatccccgaatgacacatttctgaggtcatattcttgttgttaaacattaagtgacacatgaccatacaaaaattaattcaaaatgggtcattgacctaaatgtaggagctaaagctataacttctagaatataatgtaagagcaaaattttatgcccttggattaagtaaaaatctcttaggacaaaagcaagaaataaaataattggcaggtggaacttaaagtaaaagacactgttgagaagatgaaaaggcaaatcacagaaagggagaaaataatttgaaaacctctgtctgataaaagacttgtatccagaacatgcaagtcttaacatacaagtcttatatcttaatagacaaaccaatttaaaatggacaaaagatttgaatagagatgttactgatgaagctgtatgaataacagtggtgcttacacatcattagtcgttagaaaaatgcaaattaaaaccacgatgaaatacaactacatactgactagaatggttaaaataattataaaaaaacaggatgaggaaggatgtgtagccgttgaaactctcatacattaccattgagaaggcaaaatggtatggccacttgggataacagttttggggtttcttactataaacatacacttactaccatgtgactcagtgttactggttaaattacatcctccaaaatggtatgtttaagtcctaacctccagtacctcagaatgtgacctttttttttttttttttttttttttggaaatagggtcattgcagtggaacgaggaaacatttttggggtggtggatatgctctatatcatggttgtagtgatgttacaggactatacatttgtcaaaacttagcagtgtttatttcaaaatggtgaataaattttataaataaatttatacttcaaagctgattaaaaacatttgaaaaatacaataaatggctacattgaaaatgtaatgaatatacttttagttcaaaaagtgggtgcagacgagcattctggctcctggagcggctgggagggcgacttataactagaatgcctgtggtcgaatgtaaaaacattgtcttaagagtgtacagggactggtgtggtggctcacgcctgtaatcccagcactttgggatttcgaggtgggcagattgcttgaactcaggagtttgagaccatcctgagcaacatggcgagactcccatctctacaaaaaaacaagtgtacaaatgctaattttggctatgataaaatttctaatagtgtcacttgcaaagtcgaaaaattcatctcaataattttataatgacaaagacactgatgtctaggagttaaataaaattttcgtaaaatgtcatcccgtggtatccttgggggattggttctgggacttccacagataccaaaattctcaaaatactcaagttccttatataaaatggcatactatttgcatataacctatgtatatcttctggtatactttgattacttataataccaaatacaatataaataatagttgttaaactgtattggctttttatttgtgtgatttcttattagtttttttctgcatattttctgtttgtggttggttgaatctgtgtatgtagaacccatgggtacagagggctgactgtatttataatttaccacatggggtgatttttaatatctgtagctaataattattttaagtggccatttgactgtttccttgacattcctaaaaatttatatacttaaattggggaggaaaatatgtttgcgttcttcttagtggataaatggaagattgcgttatagtcatatattcatagagctttctgatatacccagttaagcaattttgatacatccttcttcgtccttccacgggacattgacctgtctctagttctgcacatgttacactgtattgcatttagccttttcataacaataaattcaattagatgtcatttatttcttttatccctactacagtgcctggcttatgatgtacataaaataaatattagtggataggaaaatttttttataaagaatcaattttttgccacagtgcattttttcatggttgacatttattcaagaagcatttattgagcaactcttatgtggaaagcattatactggctgctttgagatatataaaagaactataacatctaaacatttaatgttagaatgaaatgtaatttctatttagtataaggtatactacaaattataggatgaaggtgggtaatcactagaggtttcagatggatcataggtaaaaaatactggaaaaacagtttagtctgatgacaaaggaaatcactttttagtagctatggtattcaaaataatcatagtttaaaatgtcatttaacagtttctggaatttttataaaatcattctccttgctgtcatattgttagatccagagagttagactgtgcagtaaatgagctatttttttaccttagaaaagcagaagacttgaattttcataagtagactcttagaggttccttctgatgcttcagcacatttccttttctccaaagaaatgcttcagggccgagtgcagtggctgacgcctgtaatcccagcactttgggagacccaggcgggcgaatcacgaggtcaggagatcaaaaccatcctggccagcatgatgaaacccagtctctaccaaaaataaaaaaattagacgggtgtggcagcacgtgcctgtagtcccagctacttgggtggctgaggcaggagaattgcttgaacccgggaggcagaggctgcagtgagccgagatcatgccactaacgacagagcaagactccgtctcaaaaaaaaaaaaaaaaaaagatagattttttttttcttcatatagagtgtcaaatagcgcttgaaccaaagccctttacctctcctcataggggcattgaacagtaatagaagcttagaacatactactttttatatagatgtcagtatagatctattttaattgttaaaatggatgtcagggttttctgtgagcagtgtgcaacataaggaatttttttttttgagatggagtctctctccgtcgcccaggctagattgtagtggcacaaccggctcactgcaacctctgcctcccaggtccaagcaattctcctgcctcagcctccccagtagctgggattacagcacgcaccaccatgccaggctaatttttgtatttttagtggagacagggtttcaccatgttggccaggctggtctcgaactcctgaccttatgatccgcctgcctcagcctcccagagtgctgggattgattacaggtgtgatgttgcacactgctcacaaaaactgtggtaagctcttttcaaataagaattatatttttggccagtgctttcactaggtgaattgaatgacaaccaaaccactgtcaggaggcagcgtggtctggaagagcagtggagtgtgagtcaaaacacctcatccttgccatcacaaagtgtggagagtcatctcagcagaccttagtactgttgactataaacattattgtgatatacctaccctaatttagactggaaagcaagtgtaaatgaggatataattgtggagccttctgcatttgtcaaaactaagaaattaatattggtaacttaatattaactaaactcctggctttataccagtttttccactaatgtcctttttgtttcaggatatcacattgcatttaattgtcacatctcttaagtctaccctatccccatcagtcattctaagctttccagatgtttgaaaattaatgtttgccttgtcttaggaatcagagaatatgtgctgagcattgctcagtctttccttgttaattcaagggtattgtgaagcatcagttaatattctgtgccttcagaggctgtttacatgtttaaagttttctgactttaagtggctgtgctcttctggttagccccccatcagtgtgacctaatcaaaaagccaaacagcaatctgtactagagttcaaaaagagggagaagtcccttttggaattagggaagtccttctatttattaattgaattcagataaagaatattgaaagaggcagtagtcatcagggaggtaggaagaaatggcatgagcaaagtcctgagaagttttctaaggatgctggtgaaagagtgccaaactggaagtcatggaacaggttagaattcaggttctgccacgtattagctctggagccttgagcaagcacctgacctcagtttcctcatttgtaagactagggacccatactaaatgatatctaaagacctttcaattctgaacatccataattgagtcccaggccaaatgtgctaagtatctgggttggaagtagtgataaagaaaattacataatagtaggagctgtcagcttcactataaccccaaaggcaggtgccatcacatacagatggagaaaaattgagtaatttgcacaacgtcacacatctggtaaatgcaaccagatttttagatcttgtgtgatttccaagccttttcaatacagtttactgcttcctcttttattgttacaagaaagattgttcagaagaactttcaggatgtctggtgagcaaggaagcttaaaagtcaagtcttatgcctgcacaactagaaaaataaatgaaagtgccatttaaaaaattgttttaaataaaagtatataacaggttgagcatctctgatctgaaatctgaaatgctccaagacgtgaaactttttgagttccaacatgatgctacgagttaacctgaacacattttttcattgtatccatggtatgttctatttttttactaaatacttacatgtgaataaatataagaaaatgaatgcttactagtagcatataaattcaagagtaaggaatgatggtgatgccagtcaaccagattgtccacatgagtggctgagatacagtgctttctgatggcttagtgtgttcaaatctgtttcatgcacaaaattatttaaaatattgtataaaattactttcaggcttagtgtataagatgtacatgaaacataaatgagttttgtgtttagactttggtctcatccccagtatatctcattatgtatatgcaaatcttccaaaatccaaaaatataaaaaaagttaacacttctggtcctaagcattttggatgagggatacttaacctgaattattgtataatatttgataagacaaaaacacaagaaagtaaaatataataattaacgataatcaccatagacataatcaatgttatttccacccatcctcttttaaaatacacatactgtatacacatatacaaattgtttacacaatatgattactggtgtgtatgtatagttttgtgatctactcttctttcttaatctgtcatgaatatttctccatgtcattaaacagtcttcaaaatcttcaatttttttcagtgcctacatcatgattgattgaaaaccgtaagtgatttaaccgttatttcgttggacatttaagttattttgagtttcactattgttattttgctttgagccttcttttacaaaaacttttattcacgtctctgttttttgtcctaggatagcttcttggatgtgggattacttaatcaaatgactcttgatacatgtggctaagaatctttaaaaggctgtatttctcctccgatctagtggtatttgagcataactgtccctccacatttttcccaagtactacaatttctggtctttggtagggccaggttttgtgttaaagattatttttattttgttgagtttgagatgacggttggtcagaaaaagtataatgttcaataagtactgaaaaagtgaatagtgcaaaatatacagtgctacaactaaaaatttagaaactgactatatgtaatttatataaaataggatgaaatctctaagcgataaatatatatagtttgtattatctatggcactatgtatggcaagaaggatgccaaatatcacttcagggcaaacccagatcataagggatagaagtggaaaaaaagaatctttagtggcaatagagaatactagaggtgacagatagaatgcaggtttactttaataggagattgtgttttctataaggctttatcctaaggaagattcagttttaatttactgtgtagaaactactttttgtaatttcaagatttgtgacataattccactattatgctgatataattttttatgtcactagattagtgtattgatcttcttaatgcatcttttgttgttttgtatgcttatagatggtaacataattcctaaagtccctgtgaatggttcttacattaatcactatgttaaaagtcttaattgctcactagtttctgatttagcttactgtactctccagtaattgttcagttctaagaatattttatggcatagtagttatataatgtcagtggtgcactggttaatgttctagaattaataatacattttctcttttcatattatgtagaattttctaaatgttagaatttaaagtcagagaacttactaagtgtttacataggacactaaaataagattttaccttcctctagtagtataccttgtgtttatgcttttacgtctgctgctttataagcagaaagagagggagggaaatggcaagaaagcatacagcaggaagagctgagaatcttaaactgtcataatctactttttaaagacaaatgtgtaagcaaaattacttgtgctgtgtatgagtaagaaggttgtagagacgttttctcatttgatcaattttaaaaagctgttatattatgctgattattgttacagctttttgaggtggtgatagggaagttttccaaggaggctggcatgcccctggctgagcccagcaaagctgcattacctcaataaattcaccacaatctaaagatgttaatgagttttggcaaaagttataatagcttcttacatctttctgcacaataggagtaacagttagagagcccaggcaattatgtcacatctgaggattggaatactttcttgttttcattctttttttccccattctttctgcatatctgctctccccgtctccagttgttttgaatcatggctgagcattttatcacctgatgagtttttaaagctctgtaagctcagaccaagccccagactaatacatcagaatctctaggggtgggacctggtattgggtaagtttttaaactccacaggtgattacatttggcagccaaggttgggacccatggtttcagatgtagtaaccacatcaattaacttagtacctcttaagaaggttgcttattagaataacctgggagattttctccacactgttccctcccttccacttcccttattaatttagtgagccagtgttaactgatgggaatatacacatacccttggatatgttgggacagaaaaaaaaaagacaacaatcaatttgttaagtactatttttcctacactctttttggaatatagtctgcttatataagtgactttgtatctatccagcattattttatgtggataattttgtgttgttcagtatttgcataatcactgtgagggcaaggaccttgtatgttcttctgttcatcactgtattttcagtacccactagtgcctggcacatggtagataatcagtaaatgttagaagagtgaatcagtaacactgagtaccccacataagtgccagctatagtatgaagctttgtaattacattgtccaccaaggaaaaagatcttccataaagccacagataagcaggaaatagatttattgaattttgagtctttcgcaggtcagggattccgtgtaggcattaaggttctgaacaaaaatgtagcacaaaacacaaatacttgctagcagaagatacatttccatacctgccctcgtatatcaaactgcaaaacatacagaaaaaaactaatggacaaacaggtgctgttagagtctgtgtttagtttaagcctcatgataaactgggctagagcttgacacatttatcaactgttagttgtattttacctaatcatagcctgtcttaaaggcagaaaatgaaaacaagatgatctgtcacatatggttaagttgtaattcagatttacaatatattggcgaaatggcttcagttttggatgagcccttaaactgtacagtgtgcaaagaatgggggagggaagagacctaagaagggttaagtaatcttagccaagatttctaaaagctcttattaatctgatttttcagaattagaaaatctctgttgtcagagttctccagtttggggtttgataagaaagcatatcatagaaattactctgcctacctaaaatcctttatggtttagattttattctgtagtgcctttacagcactcttagtgcttcagccatagccccagttttgacttattgggcccctgtccctcttatttttcaaattaaaaattacacagaaaactattcagagtagaaagagtataagtgaaaactaggtttccttttcactacagagcaccacatcctttttagaggtaaccagtattagcatttccttctgtatttttacagaaagagttagttcatattgccagcatacacatgcaggtagtttttgtagtttattggcatgatcaccacatgactagatgacgtctttagtttctaacacacttttcaaacccagcttctttccatatctcttcatgtaattaatctctcctctgctttgtttccatttgcttttttgtccctctgttaaacacctgttagaggtctgacatgtattattgggacttaggtgtggtggtctcatctcaggtatcatctcgccttcttactctgtactctttacctagcctggctcatcccacctgcaggacattaaggacctgtgtatcaaggtctcacaaatttatatctataggaccaggcccctttatcttacttgtctgtctctttgacatacttatcttttggatatctcataaacttcttagtcccagtgtatccaaaaccaacttttttttcaacatccatatcttagttaatggcatatacattatctcagtcatagcagtctgaaaactataagctattctcgaaaccctccttttcctcacttgtcctatttcaaaacgtaagtctggttgatttttgttttgttttgtttttttcctcctaaataactctcaagtccctcttctttgtctctggtaccatattagtctagcctatcatcatctttcacccagattactgcagtggtccacccacagcccctccgggcctcctccagaccattttccacagagcagcctgaggaggccttgcaaaatgtccatattagtttaacactccccctttgttgcttaaaatcttttgatagctgcctatttcttttaatataaagacaagtctccttcatgtagtcttacaaggtcctgcctagacgtttgttacagcttccctcattaggtcgtttcattgtacttcccatgttctcttcccttctgccacattgtgcttccaggccctgctacttgttcctgatggcctcagggcattttcctatgctttgaagtcctctttcccagccctttcctttcagcttctactgataaacccccactggggtatttgaaataatcttttaaatattgcttcctctgactcttcccttatctctctaacatttccccggcattcaacaaggaataccttgcctttgtagcgttttctgttttatgtttttttgtgagtttatttgattaagatctatatcctcagcttggctgaaatctccattgtatatttagtttcttgtacagattcctagccccaaatcgtagacactcaataactccttaatgaatgaatgaatttgttttctttattgaatctaacaagtactgtattttgtatattgttaaagcttaaatactttttttgattcaaagtaaattcataggttcacaaggcacagtatggattaataagcaataccatttcctggttggttgttatagagattacataagaattcacacatttaccaaaacgaggtcattcttgggaagaggagtaggaagataaaatcatgggaaccactagcacatacctaggtctgcccttttagttagtagaattatttttctacgttatttccccagccactcctctcaccctaattgtctgtattatagctttccctaattgtgaactcctaattgctttcaacctaaataaatatgattctttctaaaacactcaggaataacaactgttcacttataaacagtttttgaagtttggaaagcaatatagaggtttggctttactttagaaaaatattacagaagctacctgtgttctccgcctacttcacacatgcccatttagcatttgatgtacttcatataattaaatttgttctgcatcctaaggattttcctgagccccagccgccttgataaggttgttaaaatgaacaactcattgctaagattaccttttctccctctcttgggcagtagaactcagctgagagaatagcggcaactaggagaagaaagggtgatgggttgagatttctggagatttcagctgagggagtaaagaagcttcagaggataaagatattctttatgtcaccattagcagagaagtcaaggatctgctggacagagcagctttttgagtgtaggtattttagctaagttggatattatacaccacaatgaatgtgaatataaaaaacaagggatttaagtgtgaaattgtgaccacagtattggctaaagacaatatacttatagatgttgatatttaatttcaccacacccacagtttatcctggcatcccagtgcctggtccatagtagttattcacaatgttgtttaactgactggacttggatgtgtgtttgtgtgtgttttttaaattatttcaccttgtgtatggttgtacttgtagaaatgttttcatctacatttatataagtgtacagtactttgcaataaaaatacctgtaccagaattcttctcttacaaagtgtttcttatgattatacacaatagacttgactgcgtttggatgatgactgtcataataggccttaagatagacaaagcacaagctttatagtaatagttttgaagaaagactatatggtaattactagatcaagaaagcattattgcattatctgtgcagatagaagcctttaggcagatgccatagtttttttacttcatcagtctttttatatgtacacctgactgccagaaatagttattaattcttcaatgaagatggttttgcagactgaatttatgtgtatgtatatagcacgcacacccagccattttatttttatgttcaatctaattcctttaaacaaaagactatgaaatactactacttttctgtaggccatgtgataaggttgttagggctggacagaaagaaaaaatatatttatttgccataccctgaatatatgaaatgaagactagatttcaaaaatcttactttcaggcatcacagtaatttacaaaaaggccaataagttacacaagcatttgtagtaatttatgtaaaagatgtgaagctggtaagggatggttcaaaaacttacatatcagaatctgcttaatacaaattttaggaaaagaatccacttctttacaaggcaatactctgatcactatttcctgaacagttattgaaggtgtttcaagcaagagttacatactagtatagatttttaatgcaaatggccatatttgttttgaaggtgataccttgtgggttttcttcaactctttcaaaacttgaattttatatcattttgtttttcctcccatccccacatcctaagtgctaaaagactctaaaactcatcttgtcacctgctgttttgttcaacgggattctcttcagaaatataatcctaaagtttgggagggactcttagagtagacacttaagcagagatggaacaaagaattaataatccaaattatatgaagcatttaaaagtctgtagagtagaagccattacagaatcacctttagtacgtgattagatacctttatttctgaatctgtttacattttatttttggcaggagctgggtaattaaaaatatttgtatggatttattgctttcaaatttgtggtgaagacattttagaagagaatcttagctctgcatatacgaccctaggcaagtcacttaacctttctggctcggtttctcatctgtgaaattgtgataaaaatactcgaacaggattactactattgagttagatgtgatataaagcacctggcaaagagtgggcactccataaaatgttctttctttctttagttatgttaatagtaaaatagagctctggtgtgctttgaaacttccttctttcttgtttcaacgtacagtaataggtaagacttgagtaataatccagtaatcctttcatgtattctagcttgaacatttttttaaaggaaataaaactatatatagttgaagtttcttcgtactttcttcccagtctcattccttttccttccggcccagaggcaataactatcctgtatttttggtccatgatttctgcatgttttcatactttcacggtgtatgtatgcattcataaacaatatgtgggatcttttttatgtttttaaaacttgaataaatggtattaaattacatgtttaatccttcagcttaacttttttcactcagcattatttttgagagctatctcttgctgaaaaatataggtcattcattttaattgctgtataattatctatttccttattggtagacatagtggttttatgcagttttttcagtattttaaacaatgctaggttggatatcttctcatttttaatattcttcttagaactcaggtgtgcttactgagttgcagcttaatccctgaaatgtgcattactgacctacaaacgtttgtaatgaactgatttataatcttaattacctaactcattccagtcttttctaaagattggtctaatttaagggctcctctttctaatctctcctacccccattactcatactgagatgctaacttgatagcctcattgtgggaaaagtcgtatcaacattaggaacagttattgcttattttggtgatattaatagtgattgattttaattttcaatattatgcattttaagtataccaattctgaagtatacttttgcaatagaatatgtgtgcaaattcttaggactattaaaatacttagtccaacctaatggagtaaccttttgtatgtaatttctttttaaatatgtatttatagtgaatacatgagctagttttataattactattctctgtgttttctagactgcttttttatgcagtgtggcattgtacctaaaattttgtatctgtttttaagtcaaaaatacgttttccaaataaaattttgtatagagtctgaagacactggatacatttctgagtcactgaggtatttccatatagtttggcacaatgtaaaaattgtgtgatttaacttaattatgactgaatcattgtgaagtgtctccttttattagccatattattaatctgagtgaatcttatctagttgttaaggttgagaaaagaaaggtggctgacacacccacatcctataagaaaatgtaatacttaaattacaatcattaaggtgtaactaattctcccatttagttaggatgttggtgatgtcaagaattaattaaaatactttgcaggggtgtccaggggaaagaatacagtcgtaggttcttgaagtttctgtttctggttaggccagtaaagccccttcctcatcctctttttctcttatcactagagacagaaactaaaacccatggctttaggctgttaaaagcataaaacaaaacagcacaacagcagcagcaaaataaggcaggttggacaagtttgctagagtctgtgtgacatttaaatatcttcgttaacccagctgtttaaggtatatgctcattgcttttcagaaattttgaattttaaaaatatctgaaaatggttgagtgctgaaagttaacagtgcaggcagttatcattgagaacacctgactttcacacattttaacaccactaacattggctagtcctttttattgtctagcaatagcccagaaatactcctttcctgtttacctcccagtttgtagtttctaatcatatcaagacctagtttttaatcacttttgctgaaaggtctacccactcttaaggccagggtagactccttgttttattttctttgttctgcttcttctgcctctgctgttccaggagtcttccattttcctatctgctgtgaaatgcttgctggtcacttttctaccttggttttcttttatccttacctcccttctatctggctgattggtgggctttccatgtgcctctctgtgcacaggacacctcgccatcacttttacaatgctgttccctcttagtcatttcttagtcgtttcaccaccctttaagtttccaggaataatctttttcttttcctctcgttctttgtgaccagaatttccttatttttacatctcttttctccttggtttataaagatatgtttgaaagagtaggaaaagatcagaggccagagtgaatacctgccaactacatgaactttgagagccagagtggtcaattcgaaggcactctggtttatgtagttttaaaatgtctaaccatatatcatacttttcagtattttttactgcagatatacagtaccttatttaatattatagaagaaatagtttaaataaattttgtggaccaggatttaaaccaccttagttctatggtccaaatgtgtttcaagttccaaaatacctgatttcagaacaaatttttggaacatactcgtttataaaagttagtaactctttttataaaccattacttacagaaacattgacctcttattttaatatataaatatttgcttgttctaaaatttatttgtattttttaaattaatagctttttctgggcagttttaggttcatagcaaaattgagtgaaaaccccttgtatctctgcccctgcacagacacacaaccacccctgctattattgtcccacactacagtggtatagttgttacattccaatcgataaacctacattaacacatcattatcatgcaaagtccctagttttcatatgggttcactcttgatgttgtacattttatggatttttacacatatatagtgacatatccgccattcataccatacagaaaagttcactcccttacagatcctccgtgctgtgcctcttcatcccttccaccccactaacccctggcaaccactgatatttttactgtttctgtagttttgcctccagaatgtcatatagatggagtcatacagtatgtagccttttcatattgggttctcccacttactaatatgcatttaagtttcatccatatcttttcatggcttgatagctcatttctttttagcaccgaataatatttcgttgtctggaggtaccacagtttatatatccattcacctactgaagtaacatcttgatcaccttcaagatttggcagttatgaatcaagctgctattcacatctgcatgcagaattttgtgtggacataagttttcagttcatttgagtaaatacccaggagtgtgattactggatcttatggtaagatatgtttatgtttgtaacaagattgccaaactgtcttccaaagtggacatccagatgcataaaaatgaatctagatattttgcatttcctgtaccattttgtattctccactagcaatggatgagagttcctgttactccacattttcttcagcatttgttgttggtgttttggatttgggccattctaataggtgtgtagtggcatgcttttcttgttttaacttgaaattccctaatgacatgagtttgaacagtttttcatacgcttacttgccatctgtttatctttggtgtgaggtatctgttcaggtatttcacccattttataatcaggttgttcattttctttagttttaatggttcatcgtatatttttgataacagttctttatcaggtacatcttttgcaaatattttctccaagactgttgcctgccttgttctcttgacattgtcttgcagagcaaaaaaaatctaggctgcagttacagatttggaagttaagagcatattggtggtattgggagccgtaaaactgcataagataaccaaaacagtatatgtaggtagaaaagagaagagtgtaaggtcttagctctggaggactggtgatatttaaagcttagggtgataaggaataggaatagagagtgagaacgaggggccaggaaatgtaggaaagctaacaaagtatgttattctaggaatgaaagagaaagtgtatcaaggaggatgtgattggctgtgtcaaatgttgctggaccagtcaaataatatgaagattgagaaatgatcattgggtgtagtgatgaggtcattggtgactttggataagagctgtttcagtggagtaatgggaggaaatgcctgttgggaatgagttcaagtaacaacagaggagagaaactgaagatagcagatgtagataagatttccaaggagttttgctgtcaaggaaagatgattgagatggaaactcgaagggagagagaaatagagattttaaaaaataataataaagttgggagaaagggcattgttggattcttattggcatcactcaccagagaaggaaaaatggatgatgattcaagacagtggaagagacagagagtgtcggtcagttgctagcctctaatatgatttgtttaaattacagtggactcagccctgcaactgctcatgtcccttcctgaccccttcccatcttgccgtatgttttgactaacagatggtacatttatgagaatgaaaagaggcccctaatccagacaggtagccaacactacctggattttaggactggattttagccttcacttgtcctaaactaggtgtctttgggtacagcaaagtaatcatactaccatagcttctctgcttagtctactccaagacaataggaaaagttatttactatcctgcaatagttaaatgtacactttgtcctatagttaaatgtacactttgtccgatggcaaatagcatgataagtgggaagagagcacatttaagaactaagaatttggtgtgggaatccaagctcttctatcaactggcagtaaaatatatttgaggagagtttaaggcgtatgagtcgtcttaccaacaagtaattatgagtttagattttatttgaactatctctcttgtttgtattttataaagtaatggtgtgttaagcgcagtgcaccaaaatgtaactaagacttagtagcacctaggactcagatcttggtttttcttacaacattcgcactgaaaggaaccctggctctttggaaaaatgtttgattccaaggatgggattccttatgccaaaggaaggaaatgcttaaaaaaaaaaaaaaaaaagatgctaacatgttgcaaggatataggagtcattttgaaagggttccccatcagccaaatctgcaataatttgggtatcaaaataattaaagtcagtaatgacttataaagcattgggaaaaaatgagaccataccagtaatacttctgtacatacgtacaggcaggagaagaggctcaaggggtaactgttaagtgtagagaaagttctagaattggaaaatcatgattttattgctgtaacagaatacctgagactgagtaggttataaggaaaagaggtttatttggttcacctgatgggcatctgcatctgttgagggcctcaggctgcttcaactcacagtggaaaggcaggcatcaagtgcaaagagatcacaaagcaagaggaagcaagagagagaaaccaaggaaagccactctttttaacaatgagttctcttgggaactaattcattcttgctagagtgaggactcacccctgagggagggcattaatttattcatgagggatctacccctctgacccagacacttcccaacattgccgcgtttgggggtcagatttcaacttgagttttagcagggacagatcaaaccatagcaatcacaaatggatgctaaatcttgggaagaaattttgataagaagcaggatatttgcctggtcttgaagtgtctgtccaaatattgcttattggttgcagggaaaagatagtaactaagcagtaggaaaattggatagcagtttgtctggatgatgaaacttaacatcaccaatgaggtacaggtaggtgctgtgtgcctccaaatgtgataccatgagaaggacacatactatttcagccagacacctactatttcagccagaaatgcgttacatgaatcaaatcatgaggaaacatggcaagctcaaaatgatgagcattttttaaaaaagaagactagattctgcaaaaaacgttaatgttataaaagttaaagaaaggcggaaaggacccatattaaaggagaataaagacacaggaaataacgtggttccaagactgggtcctgcatcggagaaaaattaattttttaaaagggtattaccgaatcagttgacaacattataatacaaattgtactttaaagaattgtattaatgtatttactgaaattgtaactgtattgtaatttataggagattgtttttaggaaatgcacactgacatgtttatggggaaaaggccgtgtgcaactttcaggtgactcagaaaaaagtatgtctctatgcatgcttgcaggtttagaggggtgtgtgtttcgggagagagaggagcaaatggggcagagcagaatgctaatggagactgggtaaagttataccaattttctttgtacttttcttgcatttcctctgtaagtttgtaatatttccaagtaagttcatacacacatgcacatgcaaacacattggggcttatttcttttatacttattttacttcttattgctctagattgctaatttacctttaacacttccctggttttaggatattaacattcattgctaatatatgtacatactgatttttaatttcttttaaatagtgctgggcctaaaggagataacatttatgaatggagatcaactatacttggtccaccgggttctgtatatgaaggtggtgtgttttttctggatatcacattttcatcagattatccatttaagccaccaaaggtaagaagcttgaagtgcattctttagtatttaatccttctcctctaaaatcggttattctagaacttaaatgtgtattgatgcagttattttgatttcattgcttttcatggattgatatggaaattttcgcataatcaagaattttaaaacagtaattgactcctttcacaaataatttgtaataaacagaaagagtttaattcttaattgtaaataaaactataccttgcacatcaataaagcagataaattttatgcttatgagggagaagatcctatgaaccttcattaataccttaattaataataccttaattaactattaaggtattaatgaaggtattaggataaaaagtaaaactgtttgacagcttccagaaataagggtttaataatgtgaattttgtgctgaatacctttatagataagcaaaaacttcatagccaagaagagggaaactaataatatttagtaaactcattttgtaccttctgtgggtatgatgtagtagtggaagcagaatgcctgagttttgttggctctgagttcatttgaagtatgaattagatggataacagagaacggggtgagttgtgccttctaatgaccatcaactttgcaaagcttaaatataacaattacttgaatggctccctccgctaacttctgtttctacaatggtcaagtcagcaggtaaaaaccactggaattaagcatgagcattattatgctgttgttacagagatgtctgacatagcaggggaaagtgtattttcaagtccatagcccttaactatggtgaaatgtttttcttttccaacatggtgacttttgttctctgtacttttaaaaatttatgttgcagtctataccatttaaaatttatgtagcctgtgtgtatatgtatatgtgcacataaacggatttattttgtgaataaaagagggttatttctcagtaacttattgtctaacaaggtaacgagtgccatctagtggtatttaccccaaaccgcagacaccatttactctcaattacagctgttagtgtttaaagtgctttaccgtgtggtcccatcagcatgtaagatcttgaaattatttttgcatatggggaagattaattgaagaaaaagactcttaagttttcctggacaccttttaatgaaaaacagaaattggctaatataagaatttcacactatatagtactgtatatgatttgccgtaattttgatgaatataatgattataaatttagcatgttggttttttgctgaaattgcaatatatcatctaattctttagtgttcactctgttgctgagatatacagtattaaccattaagatctatagttggacaaatgaaaaataagatttctggtataatcttggtatttggaacaattatttctctgcaatgctaaatctttttgaagtttggaaaagttgagcttcttgaaggataataaatatttaatagaaatctgctcatgaatgctattctgttcactagttatagctgaaaatatatttgtaaatcacatatgtattgagcagtaacgtcagtgatctgaacataaattatttctatattctagagcagcattaatggaaatatagtaaaatctacatgtataattttaaattttctaatagccacataaaacataaaacaattttaatactatattagttaacccaacatattaaaaatattgtcatttcaacatgtaatccgtgtaagagtattgttaatgaaatcttacacattttctttttggtactaactctttgaaatctggtatttattttacacttctagttcgtctcaattcaccttgccacaatttaagagctgtatatgcacatgtaactagtatatgctgtattggtcagagcagttctagaggggcatactctcctcctcccccactaaactagtgtgttggtcccctaccccctccctgtcatgcattcttttcaggaagacacttttgagagcatttaatgttttcctcccagattcaacttttgcgctcacagtacactgctagttttcaaatgatcagaaatttttttttttctcggcaactccaattatgaattagctatccaattagtgtttgtgattgttttgagacttggcagtgtttgttcttatgatttatcttcttttctcacacatttcagggatatattagtttcctttatccagtagctaaaaaccttgtttattttattttaatattttagcctaacaagacagtgaaccagctgtagaaataaaaggctaagaaacagaaaggcaggtagtgtgaatgattttaccaaccgtcttctaaatcctccagtattttctaacgtttggtaagaaattagctgaattgatactgatcttttctagtaagaaactgatgtaacttttatgttttaaaaaaaaatcttcatcagttcctcttaccttcggcaccaaaacatttcttttcttcctcactttctgtctttctgtatgtatgtgtacacacacagttgtatatgctgtggatgtgtatgcaaacagacgtacccacacacatagatggaattactgtatcagttatttaagtataactgatcagttcctcactttagttctttctatacagggtaaaaacaaaaaatttttttcaactgagtcaaaagcatttaattttgttattaaacctaatctaagtttagctccagtcaaataatttagtatcatctatgatatattacccttcatttttttttagtgttttaattggtaatacagcattcattttccttctgtttttaatgtgactgtgcttaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctggtaagcaaatctttattaacatgtacaataagactacaaaaacgagtgctttttttttttttttttttttttttttagttagctttaaatgtagattgagaggtaaatgttattcatagaaagatccccataaaacagtttgtgaggaaattaccaatgccatttgaagtagactaggccaaaagtttctcaataccttcatttaatttgttaatggcataccactctataattattttgtcaccatcattaatggaatctctacttttaaaagtatttaggtgcacagaccacttcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcttgacctcatgatccacccgcctcggcctcccaaagtgctgggattacaggcgtgagccaccgcgcccggccgaccacttctaacaagagtaaagcaatgtgtctgaaaccagtgcctccttttcctgctccttccatgctgctgtatgcttttaggcaactactttaataatagaaggcttcttgttctcccttccttttttaattaattagttatataaagtgtagtagtaatggatattaaaatgatagccaatgagaattgaactagattatgattatataacctcagataaaatcatttgtgtataattcataactttaaaaaatgcctgccacatgtgaacttcagaaacttgggtagctgacttgataaagtgatgtttagacctgaaatttcacacattttgtttcgttatgtgaccttttttttttttttaagttgacttacttctaaatatttgataagtcactaaagactgttactgttgttaccttatgctcggcagagatacatatgcaatagatagtgacagatggatattcattgtggtatcctttattagagtattggaaacaacctcaatgcccattaatagatgtaacgtttaaaaagaatgtgacaactctatatgaactaatagggaaatatcttcaagatatattaagtataaaaggcactggaaaaaaatacatatacacaacataatattctaaatgcttgtcagtgcatgtaagaactctgggaagtaatgttgtaaatgggtaacaattgtttgccagggaaagaaacttctgagcagttggagtcaggaaggaagatagtttttttttactggctatggtttggtacaattcaaatattgtaccatatgtacatatttttttgtttttaaacatcaaaataaaaatttatatcaggttcactctctagttcagaattctacttaaaacaaaatggcaagtaagttttcaagtgtaaatattgatagtgattagagtcatatcaggcacagaatgaaggaagcattttatttgaaatagcatggtattgtaagactggggttttattttaaaattaaccatttttgaactattcataagcagaaatataaccacctagtatacttccattttgaatgaaaggccaaaattacaaaatagtttttgtatattaaagacatatcttttataaaagtcaaatctaactttttatatatagctcaaaattcatttttttttttatgaaggggactttcctaactggaatattaaaatatacatatgatcatgttactttaaactttttcttttgaaaatttagctattatatatgaagatactgctgaaaaataagcatttcattttaatagaatattagaactataccttgaagaagataccacaaaatagcttttaatgttctttctgcttttccagcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaagg

SEQ ID NO: 37359 - DNA, 28847 bp, Homo sapiens
ccccgtgcgcctcttgcccgcagaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccggtgagccgcgggtcccgagtgggccacgacctgggccggccgtgccctggggcgcagcgcccacagccgtgtagcgcgaagctagggctctgctgccctggggctcggtctccgcatcagtagagtgggccggctgggtatgcccaccagcctgcctcctccccacccaccactgcgccttggcggtccgcgttgcccacaccggggtcagagttttgtctcttggggttctctcccacttcctgggtccacattagagcagaaggttggatgtggctgccagggccggctgggcctgggacctcccggtcacagccggtggacttggcacctttcctgcgctctttgatctccgagttctgtctgtcccctcctctgtgcaccatacactcctgggggagtcctttttcaagtgtcaagatccgtctcagctttacgtgggtccccactcccacagggtgtgcctttgaaccagaactcaaaaaggcatgatggaatggtctttaatggtggaatttcaggcatggccaatgggagaagtattttctttgcttctggggatagagggggcttctctgtgccattgaaaaggcaggctgcatttgcgggccggcatctgtgtctgtggggggtgttggggagctctgggagcccaggagtcatgagggaatgtgctcccctggctgtggcagaatggctctcttctcttccctgatgtgttgggacaggcccctgtgtgtgtcactggctcaaaaatctggggaacgtgggcctggagcatggtgggggcagaagcaaccaggcacctggggaggccttcccctagaccctgggtacatccccccactactctgtagggcgcctgatggacatcttgcgctgccgtggcaagaggggctatgaggccttcctggaagccctggagttctactaccccgaacacttcacgctgctcacgggccaggaacccgcccagcgctgctccatgatcctcggtgagtggatctgcggtggatgctggcacctcggactccagtgcacaggctcctttccccatccctgttagggaggcgctcccactatgcctgttgaacagtaagggaaactgaggcatggagaggctgaaggggcttgcccagggccccacggtaggctgagggtggggctgggtgctagtgccgttattccaagttcagagccacatgcttaagatggctctttcttcgtgatactgttttcagacatatgtctgacatacacagatgtatagttttttatgtaaaaaaatacagaggctccaggtgactttgaatttttttttttttgagacagtgtcttgctctgtcaccaggctggagtgcagtggcgcgatctcagctcactgcaacctccgcctcccaggttcaagcgattctcctgcctcagcctcccgagtagctgggattacaggcatgggccaccacgccctgctaatttttgtatttttatttttaatagagatggggtttcatcatgttggccaggatggtcttgatttcctgaccttgtgatccgcctgcctcggcctcccagagtgctgggattacaggcgtgagccactgcgcctagctgaatttttttatataaaaaacacaaacacatacacacacgcacacacgcctacgtgtgtattttgctttttcttagaacaactgattttagtgattctttcacctctgttacatacacttgttttaagtgactgcatactgttcattagtgaagttaggacataattcatttaacccatttccagttgatggatacctaggtttccagttttgtattattacaacgatacgggaacatccttgtatgtgcgtctttgtgcaaatgtgtctcaggcgaagaggttctgagaagaatttctcaaagagtctgtgtattttaactgttaaatcaacatacctcctaccaggaatgtgtaagggcccatttgaatcctggggatcatgtttaaacgtttttaccattctgatatgtaaaaaataatgttattgttttaagtttatatttcattgagtgatacagttcacaggttactagttattaaaccttgggtaaataactgctctgtgcttcagtttttctgtctttaagatgggtacaataatagtacctaccttacagtgttgtcataaagattaagatatatctagcacaaagaatgaagttaacaaatattagtagctactgtaattattgttgataggttggtgcatattttcctgtatttattaactatttttattttgggacttgcctattgatagtttttgtccatatttttatttggttgttgatcttattgatttgtaggagctctttatatattacggctctgagttcttgttatattttctcccactctgttgcttattaactttgttacatctttcatttttcaaaggtttaaacatttttatatggatttgtccatcttttttctcttataactcctggattttgtgtgttgtttaggaagacctcccctgctcccaattctacaaatatattccagaatttccctctagtgtttttatggtttgagttttttgacacagtatgttatctcctggattttacttgcctgagctgcctattctgtcccctgttctgtcctggcagatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtaggccctggggagatgggtcggggaggcaagggaaggggcagcttttgcaatgtagtagccagccagcctgtgtcccagagccaccattgctggctctttgacgtggataagtccttttagtgctcggtgtacctacttcattgggttatgactgtggttctcaatggggggtgattctgaccccctagaaacatctggccatgtctaggaaatatttctggttgtcacaattagtggggatttattggcatctggtgtgtagaggccagggatgctgtcaaacgccctgcagggcacaggacagtccccagcaaagaattacctagcctaaaacatcggtagggccggggccaagaaacactgggttatgaggatttgataagttgttttttttttttttttttttgagatggagtctcacccttgttgcccaggctggagtgcagtggtgtgatctcggctccttgcagcctctgcctcccgggttccagcgattctcctgcctcagcttcccgggtagctgggattacaggctcgtgccaccacacccagctaatttttgtatttttagtagagatggggtttcaccatgttgacccggctggtctcgaactcctgacctcaggtgatctgcccgcctcggcctcccaaagtgctgggattacaggcgtgagccaccgtacctggcccggtgagtttaagacacagtttcaaacatgtacagtccctagcacactgctcacaacttgtgtcatcagtagccattgttgatattattatcaagagacacataggttaaacatcatgtcttctaatcctcaccaaagcaccatacgccaagccctcatttgcaaatacagactctgagactcagattagtgaaaggacttgctcaaggtcacagagccaggaagcggcacagcctggatttgaaccgggtccggctggctccagtgccagcccccttcccacgctgctgttccgcctactccctgtgtggggaagtctcacctgactccctccagcagcaagtgaggctgtgcctcctactgcatctcactttcttggtttctgactgggactcagcagggggataataccagtatttgactgccacagggcgttgttccaaggatttaatgagctgatccacgtcaagggcttagcagtgcaggccgcacggcacgcaggaggctctctccagccatgttgctcgaggctgcacagtgggttctgaccgtggagtttgaagcctccctaccccaggagccttgggccgtggctacagcattgcaggtggctgtgaggctgtagatgtgggtgcactggtgtgccagtcctcggtttgtgcacgccaggtgggtcgatatcttggggaggtgagccctgatgggggtgttgaggccaccagttgaagggtccaggctgctggtcctgcttgaggatgtaggtggctggtttgaggttgtgagatgaccttgaggctatcgttcgagggcctggttggtgtgtggcaggagacggaggctttctgaggagtgatgggcagggacagggacatgtcccaggcctgctctactgtgaaaaaccatgtggcatggggaaggctttcctttctgtgcctcagtttcctcatcctcatcacagataaggatgatgtaacaattataaaacggccttgtgctttatagataccatcctcagtgcttgccatgcacagacccctttaattttccagccaccctacgctggggtggacaacactatcttccccatttctagaggaggaaactgaggcacagagaagttggttagagcactttcccaatgtcctgggattgaaggaatttttttttttttttttttgagatggagtcttgctttgttacccaggcttgagtgcagtggtgagatctttgctcactgcaacctctgcctcccacgttcaagcgattctcctgcctcagcctcctgagtagctgggattacaggtgtgtgccaccatgcctggctaattttttttttgtatttttagtagagatggggtttcaccatgttagccaggctggtgtcaaactcctgacctcaggcgatctgcccgcctcagcctcccaaagtgctggattacaggcatgagccactgtgttcagccggattgaaggatttctgagttggctctcagcactgctgaggggcggtggctggcaggtaggagtgctcccctttctttacccagagggcttccccttttttctgaaacagacatggggcttgctgtagggttttctcagaagaaataatttactgcttagagaggacggcgtgagggctgcaggctgggggtactgggaggggctgcagccctcacggcttgtcccacctttgggttgggtgtgatgcgattgggagatgtcctgcgtgtgtggccatctgggggctgctgggacaggggagggggatggaaaagagatggtcggaggtgcctctgtagtctgcaggtcatctgcctctacgcagagtggctgctttttcctattttagggacctaagaagtgaaattggccaggcgcagtggctcatgcctgtaatcccagcactttgggaggctgaggcgggtggatcatgaggtcagaagattgagaccatcccggctaacgtggtgaaaccccgtctgtactaaaaatacaaaaaattagccgggcgtggtggcatgcacctgtggtctcagggactcgggaggctgaggcaggagaattgcttgaacccgggaggtggaggttgcagtgagtcaagattgagccactgcactccagcttgggcgacacagcgagactctgtctcaaaaaacaacaacaaaaaaagaagtgaaattaaacttagctactataaatttaccttaatttataatttatgtttggagcttttctgctccaaaattaacaaaggtgttgcagatggatctgaacagagcacctgatcgtgcctggcttggcggcttgcatccccacctcccataggcaggtgtgtggcggctgggatttaataccctgttttataaggtgcaaatttaatgagctgttatttctaagcaacataaactgaaggaacgaacgctataattttgtgctcagtgagtttgtacgccgggattaaatgcatccgtatttcctgttgctcgtcggagactcccaggtgtcctgtcctctgagctcatcagggaagccggctggccaggggtcaggcaggaggccctggtgtgtggctgcggtttgctgagagggtgtgaccacagttgtccttgtaacgagctgtctttctctggctgttcacaaagcatgttttgtgagtggaaaggaatgcgggagtcatgaatttctttctgagtctcttgcggaggaggaggagtggactgttaatttgtagaattgcctgacccagcctccagacccgtgtgtgtgtgtgtgtgtgtgtgtgtgtgtgtgtgtgtgtgtgtgtgtgtgtgtggagggggggctgccattctaacctctcaaggctggggaactagcaagtcactttccaagagaggccaggggactcctagggcaccaaatattgcatgcctgactgtagcaccagaagtcattgtgaccttttcccaacaatgacttcattttatggcctgccacctgctgccactcttgtcactgtctggccacctcagaccccacatgcgtcacgcttggctgagtgcactcatagtccagcaaactggccatgcacgtctgctcccagcttggtggtcacaccacagctgcccaccccccataccaggccaacttctggctgcacactccgaactggtgattggttaggggcatgggattttgtttgaagctgtgaagacagccacggtcacactgtggcagctctgtagcccttcatagtttagaggcctctgcccacttgctgtcttgtttgattcttgcaacacctttgggaggcaaatgatggggccaggggattgactgggcccattttactgatgaggaaactgaggcccagaggaggtaagtgacttgctcaggatgacagagcctagaagtagcaaaattgaaacctgaaccctggaactggagctcttgagggagatgaaccaacagccaaatcttctggagtggaggctttgttaggaattcctttcagggtggaccagaccaagtctgagtctctgagagtgtgttgaggtgagatgttggcttgttgcggggagcatctggttcccggactggatgagtccctcaactctcaaaaccattgccctctcctctcccctcacaccccccccgtacagatgagatgattgaggcacagagaggggccatgacttgcccagggtcacactgagctagagacggagctggggtctgaccctgttttttttttttttctccttctttctttcttctttcttccttcttccttctttcctcctcccactctgccctcctcccgcctcctccttctccttctcctcctcctccttctccttctacctcttccccctccctcctcctcccctcctcctcctcacccccttctccttcttcttcttttttttttttttttttttgagacagggtctcgctctgttgcccaggctggagtgcagtggcacgattatggttcactgcagcctcaacctcccaaagctcaagtgattctcccgcttcagcctcctgagtagctgggataataggcgcgcaccaccacacccaactaatgttttaaattttttttgtcgagacgaggtctcactgtgttaactaggctagtctccatctgcccgcctcggccttctaaagtgttaggcctggtttcccttattcttttttttttttttttttttgagacagagtcttgctctgctgcccaggctggagtgtagcggcgcaatcttggctcactgtaacctccatctcctgggttcaaatgattctcgtgcctcaatctccctagtagctgggactacaggcatgtgccaccacgcccagctcatttttgtatttttagtagagacggggtttcaccatgttggtcaggctggtctcaaactcctgacctcaggtgatccactgagggcccgcctcagcctcccaaagtgctgggattacaggcgtgagccactgtgcctggccccacttcttcttgatgcggccctcctccttttctgccatgagaatactgggctaaattgacgggagtcagtgtcagaagtgcgggacagacagcgtgtcgtgatgcagcatgtccgcccacaagttcttagagtggattcccctgggagggtgtccttggccttgctacccactgctccttcctcagccctgtttgttttatatctgtccagcctgtcctgttttcatagacaagcctggggaggactcctgcttcggcttctctgggaatctgggaggcacccaggagtgagggagcaggtcttcccacccctgtaacccgtggctcccagtgtgtctccctctgggctgacccatgtcttgggctccaggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggtaccagggccagggcttgtgggcacaggctggggggtggtcaggagggcctgcagcaggtactggggcttgtgggcacaggctgcggggtgggggatcaggaaggcctgcagcaggtagcagggccagggcttctgggcacaggctgggtagcggggctcaggagggcctgcagcaggtaccagggctggggcccatgggcacgggggtggggggtggtcaggagggcctgcggtaggtaccagggctggggcttgtgggcacaggctggcaggaggtcaggagggcctgcagcaggtaccagggctggggcccatgggcacgggggtggggggtggtcaggagggcctgcggtaggtaccagggctggggcttgtgggcacaggctggcaggaggtcaggagggcctgcagcaggtaccagggctggggcccatgggcatgggggtcgggggaggtcagaaggacctgcagcaggtaccagggctgggcctcgtggccatgggggttgagggggggtcaggagggcctgcagcaggtaccagggccagcgttcatgggcacaggctgcggggaggtcaggagggcctgcagcaggtactagggccagggctcgtggacatggagtgggggtgggggtcagacccggaaaacaggccctcttgctgtttgcttatcctcccaaggcctgggaagctgaggatttcagaaccagggatctgagatctggatggagtcccggtagcctcttgcctgaagctctgagctgagggcccttagcacgtggctgtccctggttgtctggtctagggtgtgtgagcagcctccagaaggtcctcaaactccctaaaactgcccccctgattttgagtgtgagcatttttctggggaaagggccccagctttaatttgatttgtagagggtgtggcctgggggccctagggcttgcttagtgtcctgcggcaggtcagtggcaggtcagcagctgcatgggcctgcctcctggccattgttccacacaggaagtgggggatgagagccagtgtgtttcatggggttggggcacttggctggggtgtgggtctgggggcaagatcttgggcccagggtctacctgtatgggccaggctcagccccttgaagacccctagtcatgggggtgggagtaggtcttgggaatggcctccgtctgctgccctggatggtgggtgagggccagagcacgagtgtgtgcctggtgcttgtttaggaataatcctgggtgaacttgtccagtcacacccttctccacttagcttattagcttacttgtaccccagatactccctggagggtgggtagggcttgtggggccacacccactctgccgatggggagacagagatccagagagggtcgaggccccgggccagcatggcagagctggtcaggtgggtttggagggctgagagctgcgtgtccccttccttcccacacccagggtgggcccctagccagaccctgaggtggccctgccctgtgatccccaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccaggtggggccctgcccgtgccctgccccttgtgcgggagggtgtcaggcagggcctgtgtgctcacgccttccctgagcatctgcttgacgcaggcgccgcgctgagaactgcattcatttgttctcagatgttgacggaggcacccttctaggcgcttgagatgccgcagtgagcaaaacaaaggtgccttttccttgagggggaactccagcaggggagactggcagtatgtgagatacacagtcccacgtcagctatttcatgtagtcaaaggcgatgagcaccgtgggagatgcagagctggggaaggggccggttgcagtttgagtggggaggccaagggtggccggatgggtgaaatgatgatcattcttctcgttttacagattaggcagttgagggcctgtgaggtaaagtcagtggctcagaccactccactgggcaggaggggacttgttattgggtctcagactgttggtgagcgtctctcactggccctcctgggcacctgctggttagctttctcatggtccccagccctgtggtctgaccccgccccgtgccaccctcagtacctgcaggagatggaagacctgcggctcaagcaccgcacgctgcagaaggactgtgacctgtacaagcaccgcatggccactgtcctggcccaactggaggagattgagaaggagcgagaccaggtgagcccagcctgcgtgtacgaggccctgggccagttgctgcttcccatatgggaggagacaaggagcaatggaggggactagaatggtagaaagagacgttagccgctccctgttgggttaggacggggcacaaaggctgggggaaccagacaggagacctggagcccttgagataccagccttacaccctggacccactggcctcatctgagctcctgtggcagttacagaagctggtcctggtgtcttcatttttgaatcccttgttctgtccatctcaaagacaaggccagcacagagggagtgcttacaaatagaagccgatgaagaaattctcaaaagttttggctttcagtccctgggcactatgacccttgtctcctgccaaggttgtggggtgggctgaggacctccggccagtgccaccaggcccccgagcctccttgtgtgaggttccatctgcagcggggaagggcaggaggtttttgtccttaaccaggtgtgaatcccactagaggagttgaagtctgtatattattgttgttattactttttgagactgaatctagctctgttgcccaggttggagtgcagtggtgcaatctcagctcactgaggcctcccagattcaagtgattctcctgcctcagcctcccaagtagctggtattacaggcatgccaccattcctggctaatttttgtatctttagtagagacagggtttcactatattgaccaggctggtcttgaactcctgggctcaactgatccacctgcctcagcctcccaaagtgctgggatcaaaggcatgagctcccatgcccagccgaagtctgcatattagaaatgccctcagaatcccctggcaagcttgaaagtgcaaatttggggcttcattctctggacgttctgattcaggtggtctggggtgggccccaggaatctgcattttatggggctgcccccggctctctctgaggcatgggtgacaggtctggaccatgggcccagctctggagcccctggtcttcactgtggatgcagtgggctgggtttgactcctggcttctccactgactgggatgctgggagtgaagcccctggcacacagcaggtctcgtggaaaagttttcagttcttggtgaaatggtgagagcctggattctgcagatggactgcccgatttgaatcccagctctgtcgctcctggcttggtttccccagtctgcagaatgagaataatgatattaatagtatctaacttagccagttagtgtgaagatatttaaatgagctgataatttagctcagggcccggcacacagtgctcagtaagtgatagctgccattctccttactgtccccattctccaagtcataggccaggaaagctgggccaaggtggctccttcagctgctgcctcccctcccccaaccctaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggtgagcgggtcaagattgtggaggtcctggcaggaaggctggggtcctggcaggagctcttggccagggctgggaacgtgccggccctggtgggagacctcagccaggggaggaagcttgggggaagtgggaagagtcctcagttaggggcgggaacttgaacccaggctgggctgggtgtgggctggtgagcaggcggaggggcatgttggtctctgagtttctggggttgcttctgggacactaagaatagtttggagctggtctttgcatttaactggggaaggctggctgcctgagtgcctgtgtgcatgttagaatgcaaaacctgggcctcagagaccagctagtcaggactaacatgggcctaagcatccctcagagaccagctggtctaatcctctcatcgcacagggcccagagagggtgaggggcttgcccaaggccacacagccagctagcactggagctggagtcccagacccactgtaaattggatcgtggtcctcaggctgctgccgggagctctgctttttccttttttttttttttttgagacagaatcttgctgtatcacccaggctggatcccaggttcaagttattctcgtgccttagcctccctagtagctgggactacaggtgcctgccaccatacccagctaagtttttttttgtattttcagtagggatgggggtttcaccatgttggccaggctggtttcaaactcctgacctcaagggatcctcctgcctcagcctcccaaagtgctgggattagaggtgcgaacgcccagcctgcgttttcttattttgagttgcctgacagtgagctccgcaggcctggtgtttgaagcactggggcctggaggaatataggaaaagtcagcattaatccaagacttttttttttttttaacccccagtggcttttttgctgtttggtaaagacagagtcccttttcatggccaagaggccctgcgggtggggttcctcttgtcctctcgcctggttctgtgggttccagtctttcaactggaatgcatcacagtcctgcctcagggcctttgcacatgctgttgatctgcctggaccatcccagcttgacctacttagcgcctctatacccttgagttctcagttcaaaccacagtttctttggagagtacttggactcccaggctgggtggggtctttgtgtgttttccatgccctgggcaccttccttctgctattgtctcagcttggggctattttgttcacatgtctgctggtttacagtttatctcccattctaggctgtgagctccctgaggacagggatctgtccctgtgctggcacatggcaggtgctcagtaaaggactgtggttgacgtgggcctagcactgctcacctccttcctctcctctccctcttccaggcctgtgcctcctcccattccctgtgctccaacctcagcagcacttggagcctgagcgagttcccctcccctctgggaggcccagaagcaactggggaggcagctgtcatggggggacctgagcctcacaactcggtaagacaactgccccatcccaaataaggggggacactgctatagcattattactaatgtggagagtgctttctgaaggatccatttcacaggtgaggacactgaggcgcagggaggccaagtactttactgaagctcacccagaaccatttccttgccaggcataggtgccaggaggcgtggggagccacccgcacactataatcttgcagagcccgctcttctgctctgggccctacttctcatttgtggaatgggcacaaaccaggtgtgctgaggactgggatggtgctgggcagtgggggtgacccaggccctgtcatggcattgcaggaggaagccacagacagtgaaaaggagatcaatcggctctccatcctgcccttcccccccagtgccggctccatcctccgccggcagcgtgaggaagaccccgcaccccctaagaggtgagatggctggggatagcagtagacacccagggaggtggggctgccgtttcccgaacagccacctcccagaatctgcaatgccaaagtcaggtccaggcagtcacttccctttattgccctcagatggctggagctctggaaacccaggtcctgtgagtcacaggggcgaccaaggtcaggcttaagataaggccgatgggcagagcgaactcagtcctagccaagcatcctggcaggagggtcactgggggtcaagccttgaagatcctatacccaaggagaagcttgatggttcaggactagggggcgtggagaatgtttcaaggtatcagggacctccggcaagaaagccaggccccaggtttgggcatcagcagcaaatagggaccagaaaaaccaaggcgcaccctctggtggcaagaccaagggcgggagatagcctgcctcctggggcgcgatccttgtcactgcttttcccctgtaagcagcccttgatttattcctttactggtgagaggctgggccctgggaggctgtggtcagtatggccttgatctgcgtaaatctgtcccaaggaggtgtctgatgaggaggtcatggtttaatttaggaggcgtacctgggagtcacaaaccacaaaggtggcaagtgagggtgaggtgaggggtgagagatcaggggtggcttccaggaggaggtggcattgaaagagctggctttgaagggcatgccagggcattgtaggtggaacaacattggacagaggccaggacattaacttcttaccctgggagtttaggggagccaggtggcatgggtgccctgtacctgggaccctgccttgagtctagcctgcatttgcttgggggctgtgagacatttatctggtgtgggggcaggaggagggagcggggcagagtgcccactgtgcctcacctcctgccccctccctgccctctctctgcccagatccttcagcagcatgtcagacatcacaggtaacagcccttgagttccgtggggagggctcctctggtcgggggaggtggctttgcagcccacctgaagcctgcaccacctgcgctacctttggcctgcatccccttccctgaagccccgccgtggcccctgccaggcaggaaggttgtgcttgggaggaccctggggactttggttccagcctctcaccccgagcccagtcctgggcctcactcctgttcccggctgtgatgtacgaggctcttcagttctgggccacctttcaccctcttctgggaaactgcggggtcagcctggtgggccctgacctatctctgagcccagtgggtctgatgtgctcctggggcctcaaacctgccaaggcctctctgggctggaggggggtcagtccctgtcatggaccctggccatccctgtttcccagtgccagatccctgaacctcattctttttccccagggagtgtgacacttaagccctggtcccctggcctctcttcgtcctcatcctctgacagcgtgtggcctttgggaaagccggaaggcctcctggctcggggctgtggcctggacttcctcaacaggtactgtagctgcctgcagtgggtggagctggggtgattgcttgagaggggaacaggagtgaggtgggaggagcaattgcctcgcccctgttttatgcaactattggaagattaagatctgtagacactggcagcccttggattccaatcctgctgccgctcttgatcgtccctgtgacttgggctggtcccttcacttctctgggcctccatttcctcagtagctaaagggagatgatgaccctttttgcatggaggtcttttgagggctctgctcgcagaagcaaagcacccagctctgccaggcatgtagcaggtgcttagtaatagttgtcacttacaagctgtcctcgtcccaatgtcctgcctgtcagtcccttggctctgagtccctgggactgagccacccagcaaagtttcatgctgtgggtgggcttgggtcacctcaggagcccctgtgaccgggccagccacaggtccataacaggagtcacaaagcccattagtgcagagtgcactgtaggcgacgtgctgttagtgtggccggtgcgtggccgctgttcacacctgccagtgtatctaagggaggggtggggcagagcgggggctgcacggccattgtggtcttggaactcagctgtgaggagagggcaggtagggagagcatccggtgactgtggaggaggagcgagggggaagggcgaaagtcaaggcttcctgagtcaggctgggaaagtgtggactttggcttgtacactctgggaaatgtgggagggtttagttattaactgcaaggccagctgctggctgttttacaacatgctctttgtccagggagtaggcataatgacgattatctctgctccatagaggaggtaactggggctcagagaggttaagcaacttgcccagggtcccacagttgggaagtaccaggtctgggttcatagtgacctgatcagatttgggttttggaaagggcataggaaacatggactgtcagcgctggaatgtggaggtgttgggtgcagagggatgggtcacgcagcagatgggtacagcataggaccagggcctctggcctccggagcggcttggtcagccagtgtccaggccctgcccccacctggcccccggcagtgggctcagcgagacattgtttttgcctgtgcaggacgtgcttctcggggaaggggtggaggcgcctcccttcctgctcgcctcggcccttcctcccttcctccagtttgggctgcagcaggggtcctggctgttgtccagggggcgccaggatgcagccagggagcaggagcctccgtcccagccccgcccaggccccacgatcacatggggccacttctgctgcccatgctgttcctggggaggagagaggttcctggggaagaacacaggctggggaaggtgcagaggtggtggacagagagagagagagaaagagagagagagaggcagacaggcggagaggagagggagagggagatgagggcccggacaggtcccaggtcggggcaacttgtgtgtctcctgggattgtgttatggcgaggtgggaagagctggctttggtgtcagcacttgctactgtgggaccttgggcatgtctctgaatttcccagtgcctcagtttcctgctctgtaaaatgggctcacatagtgcctgtcccttagggtcactatgggggtttgagtatcccttctagaatgcttagcacactcacggtggatgtcagcatatgctcgcggttagttatgattattgtcgccattgttgtttaatcctcagagcagctctgcaaggctggaattttaacctcgttacacagaccaggacactgaagtacagagacagttagaaattggtcccaagtcacaggcccctcggagctggttggagattccgatgtgcctccccactgtctcagctgttggagatctcacatccgtattgtgtgcccactttgtactgggcaccatgttgggcattttctctcctctttcccatttcctgcccatctcttgccctcagcctctctgccctgcccttctcagctcctggagcctgggtgccgggaggggatggtggatagtggggggctggggcagaccgggggttgggctgacagatagtcaggtgggggacagcaagggagaactcatggggcaagtgaggtgctgggtgagagaggcagagcatggagagcactggagggtttcggggtgccgtctccccagcatagcctcaccactgcccagctcgctcacgtggccccaggggatctctggcaccttctgtccttgcaaagagagggttcccataagtcattgcctggctccacggcccactagctgtgcccattcttggcaagttaactttcctgtgcctcagtttcccttatctcaaccatcgggttgtcaggaggattgactgaggtgatctgtgtggcatgcttcagtctcagcatcaggtccctgacctggtaccaagcaggcacgcagactactcagatatcttcccacggggccctgggggacattcattgaggccatgtggcctgtcactgctcagagctggcagagctggcagacttgccccgttcctgtctgcctgtgacctgacctgactggggagggggctgggagctggtagctaaggacactgtgcttcctagtaccacacaggcagccagctggtcagccagtcccaggagcggggagcaggcagcccctctccctgctgtgtcctttctctacccctcctgcttgtctgctgaggcggggggctgggaggaaccctatctggaccctgctctgggcaagcccctgtgggctctgcagactccgaggagtgctgggagcaggtattcctggtctgtggaggctcagagaagtcactggtcctttgaggaggttggcaagggcgtcctggaggagggggcgcctgagctgggtcttcagggagctgcaggagttgtcaagaagagcctgaaaaacctgagttgaaagctgaggtcagccttgatgcttgcattgcagaggggagaggtgtggaggagggagcgagtagaggtgggtggggtgggtagggttggtggaagagcctggatgccagctgcttactgggctctggtctggagaggccatgatggtcagttgtctgtgggtttgaaacaggtggggaaactgaggcaagcgagaggtgatttgttgtgaatcacacctgatgccagtaaatgtctagttttgacagagcacttagtgtctcctgggccctgttctgagagctgcccatgtctaaactcagcgagtagccagggaggtgggtggagctgaggctcaagcggctgagcagctgggccgtttgaccccagagttcctgctggcaccctgcgtgctgtgcttctcggaccatctgaccacaacccacagtgagagaaacccggtacacatgcctggaacaaaaaggtcatgagataataattggatttacctggggtggcgggagcggggtgggggatagcattgtactttctattccatagcattatccagctgtcccagtcgcaacccagtgaatgttaccagccactaagggccaggcctgcagtttggaggccccagagtcctctggtttccacctctccctgcattatcttttattcatgtgccccccccccccaccccccagcacccacagagggcaaggggtgtcattgtcagcttcgtgttatgcatgtggtaactgacgctcagcagccggctcatttgcccaggctagggtgcagtttgccctggggtttggagcggaccgtgtgctccagccacaaagccagggccagcatagccaggccaggtctcaggcctgccccctttccatgccacctcgatgcagccaggacatgcggcactgaatgatgcctcccatgcctgcatctgtccagcccctcggcctggctctgtgtcttacctgagagggcggggctgttccccagcagtgccgattgggtgggaggtccttgcagccgcgccctccccaggctggcagcagggggcagtgcagctgtgtctgggctgcagctgctggggtggatggagatgcttcgccccgctgcctctccagccagcacacctgctgaccttggtctccccacctcctccaggccaaggtgtctggcaggggacttggggtccatttgtctctgagcctggccacaaggcctcaccttttctcatccagggacaggcagaaccctaccatgatggggattttggtgacgtcttaattgtcagtggtcctcctgcccatgggaggaaaaccagacgcctctgttccacgccctccaaagggtggctccagcttgcctttcctgggagctgcttcccaggatgtaaaataagaattagggcaaggagctcagcatggtgtctggcacatggaaagcacccaggaagtgttcgctgctattgttattattaaattcttccacgcatcctgtgttctgtcctccacacctttgctctgatatattccttcagcctggaactctgtttcctccatctgtcaccaaagtgcatctattcttcaccagcgtgtagcctaggtacttcttccgtgggaagcctctctctgcttccacggctggttgtaaccacctttggatctgtgccacgtgctaatggtgacctccctcctcagactgtgagcataacaagcttttttttttttttttgagacagagtttcagtcttgttgcccaggctggagtgcagtggctcgatctcggctcactgcaacctctgcctcctgggttcaagcaattctcctcccaagtagctggaattacaggcgcccaccaccacgcccggctaatttttttgtatttttagtagagatggggtttcactatgttggccaggctggtctcgaactcctgacctcatgatccgcctgcctcggcctcccaaagtgctgggattacaggcgtgagccaccgtgcttggctatataacaagcttttattagtcatctgctatgtgccagacactgggtttggtgccagggctacagagcggaacagtatagaagtttggtcctgaaggtgttcgttctgatggaggaaacgaaagggccgtggcaaggcaaagttggagtgctctgtggcacgcaggctccactgcaccgtgtgcccaggtccaggggagaggctgcttgtgacttgagatttgaaggatgatcagcatttcccaggtggagaaggcaaggaagagggcacagaagatggagaggcctgggggtgggagtcatggcatacttgggaaatgaaatcactgtggttttccaagaatgctgaactgaatccaagtactgattggactccaattctcatctcctttctcccttctcaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagaggtgaggccctgcctcctgagctgggggggtagggtcagtgcttttgcccaggctggacatcccttaatttggtggatcaagatcaccgggcagagcttctggggattggtcaaagccgaagcgggctcagtgattagctgtggttgcctgctcagccaggcttaattgaagtctgattgggcagggactgggaggtggagccaactgacagcacgttacattcctgcgcttcaagtcgagaaagacctggatgagctgggcgggttggggagtcctgtggatgggggcgtcctgtggatggggacgggtctgactgggctgggcatggcagtttctgagggggcgctatctgaactgtgaggcatgaaacacccccacacctggtcttcctccagcccctgggctgctctactctcagaggctcacttctttccctccctgcctgggttttctcccagcaaagggtggaagctgctggtctggagggggcgtgcctggaagccgaggcccagcagagaaccttgctctggaatcaggggtccacactcccctccctgatggactcgaagggtaagtctggcttgggagtcggagctgttggccccagaggggtcctctaacccgtggtgcatggggtggggagggaccaaggacctgagaagggaccagccttgccccaattgcccttctcctggctccccgcctgctgatgcctccttctgtctgtccttgtgccctttctctatgcctccctctgtaagcagcttacagtgaaaggagcactacattaggagtccagagacctgggtttgagtcctggctctgtttctagaaggcactggccttgggcaagtccctgccccctctggacctaagtcattctaagaaggtgaaggtcgggtcctgggaactcaggcctcgagagggccatgtctttggccccaccaaggccgatcctggacctcaccatcctcctcttgtcctccttgctgccccctgccccatccatgcccagcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagaggtgacgcagagccaggagctggggatggggtccccctgggagccagggctcagatgggggtgctctccctccacctgcattccctcaccatcctctgggacagggcggggggttcgaggagaaatgaggagctttccttctttctacacacatgatgtcactccctcccacagagcccagcagctcctagaagttcaggagaaatgcctgccctccagccggcaccgaggcccccgcagtaatgtgagcacggctgggcaggtagtgggtggggggccccaagggtggggtccaaaagggagctagcaggctctgttctctggcaacctaggaagacactccctccctccttccctggtgatttaattggtcatctactatgtgcccagcaaacagaacagcagagctcaccgtccagggtagtttagagatgaaatgaggtaaagcgtgcctagtatgcaggagtacccctggtacataataagcatttgacaggctgggcacagtggctcacgcctgtaatcccagcactttgggaggccgaggtgggcggatcacaaggtcaggagatcgagaccatcctggctaacacggtgaaaccccgtctctactgaaaatacaaaaacaaaattagccgggcgtggtggcgggtgcctgtagtctcagctacttgggaggctgaggcgggagaatgaagtgaacccgggaggcggagcttgcagtgagccaagatcgcgccactgcactccagcctgggccacagggcaagactccgtttcaaaaaaaaaaacaaaaaaaacaaaccagcagtcatgtccccttttccaatgcctggatggtggctgggcttcgtggccagcgctgctgtgcacatgggcaagtgaggctcagagccatcagataaaggaagagcgagggccccagccaggcagcctgcattcgaccccagctctgccacctatcagctgtgtgactttggacaatcacctgaaccttccttgaggcttgtttcctcatctgtaaagtgcgggggttgtactgcctgtcaggctgtgcgtggcaggagatgacttccgtgagttagtgcccctcaggggcttagtgagtgtctgtcatgttgtaggcatttgagacctgtcaggtattggtaaaatcagtgccatctttattggtttcattaatttttctaccaaggtcacattgctaattcattggaagagaccctaaagtttgcctcgtatgtgacatttggttcctcttggtctctgggcctcagtctccccatctgtagcttggggggtatacctaaggctcctccaccaggctcagacgggctggcttcccgggggccacagggatggctgctctcatctgcctgggggactgtgctgggctggggaggggcaggggagggcctggtggagaaggacatctttgctgacccaggctcttctggcaagcctggaccacagtggcagtggggcccgctgtgccaggggtcccgtttcctcctctccctgagggggcggggctgagctctcagatgctcctctgtccctgcaccctcccagctgaagaagagagccctggaccagctgcggctggtgaggcccaagcccgtgggggcgcctgcaggggactccccggatcagctgctgctggagccctgtgcaggtgagtgcgcgggggcaaagctgtatcccgtgttgctcccattgtccagggatgtgtgcagctgagtgtcctttagcttgggtggcctctttggcctggaagggcctgttgtgagggttccaacaggagtgggggtcatgctgggggcctgagagacaagaccaccccacctgccatggtgattgccaaggttgagggagaccctgcggggaggtgcatgcagacgtggctgtgactgtgggtttgcacacatactggcttgttcttttctggcagagtgtgtgtagtggtgcttctcacacgtgtgtggtggcaggtgctgtgaggacccaggggggttcccggaggcagtagggtgaggccttaggccagacaggtagaaggggctgggggagctcagatgagggagtagcaaatctggggcaagaggagcgggtagttagggaagacttcctggaagagagggagtttccgcgggggccttcaaagttaaagaggagttcgttccaggcagaaggcacagaggcatggctgtgtgtggtgtgcttggagggtgttggggacagcaggtgagtattgagtaccagctctgtcaggcattggggacgtgactgtccctgccctcatggagcttgctgtctaattagggggtagagagtcagataatcccacctatgaacacaatgagagagtgtgaggtgtgcagtggagaactgggggccgtggggcacatgccaggggccctgatgtctggggaccagggaaggtgtgacctaggctctgaagggagggcaagggttaactgggctgagtggtgcagggctggggctttgggcagccccagggcatgcaaaggccctgtggttggacgcagctgaagggagagtggaggctggtggtgtggggtcagtggctggcagcctccccaggctctcaggcaggactgtgtcacccacgtgggggatgtggcttttattcctgagaatctgggaagtcactggtgtgttgaaagcaggggagttaacatgatctgatttgctttttaaagcctctctggctgctggatggagaatgacccgtagggggcagggatgaggcagagaatcagggaggagcctactgccaccgtcggtcctactaagggtgtgtgtgtgtgcatgtgtaggaggagcagcagcaggacttaggaagggatgggtggcggggtgggttttggggtatcgacgagctggtatgctgcctgcctgtgcccttatctcttttgcgcccctcccctgccacagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcgggtgagactatgtgccggggaggggaggctgggtgcccctctgggcagccgggcccatggatccttcatctctccctctccactccctgtgcagaaagcctctctggggaggaactgtgcccatcctcagcgcctggagcccccaaggctcagcctgccacccctgggctaggcagcaggatccgggccatccaggagtctgttgggaaggtgggtgctgggggctggcctggggtgctcacagaggtggcccagagcgggtgctgctgttctgggcttgagcgccagcgtctgagcgcgggccatgctctgctgctcactggcagggcggccctggccaagtcctttccctcctgtggccttcagtttcctcacctgttgcctgggtgggtgggggcagttgactgcatgtgggccccccttgaggtgtttggctgacacagctcacctacacatccttatccttgaacttgccactatcctgggagctggcagtcggctataaggtggcgggtggtgggtgggtttgggtcagctccatcctccgggtggggaggcctaggtcctgagggggaggtctgtatctccaggttgccccatgagcccaggcctcttgtctgtacttttgggctccttcctcgttgccagggtccctctgggtggggaggcaggacttgcatctgggaaggcggtgataggggacccgtctgggggcagcgcatgggaggctgatgtctgtggcccaggagtacattgtagcctcgatcctccaagcagaagcactgcctgctggagctgggtgctcggggtgtgcgggagctggtgcagaacgagatctaccccatcgtcatccacgtggaggtgactgagaagaatgtccgggaagtcaggtgaggtgggtgggtggggcagtgggcagggcactcggacctgagagcttcctccttgaggatgcctctctccctcccccctctctctccctccccctctttctccctccccctctccctccttctccccctctctctccctcccccctccctcccccgtctctccctccccttctctgtctctctctctccatctccatctgccatctgtctctctttggttgtccatcttctctctctgactcttccccctttgtctgtccctctctccctgtctctctgtctgtcttggtcccccactttgaccgctgctcactcttctctcggcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcatag

SEQ ID NO: 37360 - DNA, 2636 bp, Homo sapiens
cagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacaggtaagggaatgaaatcagcccttcttcctagaagctgcggcgggggtgtttgtcattcccttgatgtacggtaagtacgggccgactcatttttgcaggggtttgtgaagaagtcgcaggaaccgtaggctttcgttgggtctatagttaacgccggatcgcagttggaaaccaccagctttttgtcagtatatattactcattttatagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagatgtgagtggaatttgagggaaagagacattttttagtattgaatggtcttagggtttagtcaccccttttctccgtttagccttcaggctgttttatttttctcctgcccgtagttttctgtggggcttccccagtcttgccagttgtatttcctaaatgtctgttccttcacttccattgccattttcttttttagtgttctctcctcttcccagaatgttgcaaaaacctcttcactatacttcctccattttatcttcctgcattgcattccatatgaagcatgtcctccattccattaaccatagcttaaaaatcttagcttgctatccactgcctatagaaaaaacacatctccttggcatagcatgtaagactttcttacctctctatatttgttttcatttatctagcttagaattgtttgaatattgtgctgcttgactcgaactccttaggccaagagactgtttaacccgtgcgtatctatgacttagcatatagattattcaataaatgttctgctgaattgataatacgttttccacctttcttttcacttacagtgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggtgagaccctattgatgcctaatgcctgaactcttcaaaaccaattgctaattctctatctctgccccacctcttgattgctttcccttttcttatagttttttatgctaattctgtttcatttctataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttc

SEQ ID NO: 37361 - DNA, 182988 bp, Homo sapiens; identical to SEQ ID NO: 36731

SEQ ID NO: 37362 - DNA, 153134 bp, Homo sapiens
agtccccgcgcagtccccgcgcagtcccagcgccaccgggcagcagcggcgccgtgctcgctccaggtagggccccgcgccccgcgccgccgccgggagggagcgggctggaggggccgagacccgtggcgagaagggctacccgggcccctcggagagcctccgggaaggggtgagggctgccgggtgagcaggcggagtaggaaatggaaccaagcgggcgcaagagcgcaccgggaagaatttccccgctgggtttctgggacgcaggtcgcacgggatgcgggatgctggcgaccttagccgggtgggggccgccggcctgggggcgcttcctcctttcttctcccttttccttctcacctgaacgaaagggggcctgcggggagggaagaaggtggaaagtttttgtattcttggtaaaaaaaaaaaaaaaaaatgcgtgaggaaacatgttttctggagatggtatcctgtccacaggggagcataaccccttttctgggaatgtattggagcacggacgggggtgccattgctcaggcttctaaacaagccaagtttctggtcaagggcctgggggagggggaggcaggtctttgaaagataccaaaaaaaaaaaaaaaagaaaaatctgcgtgctcattcctgtagcctcaagtgaggttattccccagctttgagggccaggttaaccaagcaaagtttgtgcaataaagtatctttgtggtattggattttcgagagccaccgttatcaatgggagagtgactgttgaatgctacaggcgtgtgcactcccccgtgggcatgaagagaggtccacgggctggctggattgggagactccggtcatttctgcaaggagagcgccacaggactgccttgttccctgggctgtcctgcccctgtgcgggctggacgtggtgctataaaagatgattcaggagtggcacaggctgagggggactaggctggagaaggtggagggaagagggagcactccgtgccctcttcctgtccatgggaaatgaaccatctgtgcctggtgtccaagtccttgacgttccagttgccctttgagagcacacctcaagcctgctgaattcttttaagaaccacctacaagatctgagaagtccgcccatgctttctgtcaactccggcctctttgaccttttcttttgccaaagaaaattctaaaccactgggattcgtgaggctccgtgagagaggcaagaagcctggagggtccactccgttgctcttttcccttggtttgctccctagaagccatggtccccactgggcccttcttgcccgaggctgtgtgatagacaagccctattcctaaggtcctgggtcccccaccccaccccacaccccgaccttgtgaatcatcatcttcatattttccctaacttatctttggtaacccttgtaaaatggcaggcttactgcggatgcttaatctcttttaaaagtgctgtgtctagcgggaagaagagtgacatttactaatatggttgcaaattacttttgaagtttatgcacagctgtttaaaatccctctgagatcagtgccattgtttgatgcaggtgcttaccgcagaaggctcttgttagtcccttcctcctgctgattgaacatacatatatttaaagacgtggcgtagggagagcttctaaaacctgcaaagccaaagctgcacagctcctgcaagttagcgatccactctaagtttttcagttgttgtttctgtcttcttgcctctcatgaacttctgtttctgatttcaagagtaacctgctgggcaccatcagcctttgtttcagtgacctgcgattttcttctacactttaaaaatgtcaatatccaggcaagactcttgtcacccaccatccgcgttgtcatgttcatttccgctactgtcttgtgctgtggtgcctcgggatggcaactgttacttgaggagctaacttctacctctgttctcctacagacatgtcctcattgcgtcttcgctcaccatacacggtgcagctcctggaaatttgatttgttttgctgtctcacttctccttcaggcaacaaggggatggtgttcgattattcacacctcagctccttctgtaatctcaaagatccctttcaacaataatactctctgtctcttgttaacgccaggcatcagaagcccccttacatagccggcttgtcactggtcatttctataaagtattctcattctaacacatgctgtctcttccgtggaaaagactaaattcttctctgcaatgaattagatgttttaaccaaaattccatgtggactgggtccagaattttctttcaagagtatgggcttgtggtacaagtatgtaacttcggggattcagaagtagacctacacagacaaatctccttataacgtgttatttaattatggtatatttgcctttctggaaattaggaattagagttagtacttcctgtttttaatgcatttgattgatgtcttagagttgctgattatgttgttgcccctaaaaatgttgctaatgtgctggtttgttaacaaggttatatttgatttcaggtgatttcctttttatggagttcagtctttaatttttttcaataatttgcctcaaatcatttaaaatgatatattgttatataatgaaaatcccagcaatatagacgtgattccgtgtgtgtgtgtatgtgtgtgtgtaatctgtaatttaaaatagagaaattagtattgtgacggcatacatagcattaaactcatgcttgctgtttctgttgttttaacactttaagcagctcatttctaagcagctatgtgttcagctcagctttttcatacctattccaattgttaaggaagaagtcatgagaaactatagaaaaatgtgatgttgaaccagagagatggattaaaagctgtttccttacaatggtgaaaatatctttcattattttaacatgccaagcatttatacatgtcaaattctgattgctctgtcatctaaacacattcttggggacaaaatgagcatcagagttttaaaattaggaaagctcactcaagcccagaatcatagatttttgctcctggattaaattagcaagtatttggcaggacatctttctgcaggttgctgtaggttgatgttagcttttgaattaagctaatagtattaattataataataataatcagcatcaacaaaaccaatgaaatatggttttgagtctttattatttagaatttatgtgctgtatatcatactcagaattttatttatatgtaagaggcattactgcttcatttaacctccaaaagcctttataaattagatattattattattccagtttttcagatgaggaaactgaggctcaaggggtagagccccttgtccaggtcttataaccagtcagtggtagagtcaggttagttggaccatccagattagtctaaccatcaagcatttgctttaaaccgcagtcccaggtgacctaccagttaacttttttattgtggttaaaatacacataacttaaaatttaacttcttaactattttctagcgtacagttcagtgacattaagtatattcacattgttttgcaaccattgccatcatccatccacaggattcttctcatctcctaaaactgaaactctgtcctcgtggaacattcgttcctcatccgtctttcctctcagcccctggcagccacccttctacttcctgtctctaagattctgactgctctagggacctcacagaagcagaatacagtatccatccttttgtaactgtcttatttcacttagcatagtgttctcaagctgtatccatgtgacagcattggacaggacttccttcctttttaagtctgaatactattccatttatggatataccacattttgcttatccttgtatctgttgatggttgcttctatcttttgattattgtgaataatgctgccgtgaagaggaacacgcagatatctgtttgaggtcctgctttcaattctttggggtatgtacccagcagtagaattgtggggtcgtagggtaattctatgtttaattttttgaggaactgccatattgttttccacagtggctggaccgttttacattcccaccagtggtagaaagggtcccaattattccacattctcagcaacgctgtcttttgttttgtgttttttgagatggagtctcgctgtgtcgccaggctggagtgcagtggcatgatctcagctcactgcaacctctacctcccaggttcaagcaattctcctgcctcagcctcctgagtagctgggactataggcacgcgctgccacacccagctaacttttgtatttttagtagagatggggtttcaccatgttggccaagatggtctcgatctcttgacctcatgatccacccaccttggcctcccaaagtgctgagattacaggcgtgagccaccgcacctgggcttttttaaaaatcttctttatagtagcctttctaattggtgtaaggtgctgatagttaactttttacccaatcattgaatgcccaatggcagggatctctgggctgatgctactcctgagttcattgtttatttcctatcccagcttgagcatatacacctttttctagtgtagaattaatggaggaaatacaactcacacagcacctgagggactagggaagccatggaaaggacagtccctaaaacataaacagaatgtcccggtaggtagggttatctccacctccatgaggaaccttatgattcagaaatgagtagttgttgagaataaagtgaacatggcatcagtgttaataaccctgaatgtgtgggacagatgctttttagaagattagttacagatataattatcttttgtatgttatcagagcaggacaagttcccaggacaatggagagaatggaaagggaaactgctattgaattcaccaggcctttgttgcaagcctcagatcacacaccgtgctgcaaaacccacagggagatgtggtcaggcaaataggaaattataatgaattgtgatgaattcatgagatatttgtactattttgtatcagtttataatgtcatgcaactctgttttatatttgctagtttcctttctgtctcttttttcctctagcatgaaactccatgagggctggcattttgtccctacatgtgtccccagccactctaacagggcctgacacataccaagttgtgaacaaatatgtgcagaatgattgtgtgtttcagtaggggacacacttggtattatgtgcacagctagatttggggtgtcgcagagctgtcagtgacggctcaactgagacctgaaggggaagtggcagtgagccagatgggggttctgggaggtaggaacagtgtttgtagaatgtccctgcagcatgtgagtctggaatcccagtgcagtccagtctaagccttgcagatgagtggaaatgagcagagtaagcatcacagcttccatttaaacctctgctccccatcctaatttgccatatgaccttaaccagtgaacttcttggagtgtcattctctccatttgcaaagtgaagaaaattgtgatctctgatagcagtgatgctgcgagaaaggagcatgtgccagtgtgtgggctattgctgggtggagctggaggagtcagctgtgccagatcacataggacctgtaagcaggtgaaccatatacgttatcctccagatggggactgtttatagagtgaaagagcacgttattaatcactaagcttgggtaacaggtacaaacccagattgtcctgggcagactgtcccgtagagttgtcctgcgttaagtcatacgaaggagtttgatccttttctaagaacaggaggaaccctttaaatgctttatctaccaatgtatacaagtgccattcaggttctctccagcgtttcagagagttttacctgcccatgaactcacagcactcggcttgcactgcaaactcacctatacgttggcagctgtctcctcactgggcacttaattcatgaacaactaggagggaaagacaacaagacagccaggggtctgctctttggctctttgcatttttttttacggggtcttgctctgtcgcccaggctggagtgcagtggcacgatctcagctcacagcagcctccgcctctgaggctcaagggatcctccggcctcagcctcctgagtagctgggactacagttgcatgccaccatggcctggctagtttgtgcactttgtagagatggtgttttgtcatgttgcccaggctagtctctaactcctgggctcaagtgatctgcccgccttggcctcccagagtgctgagattaaagacatgagccaccacacctggcctagctcttttcgcctttaactggagtgttagctgatatcaagaacacatcttttgggtttttctttttttaaccttgtaacacctaaaggactgcggctaagtgttaaaagaaaaaaatttctatctggtggtttaaatatctgcagaagcagaatccttgtcatcctgaaattttttccctgtgggcaagaattcctaataagcgtacaatctattggaaaaatcaaaaagtaaacaaactatggcaatatattctaacatgtattgacttgtcactatcggccgtttgctgtgctaagcactatatgtagatgattgcttgggtgctttgagaacatgtagaagggaaccaagtcctgattcggaggttcaggaaaggctttcagaggacaaggtatcgcgggtggggatggaagatgtatgggaattagccaaaaggacaggggttcagaggtgagccaagtctgtcctgaaagtaagcagaaatgttgttgttcttgtcgttttgagagaagttcatctcagctgtgttcagcatttttagggcataagcttcaacattttccgttctgttttcactgatatgttttagctatacaaaagcaggccttctacacagtttttcaaactccaagacacagtctactagtgggcaatgacattaattttgggggtgataacaagcatgaaatagaataaaacagaaaatattaagatgcatttcatgtaggaagggtaattatttcatgaaactgtatcatttggtttgggacacattaaatctgttcgtacctaaaagaagacattcatgcagccaacaaacatggaaaaaaaaccctcaatatcactgatcattagagaaatgcaaatcaaaaccacaatcagttaccatctcctgcaagtcagaatggtgattattaaaaaatcaagaaacaacaggtgctggcaaagttgcagagaaataggaacgcttttacactcttggtggtgggaatgtaaattagtccaaccattgtggaagatggtgtggcaattcctcaaagatctagaaccagaaataccgtttgactcagcactcctgttactgggcatatatccaaaggaatataaaccattctgttataaagatacatgcacacgtatgttcattacagcactattcacaatagcaaagacatggcatcaacccaaatgcccaccaatggtagtctggattaagaaaatgtacatacacaccatagaatactatgtagccataaaaaggaatgagatccctgtcctttgcagggacatggatagagctggaagccatcatcctcagcaaactaacacaggagcagaaaactggacaccttatgttctcacttataagtgggagctgaataatgagaacatgtggacacagggaggggaacaacacacactggggcctgtcgggaggtgggattggagggagggagagcattaggaaaagtagctaatgcatgtggggcttaatacctaggtgatgggatgataggtgcagcaaaccaccatggcacgtttacccatgtaacaaacctgcacgtcctgcacctgtatcccagaacttaaaataaaaataaaaattaaagaaaattacatacctatggcatttagttttctataccattcctttaagtcatagaatcagatgagctcaggggctagaaggaagagggagcgatgggaaggcagtcgttggtcatgccctgggcctggatcgcgggaatcagtcattcagaaagccccatatgttgggtgggtctcacagcttacagagaagccagctgaggtgtgcaggttaagaaacttgatctagggtcacagattaaattactagcgctgacccctgatctcttggcttctgatgtggtggtattctttccatacctccagggactgtgttcccaaagtttgttagttaggtggctgtttagggaaggaccacacctggttcctgtttgtttgtttcttggtttgtttgttggtttgtttgtttgtttgtttttgaggcagggtcttgttctgttgctcaggttggagtgctgtgactcaatctcggctcactgcaacatctgcctcccaggctcaagcaattattgtgtcagcctcgagagtagctaggactacaggcatgcaccaccacacctggttaatttttatgtttttagtagagacagggtttcaccatgttggccaggctagacttgaaatcctggcctcaagtgatcctcctgccttggcctcccaaagtgctgggattacaggtgtgagccaccccacctatcaagggaagatattttcttaaggggagtatgtaataacaaccatgtccctggtttgttaggaaggttataaactttgaaatatacccatcagtttcataaagagcaagacaggttaggaagaaatagtgttcattatacagactagagagctttcagcttgacattgacaaatataaacttggccactgtccctccactaaagcgtttcccttgctgctggggaaggaccgcctggtgatgttgtgtgagatgatgcactttctttgccccctctgtggtcactgggatcacagctaaatccaactgtctgctttttccagtgtctacacataggctgatgagttctcccggaaaacacgccgctctgcaaattcaggatgccgtagctctgtgacttcccactccatctaggatctctgtcttccccagctcccagacgtttccctggccaatgatcttccttcccacggcagcttctccacagctgctcctgcctccgccgtcccctcgcactcagcagctgtcttgcctcctgcttccctgagaaagtacaagtttcccgattcagaactgcccccacctggggatcacagggctgcacgcctcactttatctgaatccatcctctcatccttcttttctttcacaacgaaagaaacccctcagttccagccaggcacagtggctcacatctgtaatccaagcactttgggaggccaaggtgggtgaatcacttgaggccaggagttttagaccatcctggccaacacggtgaaaccccgtctctactaaaaatacaaaaattagccaggcgtgctggcgcatacctgtaatcccagctactcgggaggctgaggcaggagaatcgcttgaacccaggagacagaggttgcagtgagccgagattgccccattgcactccagcctgggtgacagagcaagagtctgtcttagaaaaaaaaaaaaaaaaagaagccccttagttcctgtctgaggctcacctcccctggggccctggaatccatttctttcttgttcttgggaatctcaatctcttatcttccctgtcacctgcattttccttctctccctcatttctggccccattctctctgtattaagtgcgcttaaatcccttccttctgtgaaaaaaagaatatatatccttttataccttcctccagctacttccttgtcttgcttctcttcacaatcaaactcctcaaattgttgtctacacttgctgcctttgcttcctcaccccacatgtcttgaacgacagatgcctggccttgcctcttgcacccctcagaaatgatcacccgcactctcctcatggccgattcccgtggagttctacccgcctcttacctgacttcctgcaaccagatgtgccgtgagcacacatgcatcctgggacattgtccctctgtgtctcccatgacccccctgcccatgtttccttccttccttcctctcttctcctttgcaagctcctcttcttttatcaacctggatgactgatgttcctcaattttcccgccctgtgagcatcctcttccctcatcagcctccatacctatctcctcgctgactgtgacccagtcatgactgccccagatccttgccattcttccccagaaagttcctgggcacgtctaatgcctcatgccccaaactggatgcaccaccttcccctttctctttcaacacgttttctcctcctgctcttttctgcaactggcatagacatcacctgctgcacgacctgaaatctgtgtgtctttccttgattctgtctcccctatctccatagcttgccccaaaccaattttattcactcaccccaattcctctgtgttccctccagcctgtcacactcccaccacctctgctctaattacaggcagcaccgtttctcttctgggttggtgtggaacctcctccctagccgtggttaccatgggctgccttctggaacccagtgtgccactccctgctcttaagttctccaaaggctacccagtgcccccgggataaagcccagcctccctgatgtggattcgaaggttctactcctttcctctccagccctcacatcgggttcctccaagtctgagcctctttaagctcctaggaggtcccagcatcccctcatctcgtggacgtctgctcaatctctgagctacttcctgtacatcttcagctcccaagatgtctcttgtcctctggaaagctcttcctgatcctccacatcaggacttggctttcttccacattgtacactccctgaggactggatccacactctctcttactctttttgttgcacttctagcagtcagcattgtgtctgacacgtagtaggtgctcagtaaatattagtgggataaataaatgagtcatatattttagaatctgtaatgcccaaggtactgtgtgctaagtgttagaggaaaagaatcccaatctagtgacttaaatgtctgcacaacagaattactattgtcttggaagattttgcctgtggacctctggagttatctagataaattctaccagaaatcagagctgaagggggtgggaaatgtttagaattccgggaggtgacttgctgcaaagactccatctccccttgtctatggtgtgatttttccccttatcatccccttggcatcctgctttgtggaccactgtaatgtcaataattaaaaaaaagattaaactggccgggcgcggtggctcacgcctgttatctcagcactttgggaggccgaggtgggcggatcacgaggtcaggagattgagaccatcctggctaatgcagtgaaaccccgtctctactaaaaatacaaaaaaattagccaggaatggtggtgtgtgcctgtagtcccaactactcgggaggctgaggcaggagaactgcgtgaacctgggaggtggagcttgcagtgaaccaagatcacgccactgcagtccagcctgggagacagagcaaggctccatctcaaaaaaaaaaaaaaaggttaagctaagagtgatcaggaaataaaagataatattaaaatattcaaaaatattctataagcaaaagaatgaggcaacaggtaaacataaaatgtagacatagcaaaaattcataagtgattttaataaagaaaaaatagtaaaggataaaagataaaattttgtttaaattaaatgaaaagatattttaagtcttcttcaaaacaaaatcataattttttttgttagttttggggggatttttgtttttgtttttgttttgttttgtttttttcttttttggagacaagagtctcgctctgtcacccaggctggaatgcagtggcgtggtcacagctcactgcaacctccgcccttcgcctcacctgagtagctgagactacaggctcacagcaccatgcctggataacttttgtatttttagcagagacatgttttcatcatgttggccaggctggtctccaactcctgacctcaaatgatctcccaaccccctgcgccaccaccaaagtgctgggattacaggcgagagccaccacgcccagcctataatcacttttaaatgtactaaaatagatacgagtaagaaaggtaaaagactaaattcaagaattaggatgatagaggtatgcccaaaacaaaataaatgaaagcattcacaaaaaaaagaatgtttatcttaaaaggaaagagtagtaaactatttaagggactcacttaaaagtagaataaaccaacattatgaaaccaaagaaaaacataatctttcaaagaagattagaaataaatcccagcagcaataaaataaaatgggcactcacatgtatgggtttctaacaacagctaaaccccagctaaaacaatgttaaagccagtgctgaggtttccagcttgtaccccagaaggccttggtgacctcagggatgtcatagagggaaaacactgggacatttccctcctgaggaatgtaagcacagggtcagataagggtagagaagagagctacactcatctttgtctgcagaattcgggtgacgcgtcttactgtgcaagacttggcaccttgtgcattctggccccaaattgcatctccatccgtgtgttctgctatcctttcagaaatgggaagatatggtgggccctttagggccaagcatatccctgtctttgttcatggaggcctcttctcaaacagaatccctatgtcctgttcatgaaacactatttgcccctactatataattggcatttttttaagtgtcctattgtgttagagcttttccaagtcgcctctgatgtgtggactgactttctgcttcctgtgtctctgggagcttgaggcttctatccttctcattagtggagctccctaatgacattttaatgcaattattgtctcttgagtaagcctgagagcatgtaccgagtcttctctttctctttctctctttaactctcagcacagagctcagacggaaccttggattgaggaggttcatgaggcctcctgtagccagggaatatattttatttccctccagttaccaatatgaaggtttccaaacgttcatatcatattttaggccctaatcattaatattgagagccctaagcactccgatttgggtccatatctaaaggtgagttttaggggatctgactgagaagtgttccgggccagctccctagaaacccttgggtgcactgacttcttcctggccagtgtcgtctgcttggtcatcagtgtgttcctcccctcctgagttctctccatctttctgttcttctgttttcttgcagtaatcgaggacaggtggtcgctggcacacaaggatattaggaacccatgaggttgtcccttgtaggagaaaagactggagagaggccactgaatctcgttgtgtcattcaccctacctagtcctgctctgccagggtcatgctcaccttccagacccacccaacagtgaagtcggactgaaaaatcccagaagtgggaattgggagacaaggttgagtgcattagggggatgtctaggattccccctgattcgaatattttgtagctgttttgaggggtccttttcgcatccagaccaggatttcacctggacagctggagtgggaaagaagtggatacatttcaagctcctagggctgtagttaatgtgtcctgtcataaccactgcagaacagccagtgtaggtcagagaatgcaaccactggtggcatgtataacccttcaccaataaaccgaagtgcagtcccacaaacatgggagtcattcagctacaattagctttgctatggacaggaggaattaaaatttaataccgtagcaacagcaaaacatgattcgttctacagtgttagtggggatggtaacacaaggaaggttatgataaccaagtttctctgaaaaggtcaagtggatttcctcagtgggctatgtttctggaatataaggtaatggtgaataatagaggaaatctccctctaagaatgggaactctttaattcatctgcattagtcattcaataaaaataaattagcatacattttactggggacctatttagaggggtactatgaacagtagccataaataactcttgcataggaagaacgtgaattactctactttgtaaatattagtttgcaaaagtaattgtggttttgcaattacttttgaggaacgtaattcagtgggaagtaacttgcataattccaagttctgaagcagaggcagctgaaatatttgccattgcaatgaaaaggactttcctcccgggattcttccctagttcctggacaaggagatttgttaatatttgtagtacacttgagatctgcgactaaaagtgctttaggagagaaaagcatcacaagaagaaagggctttttgtttctttttaaaataaaataaatgcaatttctttcaccaaaaaaaaggcgaacattgctaagcataaatgagcacttccttttagaaatgaataaagtaaaactcaaccattagcaacttcccatagctagagctcgcagaggaaaatgttaacacatagcatcatgtttgaattttattattttcatagagaagaaaaccagcaagcaaaccccttctcttgagagaacagccttgaagtactcagaacagagagcatatgtatctattgaaataaaataaagtcacttttctccaggaaaatactatagatattttctcatggaaaaaatagactagacctatgggtctaaatatgtaaacataaagagagatcacactatttattcaagtactgtgctatctcaagacacccagccatgctgctaagaaggcgcattataaagaagcatcaaacattctgcagtttcaaaaagtgaaacgtatatttgcttgaatgttcatctaaacactacccataggaaaattcaaacgaaactccagggaattttaatccacatgccacattttcttagtcttttgcaagatagagtcagaggattacattttctgaaaaccgctttttaaaaagcttaagccctaatcagttaagtgtgacaaaggcttgaaatgggatttggtagcaagtaattaaggatgaagtacaagtgggtatatattgacagtggacccatgctattgtcctgaaattgtcagcggggagtttattctttatttgacattgtttatttgacccagagcattgctttgaagatatcaattgctatggaacaaactgctcccaaacttagtggcttaaaaaaacagcaccattgtatttgttcttgattctgtgggctagggatttgggtcagccttggcttggcggttttggtcttcagagcatccctagggccctctcataaggttgcagtcagacctgagatgaggtcactcccttatatggcccctgggtggatgcagctaggaggttgagattcccccaccccgtcttcctccatatgtggccccaaagtaggaagttcctgctgctttggtctttgggtgaaaaacaggtcacgggccaggcaagatcaaggaggggcagcagagggcacttctgggcgagcagtacagtggcatcgcagaaggacaggtgggagggaaagggataggctgcagcagctgcctttgaaaacgccatcgagcaatagtattgcagccatttataccataatatttcctacagaggacctcgtttagtttccgagattgagcctctagtctcgctcttcacaccgctgaagatgtgcggtagaggatcttgctgaaacgaaaatgattgctgcactcccctgcaaagctctttggttactccatatcacctgcaaaatagaatcccgaatctttgcggggcccgtgagttcttcccagcctgtgccctgcctgccagactcaggtttcccttgggtccttgagcacctcgtagctccccagaagcctcttgcattttacagctctgcacctgatcccaggcctgagtgcacttcctcacgctcacatcgttactttgctaacccctgagacctcacctcctctgcaaaggcccccacgggctgtgtcaaggtgtccctcctctgcgtgccctggcatgctgtgcacatggacagctcagcagcactaacacacccttcctccctccccaactgcactgtgagctcccaagggcaggctctgcatctctttgtctgtctagcccctagccctcggcttgagcagagagtcccacacatagcaagtgctcagtaaattttggtggaatgtcagctcagtataggtaaatgacagagtggaggagtgtcggagggaaaagaccagaaaaccctgtacaggaagaaggcggtgtgatcccatggagagttggagcctggggaggcaggaagaggaggaacaaagcggtgggcttagactgcaattggaggctgagagcactctaggtagtcaagagacgcgaacaagcatagaaagtaaagcagaaaatctgattcgatgtaagagaaatcgaggcatgtgtcatggtgaggggcttatagggaagaggcagtgacaaggtaggagagatggcccaacatcaggacgggccatggagacctgtccccatggggagagccctgacctggactcagaaggcagggcacccagaatcccacccacgcacctccagacatgcagtagagctcagtcatagtaggcatgcagtagacctccctgtcaccgagaagaggaggagaggcactgggcaaagtgaggttgctgcttccgggactcttggaactgtgagacttacgctctgaaatcctagctgtcacttacttcactttcgactgaatatcttcactcttgagccaaagtgattgcatgcctttaaagtgaaactgtgcgctgggatctagttgacaagggacaggggctattgttttgttgggggaggggaggtggcagctgagagccaaccaaggaagcccaccttgaaagaatccatagccttttttcaacaaaaaaactaaaaagtaatcactacagaaaatattttagtgctaaatcttggaagaaaacatgatgagtgttcttttgactctgagtatataataattatagctaacatagactgagctttttctgtctactagtaactgttctaatcactttgcatccattaacccatttaatcctattatgatcctcatttttcagataagaaaagtgaggttaaatagcttgtttaaagccacagagctaccatacagcagaactggaatttgaactcaagcagtttgatgccatgatctgtgttcttaatactccatgtagcaaagcctgattttgggactataccttatctactgacttatgtttaaaaatactacctgacattggagttaattctgagaagtgggttttgagacttccttctccctttatatctcaattactgtttggggctatttccttgttttgctgtccaatgtattacttatgttagtaatggagagaacactcactctggttgagcataatcatcaagccgggagctctgctaagatccagtcggcttggctgggttcttctccaggcattctctgctgggccctgaagcgtgcgtctctctgctgaagcatgtgaacattcctcctggtgtttagagagatttggaaaaggctgaaaaaccgcatggaactccggaagttgttgtcttttcagggaaaacttgtgagggagacaggagatggccacagtggttttctttggggtccagcactgaccggggcatttatgaggctgccctgcaggagaaccacacagatgagttcatagacaagcctgagtgggcttctccttcgttcttccttacccacgagcgtccacctcaatccctctctctttcctttccggtatctccagatgccaggtccgtggctcaatgtatttccttcctaccagcattattttgaactgacaatgttgtaaattttaaactatattttaagtaaaccttaaaagcttattttagaatcctaatctgctttttcagacttttattcacctcagatctccaactccctttactttttgcttgaactctcctcccttcttcctgctttcctcaactctttcatgctgtgtttaataacatgctaaacacattaaaaacagcaagttctatcatatcaacatacatgcccacacccacacacatacgtactgacgactgtcacttgcaaagagctgttaagaagaaagtttgtttaattaaaaaccagcgagaatggtggccagattaacattcttgagtcataacttggaggtttgaacttcaactttatggagccgttctgagaatttaaaaaagtaatctattctgtcatactgtgagatctacataaattattttttggcataggcctttgtaactttttaattgacttttgagtcagtgtgtttctgtgtatgtaaatcaattgtaggttcacgtcaaatttctgattgtctcagatatgtattgtttagtaatatttgacagggtcctgaagcacaagattccaaaaagttcaaaaagatacccttattcaaggaaacatttctttttttcttgtttctttttttttttttttttttttttttttgagacagggtctcactctggtggtccaggctggagtacagcacaatctcagctcaatgtaggctgcacctcccaggctcaggtgatcctcccacctcagcctcctgagtagctaggattacaggtgcacaccaccacacccagctaactttttgtatttttagtagagacacagtttcgctgtgttgcccaggctagcctcaaacccttggactcaagcaatctgcctgtcttggcctcccagagtgctgggattacaggtatgagcacccagcctcaaggaagaattttttagtcagcaatttgaaaagaataaatttttttttttttttgaaatggagtctccctctgtcgcccaggctggagtgcagtggtgcaatctcggctcactgcaaactccacctcccaggcttatgccgttctcctgcctcagcctcctgagtagctgggtctacaggtgcccaccaccacgcctggctaattttttgtatttttagtgaagatggggtttcactgtgttagccaggatggtcttgatgtcctgacctcgtgatccacccgcctcggcctcccaaagcgctgggattacagacatgagacaccgcgcctggcctcaaaagaataatttttaaaatttcaagaaacctatactttgttttggcttggtttctaaaatagaaaataaaatggattatttatatttgaccaaatagacacattttcagaggctgaacaattcactgagtatgtaagcattaggcctgaaaatgaatacggagaaaaattagaatagccacgaagtgcagcatatccgtgaaacactatctcaggggcggagacaaagtcgccacactttctacgggttcattttgtcctgatggttccatgatgcgctgcctcccagccagtgtttgcagaaggtttttagattcagtcatggaggggaagaagaagctgtgaaaaccaaaaacagcacagaggggtttctttctccttccagtaggcttcccagcaaatcaaggatgactgcctgtagcacgccgctcctcacctagtctcaaaatactccagaaagttctccctacaccttattctatccagcacctgaaatgctgtcagctaggatcttaggggacacagatcctcttaaaaatgcaagcactgctgagattcccttcacccattagggtggcttaggcagtaacaaagagaaaatggatattttcaaggagaaggggaaagctgggttttattcagtcactaaatgttgactgatcaaacacctaacatgtcagggctttttctgggcgtttaaaatacaggggagaagagaaggagaaaggtactgaccctcgtcaagcctatgcctacttttttttggagtagaaagacaatagctaagtaaataacacacaaataaggtaaagtcaggcacctcaaatacagtgacttgaccactacacattctgtgtacgtaacgaaataccacatgtgccccataaatatgcaaaatatgatgtatcaataaaaacaaacacacacacacaaaactcaaagaacaataaaacaaagacggtgaagaggtaaagagaatttctagaacctggcctgtttttagattattaaatgtttccttttttgatggagagtgaagaaaaatatctgatattgtacttgctgccacaaaatcatggttaacagaaaaagatacaggccaggcacggtggctcacacctgtaatctcagcactttgggaggccgaggcaggcagatcacctgaggtcaggagttcgagaccatcctggccaacttggcgaaatcccatctctactaaaaatataaaaattagctgggtgtggtggtggatgcctgtagtcccagctactcaggaggctgaggcaggagaatctcttgaacccaggaggtggaaattgcagtgagccgaaactgccactgcactccagcctgggtggcagagcgagactatctcaaaagaaaaaaaattacaaaggagtcactagatgatctagaaaaaggcatgtccctccttccctggcccaaacaatgcacagctcttatctgccccagtcctcaagggctgggaccagggctcttttattacccagaagttcctttgccagttcttttcctggcacctagttggtgactaatgaatatttcttcctagtgagcgtagtataaggtatctgactgtggtcatttatgttcctaatgaggatacgtaacttttctttttaaaccttaactttttattgcctattgctgaaatgttagcagataggccaatgagtagaaagaaccccaagaattgcctgattaattcccactcatgcagcccaggcccaagctctcaccttctgccctgcttttaacggcagcacatgtcaccgctgacgggacctgcctctctgcgcgtgaccatgcacttgggactctctaaatgtctcaccggagaatcaatagccctagttcagctctgaatgaagtttctcgtcgcccccttctcttacaccctaaggataaagactgtctctgagaattttccccaaatcttcctaacatagagataaaaatagtaaaataagaaattagacccctcaacttcaactttaaaatcttatttctcttcctgcatcacggtgaccacctcctcacaagtgcaagaatagatgacgatattccagcatgctgtgattctcctaaaaacctgctgctcctagggactctgtggagtgagtttcctggaccgaagtcacttctcagatcttcatgttacacccatgatgtttgcttgctaaaccatcagcttaagttatttatcctgtatcttttatctcagttttctggttgcattttatctgtgtcatctttactttagtcaagctaacgctgtggttttgcaaattaaatcagctgtgggtttcagtatgtaactcctctttgtgtttactaagccttttttaaaaaaaacaaaatagtactgtatgtctgtttacatctttagtagtgtgtaagggaagattgttttctttagagttcttttgaacaatttcaaggctattcagaaggatccattttaagaaaccaaaacatctttttaaaatgccttgtttaatatatatctttagccataatggaatccccttaaaattttgaagttgatctgtaataaagaggttgtgtgggtcatgagtctggactttatagttcagacaaagagaatctgcttcatgtttcaaagcaaggaagagatttttttaaaagacagctcacatggcccgtgtaggggtggaaaaggcagcgtgaaagagcaaggggataagtaattaaacatctattggaatcatgaaattattaagagaaaatgtctgaagttccagagctaaaagactgaagagcagtgatgaaatgcaacaaaaataaccagaaaaatccatgggacttgttgcgtagatggttggaggagatgaagatgaaggagaactcagctggttccaatatttctagcttggaagactcagtaagtggtaattccattgatcaagacaggacagagaggagaggtacagacactggaaaaagtagaattcatgtttgtttcagttgtgtttgaggggctggtggaacatcacctggaaaggtccaatatggagttgaatacaggggaccgaagaaagtgaatgtatagttcaagaaagatattctttttgaggctactactaggtagagggtcataggagccatcaaaatagatgagattgaccagaaatgttggtttaaaaaaaagggggaggaaagtcaaaatgtattccaaaatagttaggtaaagaagtgaaaccaacagaataagctgaagagtgagctgagagggaaggagagcaggagagaagaagggagtcgacagtgtcctgtgcagtgtcaaggaggaagaccaagaaattgaattaaaatacaattgatagtacagagttacatttggtatagagaaaggtctctggaacaaaaggaagaaggtctctggttgaggaggaagaccatttccagccgcagggtctggaaatgaccaagtcatcagcgctcttgcagggagcaagatagatccacagagtgctggctggaggaatccatatggcagagggcagagaagcgaatggaaggggaggaagcaaagatggttcaggaagctggttggtgaaggaagggaggtaaggccatagcagcgggagaagccacggcagaagttgttagaggttgcaaaaccggagggtgtttataagcgggagtgggagacaggcagaaatcacaagaatggcaaggggttaaagaaaagaacaattccaagagtgtgtacagggttaggatcatgtatgcatgaggcattcagggaagaactagatggagactgggataagttgaaccagagcgaaggaagttgagccatttatgtcttgcggcttccagtttttccttaaaattaacaagctcatctgccgaggtggagaaggcagagtcatggttttggagacataaggggaacaagtgtgggacagcccgtttaggaaattggaaaataaacaggccaggaataagatcaaaaataaagccaagattgttggcaaattcagcaataaatcaaatgcttacataattcattgttttttattgtagtgaaaataaacataaaatttacaattttaaccactttaagtgtaaagtgcagtggcattaattagattcatgactgtttccagaacgttttcatgacccaagcagaagctctgtacccagtaagcagtaactctccatttccctctcctttcagtcccaggccacccccttctactctttgtctctatgaatttgcctcttccaggtagctcatattaagtgttgctttttttttttttttttttttcccaagacagggtcttgctttgttgctcaggctggagtgcagtggtgcaattacagctcactgtagcctctaactcctgggctcaaacattcctcccaccttaccctcttgagtagctaggactacaagcgtatgccactgcacccagctggtttcttaaattttttgtagagatgtgagttttgctatgttgcccaggctggtctctaacccctggcctcaagtgatcctcctatctcagcctcccaaagtgctgggattacaggcatgagccctcatgctaacctatttgttgcttttaaagcattaatcatgggataagaaaaaggaataagttattcttctgctgtataacactctgtaaatgaagaggtcattcctaaaccatatcctggttttgttgttgttgttgtttgttggttttttgaggcagagtctcgctctgttacccaggcttcagtgcagtggcacgatctcagctcactgcaacctctgcctcccggtttcaagcgattctcctgcatcagcttccccagtagttgagattacaggcatccaccaccaccccagctaatttttgtttttttagtagagacgtggttttgccatgttagttaggctagacttgaactcctgatctcaagtgatctgcccacctttgcctcccaaagttctgggattacagatgtgagctaccgtgcccacctggcccataccctgtttttttttaaatccaccatgtggtatccatttataaaaccttattattaatacaatgctatgaaattgatataatgctttacccttaaagtgattcaaatcagctgaagctttgaacctctctaaatcctactttgaattaaatattttctttatcatacgcatacacaacaatgaatgtcttttttcccccatccaaatgatagcacagaattgtgaatctgtttctgtttagtgttctcttccagaggattgcattattcactgaatgtctgttgtctgaaatagaagttcccacagtagtttgtgtacgcatcatttaggaagataagtggtttttcctgttatgtatacaaataaccagtctgtgttaatgtctattatgggtgacatgaacagatccttctcgaggaggtttacatgtgtcactatagcattagatcttttttttttttaacttttattttagatacagggagtatattacatgatactgaggtttagggtgcgattgatcccatcacccaggaactgagcatagtacccaatagttagtttttcaaccctagaccccccccctcccacctttacttgtccccagtatctatcgttgccatctttatgtccatgagtacccaatatttagctcccacttctaagtgagaatatgcattatttgattatctgttcctgcattcaccacttaggatcatagcctctagctgcaatcatgttgctgcaaaggacatgattccattcttttttgtggctgtatagtgttccatggtgtctatgtactacattttccttatgagcatctaggttgactccatgtctttgctgttgttaatggtgttgccacgaacatagatatgcgtgtgtctttttggtagggtgatttattttcttttggatatatacccagtgatggaattgcaggttcaaatggtagttctgttttagattctttgtagacttagtaatttttaatggaaatgaattatcttcccaatgaaagtaaattctaataaaagacttattgaaagaaatgtctgatattgggatcattttcctaacacaatttccattttcattttctgtaaagcccccacaagagttgacagagttcctgaggtggcgatgagtgagccgtgcctctttctacagtggatgtagtggatgtggcttacagatgccttttacatttccagctgtagacagaaaatgccagaggccacagcatttccccaggccctgaaactaagctaacaccctctaaatattgccaaatcaaagtaatagaaaggaaaactgttctcatattgtctcacttccccaaacatatctcccctaattcagttccaaccacactttaattcccagtttggacccccatttttctcctgaaactactgctggagagttctctctcttcggagttgcagttccttctgcaacgttgcatggactttggtaccaactggccttggttgctttgtatatgagtcctgtatcccaaggagactataatcttcctgacggtcgtgggtttcaattcctagaatcacgaaatagcagcactttacagatgagaacattagacccagagaggtaaagtaacttgcctaaggtcacacagctgaattcagcaaacaggtgaattagtctttcttccctacttgaactactacttgaatgagtgctccgagacttgatgtctgcgacactctgtttttttttactgtttccactgcacttttttgttctagagacctttctccataccaaatataattctgtactatcaattatattttaatgtataaaattatagtcacatttcaggtcctgcctcccagggataaccttgactaaagttttaggtgctcagaaataatttagtgacacatttatagattttaaagtttggtaagaaatttggaagtaactgccaaagttgaagatatgtgcataccgcaactttgtaggtctattgctttgcatgtattctatcgaaactctcaaatatgttcccaaggaggtatctacaaggatgttcacagcagcatgagttataagaaagtggaggagaaggaggaggaaggaagaagaaggaaaaaaaggaaaagatgaaacatcaatagaagaaaagatggatagcatatttctttcttcttcttcttcttttgtttgtttgttttttttttttttttttttttttttttgagacagggtcttgctctgtcacccaggctggagtgcagtggcactatctcggctctctgcaacctccacctccagggctcaggtgatcctcccacctcagcctcctgagtacctggggccacaggaacacactaccatgcccagctaatttttgtatttttagtagaggcaggattttgctatgttgcccaggctggtctcaaagtcctgagctcaagcgatctgcctgcctcgtatgtctattccgatggaatctgcagcagtggttctcaaagtgtggtccaggagatcattaaaaccttttcagggagtttgcaaagtcaaaactgatttcacagtattactgaggtctatttttccttttcactctcattctgtaccttgaagttttccagagactgcatgttctgatagccacaggctaaacgcagaaactgtcttctattaaaccagacattaaagagatcacaaaagtgtcaaacagtgccactttttttcaatgttttttgctttgaaaaacataattatttatcataaaatatgttgtcttcacgtattacatgataggttttcattatttttaattaaaaaaaaattttaatttttctccttcttattttctgatgtggtaaatattgacagatataatccctataaaccaaagctctttgtttttctcacaatttttaagagaataaaataattcttagagtaaaaagtttggttgggtgcagcgactcacacctgtgatcccagcactttgggaggccaaggcaggaggatcacttgaggtcaggagtttgagactggcctgagcaacctagtgagaccctgtgtctacaaaaaataaaaaagaaactagctgggtgtggtggtgcatgcctgcagtgtaactagttgggacactgaaggggaggatcacttgaacccaagaggtggaggccgcagtgagctgtgattacaccactgcactccagcctgggcaacagagcaagactctgtctagaaagacaaaaaaaaaaaaaaaagactaacaggtttgagccctgctgttgcagacagtgagaatgaatgaatggagactgcacgcactgagcctgaatcttggaggcacgatcactggagttgcaggagaatataaacagtgatttatattgtgttttataactagtaaaacatgctgtatgcagaatacatgtttttaggaatatacaggtatataaaacatgtataaaaagttatttttatatttgtgtatatctgaaacactttataatacacttgaaaaactataaatagctatataagctcaacaaccacaaaaaaaattagaaaatgaacaaaagacttgagtagacatttcctcaaagaagatatacagatagccaacaagcatatgaaaaaaagttcactatcagtgatcattagagaaatgcaaatcaaaaccacaatgagatacagtctcacaccagtccgaatggctattactgaaaagccaaagaataacagatgctggcaaggttgtggagaaaatggaatgcttatacactgttggtaggagtgtaaaccagttcaaccattgtggaaagcagtatggtgattcctcaaagagctaaaaacagagctaccattcgacccaggaatcccattactgggtacataaccgaaggaatagaaatcgttctatcataaagacacacgcacgtgtgtgttcactgcagcactatttgcaatagcaaagacatggaatcaacctaaatgtccatcagtggtagatagataaagaaaatgtgggctgggcgtggtggctcacacctgtaatcccagcactttgggaggccgaggcaggcggatcacaaggtcaggagatcgagaccatcctggttaacatggtgaaaccccgtctctactaaaaatacaaaatattagccgggtgtggtggcaggcacctgtagtcccagctactcaggaggctgaggcaggagaatggcatgaacccaggaggcggagcttgcagtgagctgagatggtgcactccaggcactccagcctgggtgacagagtgagactccatctcaaaaaaaaaaaaagaaaaaaaaaagaaaatgtggtacatatgcaccatggaatactatgcagacacaaaaatgcatgagaccaggacttttgcagaaacgtggatggagctggaggccattatccttagcaaactaacacagaaacagaaaaccaaatgtggcatgttctcacttataagtgggagctaaattatgagaacacatggactcaaagaggggaacaacacacactggggcctgtcagagggtggagggtgacagtagagagaagatcagaaaaaaataactattaggtaccaggcttagtacctgggtgatgaaataatctgtacaacaaacccccgtggcacaagtttacctgtataacaaacctgcaggcgtacccctgaacctaaaataaacatttaaaaaaaagagaagatgctcaacattacttaccattagcaaatacaaattataatcccattagagaagtgcaaatcaaaggagatattgccttgaacccattaggatggctagatcaaaaaacaaaaaataacaagtgttggtgaagacgtggagagttggagcctttttgcacttttgctgggaatgtaaaatggtatagctgctatgggaatcagtacggtggttcctcaaaaacttagaatgactgcatgatccagcaattctaccctgagtatatattcaaaggaattgaaagcagggtcttgaagagatatttacacacccacatcgattagcagcaggattctcaatagccaagaggtggagacgacccacatatccatcaacagatgaatggatgaacaaaatatgctacaaacatgcaatggaggctgggcacagtggttcatgcccataatcccagcactttgggaggctgaggcaggctgatcacttgaggccaggagtttgagaccagcctggccaacatggcaaaatcccatctttactaaacatataaaaattagccgggcatggtggcatgtgcctgtaatcccagctactcaggtggcggaggcatgagaatagtttgaatctgggaggtggaggctgcagtgagccaaggtcataccgctgcactccaggctgggcggcagagtgagactccatctcagaaaaaaaagtgcaatgggatattagactattagccttaaaaaggaaataaattccttcacatgctgtcatgtggatgaactttgaggaaattatgttaggtgaaataagccagatacaaaagaacagatattgcccgttctacctatgagaagtatctcaagtagtcaaattcacagaaacgggaagtagaacggagattgcagggcttgtggaaagggagaatggggagttattgtttaatgggtgcagaatttcagacttgcaagatgtaaaagttctggagatgaatgcccaacaatgtgaatatacagaacactgctgaactatacattgaaaatgattaagatggtgaatttcagccgggcgcggtggctcacgcctgtaatcccagcactttgggaggccgaggtggccagattaccagaggtcaggagtttgagaccagcctggccaacatggggagagcgctgtctctactaaaaatacaaaaattagccgggcatggtggcaaacacctgtaatctcagctactcgggaggctgaggcgggagaatttcttgagcctgggaggtggagattgcagtgagccaagatcatgccattgcactccagcctagcctggcagacagagtgagactctgtctcaaaaaaaaaaaaaaaaaaagatgaattttatgttatgtgctttttaccatgataagaaaagctacataattgcagtttttgtcattacttttaatggcaaaaattgcaattacttttgtaccaacctagtaatcgctatgacaaacctttgtatgatgggggaattttctgattccctgccctcactccagttatcataaaaataagtcgactgtttctgaatttcccaagtgagtatcttgcccagacttcttgctttagtccagtctttgatgttggctcatatgaagcattctgcccttccagaatatcccgtacttcctccctatctacataaattctacccaagggaactctaatgaatcccattgcagcatgcccaactccatactgctttctccatgatacagtcagaagccaacccagggcacttggattcctcttgccttaaggacccaggacacttattttgtgtacaactagatgttcattacttatatggccccatgtactgcttcttaagttttcagagctgttccatcgctcccattagaatgtaagcccttggaaaacagaggtcctaataacacaacatggcttatacgtgcctgcctcagagctttggcatatggctgtcacacaataagactggtgaatgaatggataaatggatcatggatggatcaatgtggtctttcactgtagctgagctggatgcattaagaattaagtataacatcttctttttttattttattattattatactttaagttttagggtacatgtgcaccatgtgcagtttgttacatatgtatacgtgtgccatgttggtgtgctgcacccattaactggtcatttagcattagttatatctcctaaagctatccctcccccctccccccaccccacaacagtccccagagtgtgatgttccccttcctatgtccatgtgttctcattgttcaattcccacctatgagtgagaacatgcagtgtttggttttttgttcttgccatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgagaaatcgccacactgacttccacaatggttgaactagttgacagtcccaccaacagtgtaaaagtgttcctatttctccacatcctctccagcacctgttgtttcctgaccttttaatgattgccattctaactggtgtgagatggtatctcattgtggttttgatttgcatttctctgatggccagtgatgatgagcattttttcatgtgtcttttggctgcataaatgtcttcttttgagaagtgtctgctcatatccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaacgttgaagtctttaatccatcttgaattaatttttgtataaggtgtaaggaagggatccagtttcagctttctacatatggctagccagttttcccagcaccatttattaaatagggaatcctttcctcattgcttgtttttctcaggtttgtcaaagatcagatagttgtagatatgtggccttatttctgagggctctgttctgttccattgatctatatctctgttttggtaccagtaccatgctgttttggttactgtagcctgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcgtccatttgtttgtatcctcttttatttcattgagcagtggtttgtagtcctccttgaagaggtccttcacgtcccttgtaagttggattcccacaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcgtataaacagaaccaaagacaaaaaccacatgattatctcaatagattcagaaaaggcctttgacaaaattcaacaacgcttcatgctaaaaactctcaataaattaggtattgatgggacgtatctcaaaataataagagctatctatgacagacccacagccaatatcatacagaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgactgtatatctagaaaactccatcgtctcagcccaaaatctccttaagctggtaagcaacttcagcaaagtctcaggatacgaaatcaatgtacaaaaatcacaagcattcttatacaccaataccagacagagagccaaatcatgagtgaactcccattcacaattgcttcaaagagagtaaaatacctaagtataacaccttctttgaactaatgtagcttccacatggctaagctttgtgtatattccttgcaccacgctgaaatttcctttcctctgcaacctcatcttgctctaccccaaggggcacttctactgtaaacctggatggtgtgtggagtgaggcagtcctgactcccctaccctaatcccactggcaccccattttactgccctttttgttttaagacgcttactattaattgatacacaaaaacaggaggcaggtaacaaaaataataaacatcagggcctgtacaccatcatgagtaacacctaacatttgcagttagatatctctgagctcagttccccaccatcccacttactagctgtaggtcctcggacaattcacttgaactctttcttttgttgttgtgctagaatacgcgtaacacaaaatttaccatgtgaaccttttttttttctcgttttcctgagatggagttttgctatgtcccccaggctggagtgcagtggcacaatctcagctcactgcaacctccacctcctgggttcaagcgattctccccgcctcagcctcccgaatagctgggattacaggcacacaccaccacacctggctaatttttgtatttttagtagtttcaccatgtttgccaggctggtctcgaactcctcaccttgtgatctgcctgcctcagcctcccaaagtgctgggattgcaggcatgagccaccgtgcctggcctgaaccaatttgaagtgtacggttcagggacatgagaacattcacagtattatgcaaccatcgccaccacgcatctccagaaccttttcatcatcccaaactgagactctgtccccatcaagcatgaattccccatttccccccttccaagttcccgggagccacaattctaccctcagtgtctgtgaatgtgactcctctagggactcatttcagtggaactgtttaacatttgtcccttggtgtctggcttctttcaccgagcataatgtccccaagtttcctccatgttgtagcaggtgtcaccacgtccttcctttttcagcctcaagaatattccagtttaacctttgaaagcctccattgcctcttctgtaaaatcggatcagtaggccatttttcaaaggttgttgtgaggatttaataaaatcaggtaaagcaacagacagcgcccagtgcagtgctttgagccatgataaaaattaatttagcctccttctcttccctttctaaatgataagttacatgaagaccaggtgcaagaaaaatgcctttctcatgtccgtggttcctgaagtcacacatttgtgagtgctcagtaattaatattatttttaactgaattggataatcttcttatttagcaagttagagattaactcccagagtcccagtatcgtaaaaataaaaatgttacattcacattttcccgctatttttcccctatagattaaaaaaaaaaaaaacagaaaggaaataatagcagactttgtcactcaggaaaagaaagagttgacttaagacaatgtgggtctgggcgcagtggctcacgcctgtaatcccagcactttgggaggccgaggcaggcggatcatgaggtcaggagttcgagagcagcctggccaatatggtgaaacactgtctctactaaaaatataaaaatttagccaggtgcggtggtacgtgcctgttgtcccagttacttgggaggctgaggcaggagaatctcttaaacccaggaggtggaggttgcagtgagcctggatcatgccactgcactccagcctatgcgatagaaagagactcctcaaaaaaaaaaaaaaagagtgtggggtaggatctccaactgcttaggcgagagaggaggttaaacagtcatcacacaaattcagattctaagggcaggtgaatgaatagaaccaataagtgaagacccagtttccagttatctccatttatcaatgtccttggcctaagtcaattagagttaatcactgtggagttaattacagtgtctctccttgccgttaacaatatattctgtggtcatcgcattattagaatgggcaaattggttcttcagttgacagtgtgaccaggtcattaaacagacaaatctccccgatgaaaaaccttgagcgatgttgattttggtggaaacataaagccatccacaaaccatcctttccaggatggatgtcaggtagtgggaattaagctcaaaactgtgactcacaaacagtttaacttccttcaggttgattttccccattggtaaaattcccatgaatattctacataaccctttgattcttccaacatcgtttttcccaaacatctttcctgagagctcttcaaaagatggtaaaggtaccatagtaagatacatgatgtaatgaacttgacctcgctgaggggaaaatggccatggtagcctgcttggaagaaatatgcaaaccatctgagaaagagacagctctctcagtgtcgtggggttggaggtcatgtctttccttttcacaacaggaagggctggcaccttctgctctttcggtcctgacaactgtctgctcagagcatcagccaaacaaggccctgtcatcccagccaggaaggatgcgcggtgcatgggagtggcaggacatttgtggaaggagtacagccgaccccccagtttcctccagtccttgtccccaggctggggttccttccagcacttgcagttcagccctgctcagcgtgtttctctggaaaacagaaccgtgggccttgtcagcaacctgctgtgtgagttgggttgtgtgtttgatcatcgaggacagtgtttcagcatctggaggtgtgtgtttgctttccttaggtaaccacaaagtagtggttagcgtctctctaattgataagggtgacagaagctgctgctggctttagaatgatgcctgaactcttcttctgaaaatgaatgtggttaatttagtcatgacagacacatttctgacttcttcctccctccttttttccccaacgccacctttccccatggtgttgtgtttttgcttttgtttttgtttttgttttcctctgtctggagactgaaagagaccagactgcgctcagctgaaagctaagggaagcctgtgctgctccgccagggctgagtattttgttttcagctccgcgaactccacctgtgtgactttttcttcctttctttttaaaagtaaacatggcaggatgtgtgctcaccaattactgagcgcacagaaatacaggaactgctgggctaacgaacacgacttcaaaggacagtggtgaggagcccttgcctccctgccaggcttgaaagggctgagctctccagggagggcagggcccaccctcagggctccaccaaaatagtgacttcccagcctgtgactttcttagagccctgaggaaggactcaacgcagggaaaggacgtgatggcagtggggattccctcttgctttgagcccttctgaatgcaagcagaaaaagaaacccttttatattactttttaattgaatataataacagaaacaatgaaaagaatgtgaccttgactttgcaactctatttcccaggcatattcctaacaacacctaagaaagctaggatgtaggtagcttttatcaccttcgttctttttaggtaatgagttagaagcacaaagcaggcaagagacctcgtaacgtcaaatttaatattaagctgatcttctgatggcccaggacatacccctgggtgctagaatctaacacggagacatggatggtgacgggtacctagtgatccagctgttgaactacacacaattctgctgttgtccccgagggagaactgttcactctgaagctgcagatgctgtgttatagggtgttaaagtctctacagtttctatcaatgctgttgcattcatgttttattgcttctgccaaaatacgagtatttcaaggatgaagttcatgttctcccaccagctcttgtctaaaatccatgctcaatgagtatttactgtatgcaggttattactgaagagaggacttatgtgttcttcccatgacatcagaatgcaaggatatttctccaagagagcaggcttctatctgcaaatgcattcacctgaggatagtggtgagacagccactgagcctggcaagtcagcaccactccaggttgttgggctgaaaatagactagagagagtaatctctaggccctcattttataggcaaagaagctgaaacccacagagggtaagcagtttccccatgtttactctgtccttcattgagctttgtattggcttcgttgctcttagtgaaaacacaaggactggccacagttagagccggggtccatgtgtgcatcccaggcttctgcctctgacagagttgaggaacgtgttgagaaggtgtggttgctttccttgaccttaaacttaaatagcgcagaattgctttgggctcagcgttttaatcatgtcacataaaaatcagatgctatccacagagaagaaaaaaaatcatttgaaatgtgcatatgaatatttattagagaaagagtaaagagtagatattacttcatatggaaacgaggaggcttggaggtggctttaatatgcagcatcagtaagaatcaatgcaaagagaatgctatctagcaattttaaatgttcactcaaagagaaatgggcttgaattatagcaggaggattcctgtttagttgttaaaaaaaagataaaaagtaatcagtaggtctcaacatggacttactaaattcatgccagattcacctagtttccatttttgtagagtccccagactaatgaattattagaccagtgagagaacatgatttcaatgagatatctaacaaaatggctcataacactcctattagaaacgtgaaaagtacctagtgggcacctagggggcaacaattccttcagatccaggaaaagggggtctttaggggcaggtcatagaattcggtactggattctgccctagtcatcagcatttctagaaataaatgtccttaagatttagaagttaggccagatttatagcagaccacacaaaactcaaagggtcagtagaatgcagaatcaaaatgatcatgtagactgaaaaactaggccaacgccaaattcagatctgactttggcaaaagcctttacgcagagtcaacagcttaactggtccagggccaggtggggaaatcatgagaacattatgatgaacaggactccggggttttagttagttgacatttctatctgagttggcagtagaatgtaacgtctgcaaaagtcagttcattcatggtctgcatttatggaccttcagtgcatctagaacttttaccttctgcttatcaaatagtatctggaaatactgattattctggatatgcattgtaatgatattgacactcatgaaaagatgctcaacacccttccttagtagggaaatacaacacaaatcaataagctctgcttcacacccattaggatggctattaccaaaaaaagggaaggtggtgttggtgaggctgtgaagatgtgggaccttcttgaattgctggtggacatgtgaagtggtacagactctgaggaaaacagtgcagtgattcctcaaaaagttaaacagagttaccacatgatctagcaattccattcctgggtattctcaaaatagttgaaaatgaggactgagatacttgtacactaaactccgtggcagcattattcaccatggccaaaaactagaaacagcccaaatgttcatcagcagaggaacaaacaaacaaaatggggcatattcatacaatggaatatcactcatccttaaaaaggcatgaaactttctgacacctgctacgacacagatgaaccttaaaaacatgatgctaagtgagatgatccagaaacaaaggacaaatacgctaagactccacttatacgaggttcctagagtagtcaaatttataggcatagaaagtagacgagcagttatcaggggctggtgagtgggaggaatggggcgttagtgttgaatggggacagagtttgagtttgggaagataaaatagttctggagatggatggtggtgatggttgcacaacaatgtgaatgtatgaatgtcactgaactatacaattaaaaatggctagcatgatacattttatattgtatatattttaccacaataaaaaggttattaaacatagactgagtatcctggcagcaagaactagtacaaaaagcaaactgacaaactttgtgtgtctgggcaaagatgatcaagaccataggtctagaaactctgacaaagaaagataactaaaggaatttagttatcatttactgtcaagaagaacaggcagaagagggtgctggccacccttaattagttgaagggatttcctgtggcagaggcattacatgaattccacttattcagagtaaccagagggcagaatcaggaccaatggaagaaattatatccaaggaggtaaatttcagtgcaggaaagaactttcagccaattagaactatattttgaaaagaagcaggggcactgctaaatgcacaactgagtgttcacagtatactcaagaaagacattttatgcaatttgtgatgcagagtgctgcgctgatgagttctctaaagcagcggtccctaacctttttggcaccagggaccagttttgtagaagcctatttttccacagactggggtggggaatggtttcaggatgattcaagcacattacattaattgtccactctatttctattattattacattgtaacatataatgaaataattacaactcaccatcatgtagaatgagtgggagccctgagcttgttttcctgcaactagatggtcccatctgggggtaatgggagacagtgacaggtcctcaggcattagattctcataaggagtgtgcaacctagatctctcacttgcgcagttcatgatagggtttctgctcctgtgaaactctaatgctgtggctgatctgacaggaggcggggctcaggcaggaacggtcactcaccgcctgctgtgcaccccagttcctaacaggccacggaccaccactggtccatggcctgggggctggaggacccctgctctaaagggtcaacataggtgaatttagaaaagtcagcatcctccaagttctcagaaacattctccgattcactgatgagtcgtgaaaatatagtgaggcagaatgttagggccaacagaaaggaaagtagggctctagggattacagtcaccaaggtttctacccttgtgcaagagaaccatcacttaatacttagtcatgtcattttcaattattaaaaataaattcatcacgcctgtaatcccagtactttgggaggctgagatgggcagattgcctgagctcaggaattcaagaccagcctgggcaacatggtaaaaccccatctctactaaaatacaaaaaattagctgggcgtggtggggcgcacctgtagtcccagctactccggagggtgaggcaggagaattgcttgaacctgggaggtggaggttgcagtgaactgggtgacagagcgagactccatctacaaaataaataaatgaataaataaattcaaagtccttcatttctagagagtatggaaataggtaaaagtcaacagcttaaaatctgaactaggaaaatcagtcttattccaactccgactttccagagtccatgaccagctggcactaggacaactctggcagacttatgtcactttggtgacgtcaatgtgacatcacagccaagcaaggaaaggcccccattatcttagtgccgactagatgttctaaaggcaggaggagccagggagggggcatcttggtttgaaaaagcttttccccatgtccttcaaactgagccatgcctatgatagatttgaaatgcagcttttgtcgtgacatttcccaatggaacagcttctgtaaaacgtttcctctctctctgctaagaggtcattcctgtctggaatgcctccagtacaaaactagccttgcttctttagcttccccgaggtccagcaaggaaagacctgaaattggttatgaacaggttggcccaggctggcatacccgtcttctgacaatgccgcctccaagctcacccacctccaggctccagtcctggcagcaatgggagttggaccactggaactagcacagtgggcctcaccttagagcaggtactcctgtttctgagcccacagagtgaggcacaatgaagggtgtttcagctggaacagaaggcacatccttggggaagccagcaggagccttggtcccgctttccctgctcctggaggcagtaagccccaagagagcaattcccttccctccttcttttccttcctgttttgcaggaggccagatgttcttttcatgccacttagcttttatttccaaaccatccccggtgaggaagcgctaaactgcagaggcctcggaggaggaagtgcagggaaggggggcgctgtggaagaggaaccagaaaaggggaaagttagcttgccctccctagccctgagtttgcaagtatcaaagtcaaaatgtgtggcttcttttcttggagcaactgagatgaaagtgtctttgagagccccagagaagtgtcagatgaataagatcggtcagtcatcatatctctgcagcaaggaccagcgaagagagctcagtgggagccaaaggtctcctgacgaagatctcaccataaccaactcagccagttgccattaaaaatcctcacagaacagcacttagtttacaggagctcaaagacctgtgaatgctttcagaatagatcccgagaaaggaagaggttctgggcagtgcaatgtcctcaggttagcttctgtggcacctgagttcccgttcccgcagggctggaacaagctgtgcagccttgagcaaaggtcttcacctctctgagcccatttccacatctgtaaagtaaggacaagagaccgacttggatatgtcacaagatggtggcattaaaatggagagatggaacttgaaaacactttgaaaaaacatcggattttgttagtcctcctcatttatttccttaagaggtaaactgaggtatagattaacaaaatggcttattggtttcagtccttttagaacaagatgaaattttattttagaaaacaaagcgagaaataaaaaaaagaatcaccaacttccctgcaagcattcaacaaatgcccatagtataaaaccaacaagaggagtcaaaccgcctcttctgcatccccaccagccacactccgacacccccactgcgccccatctttctgtccctgatgcttgtcaaattgttccatcgtcagccccaccagagctcatgctactctgagcccctggcttgggagagcgagaactgggatggggaagggtattcttccaaaggcaccgtaggtattgttttgtttctgggagggaaggtggtgcctccagcctctccttcctcttgcagctcgcaagcaaacacagatggaggagatgctctggctgtttttaattctgctttctctcccagggttcttacccagaaaacctattggaatttcaaattttcaaacctcaggaaagtgttgtgtcgggaagatgatttggggttgttttgtgctatcagctgtggggctgggacaggacactgaagcccagtaccccatttggataccgctcttcatcctatttttgcctgggagaagaacagggagaactggctggaggaagaggagaaggggagcggaagaagaagagatttttagagcataataataaaatcgtattttactattagaataattttttatcttccagaacatgttttcagttatagccttgtctgcttcttactaaagtcttatgaggtgtgctattcattagtctacaagtctgctgctgtcatagggctcccaagtaacagtgactgaaagaagacagtggacatccctcccatgtcagagcccgggctcaggcagtcaagggcatagccaaggtcatcgccaaggtcactgccaaggtgatttgacaccatcacatccatgttccagccagtggcaagtggctgggcccaccctgggggttatacccctcagcaaagggacattgaaggaatctgtgtctgggaccacccaggctcagtgcaggtgggggattagagccatgggctgcccggaccttcaaatgccctcacaggtgatcatgtttcacacattccattctcctcatcctcctcattccacggacacacacaaacctccccacgcacatctgcttccccagggtcccccttacttcctactgtccccaagggtgacctagaaccaggggtagggcctgactccactgctcagtaggaaggaagagggcttgtgatccactgccatggctgccctagggtggtgctcctagaactccatgtgggaggctgggggcatttcctcatagatcgatggcaaatccacagcagttggtttcgtcagcttaaaatgagtgacagacagactgactttccaaagcatagagcttatttgggaagagcaggggactgtaatcgggatctgtccgctttgatggatctcaggtgcgtctaaagaggcgcggcgaggggagacttcaaaagaccaagaggggaggtggacacgggctgttttgaaacagcgctcagtgcaggaggtggccttggcgcatggctggagacaggcgtgtcaggccggcagcttgtctggaatactttggttttggggaattccttgcctacttccttcgtaacctcccaggtctttttacttggggtttgacataagtgactccattttgatactggtaactttcacattttcatagcaccatttggtactgaaaaaaaaatgtattaatacatatgtggatttaacatcatgggtaacatttctatggaaaaaatgtatattccctcacctaaacaaataacttattagtaaagttataaatttttgctgtttcttaaattgggaatctcccattatgaggattggaggattcttggaaacaggaactatggcttagatacccacaatactttccacatatggaactcctgataagttggtattaggtgaaagagagacttgttaaattaccaaatgttatcaaaactgggcatccgaatggtgccaggtgatacctgggaccaggtgaacagagaggtcttgtagtggaaagaaactagtgtcagagtcagcagaagtgagccaggttacttacaagctcggcagccttggagaaagtgttaatttctgtacacatccatttttcccttctttataatgggaacaattcatcctacttcacaaaattgttaggacttcaaaccgaataaatatatgaaaaacattttccctttttgttacacagaattattttttaaaatttgaattgcacattccaaaaagaactagttaaaatcaactaatatccagtatactgaaagatagcattttactccaaattttttcccactgacagatttttatctttgtaatgagtttatatatatatatatatatctatatatatatatatatagatatatgtttctatttaacttttaagtatattctgtaaatatctttgtttcaataagtaataagccactggttataaaatattccattatagttacatgccattatatatttaaacaatatcttatttttgaatcttcaggctgtttctagttttattattattaaactgtgctgcaatgaacagtcttgtaagtatattttcttacactttccttatcactttaaagtcatttaatacacatttccttctataaagcttgtagaggtctcttatccaaattgctatggcgagatctgcttcataattcatattttataaaggtaataaagttacatgctgtatattacaaaattttcccaaaaagctatgtactggggaaggatattaagagtcatgttcagtagaataaatagactgtaaagagcttcatgtcagactttggattttgctacaaaattagtttatatcacagaataattattttctatttttagagctttttggcatttggaatcacagagaagggattaaagacctggatgatttacctatcttttatttctagtaaaatggaacttgttttattggcccttgataactttacttttgtaaattgcctgttgttagcctttgcccattttttcattaggggatttgccctttttaatgatattaaataattaaatattttgccacatattttgcaattatgtctcccagctttacgtgtattaataacacacaagttttatgtaaaatagtttggaaatgtttacctttttggggcttgtctgtgggatcatatctaagaagtcattcctaattccaagagggcataattattgatctatgttacctagtacttttagtggtttagcagttttatttctggatgaatatcttcaatctgtctgaatttagtattatattagctttaatgtaggttttagctggtagacacagtctcattcattaagcaatctttccctttcccgttgagtttaaataccatcttctttaaacacaaaacttttatatgtaattggatctgtttctggacattctgttttgttccggtaacctgtccatctcttttgctgccagaaccacattattcccattataatatctttattttaatacctattagggctgggagaaggaaggatgaagagacagagggcatttttagggcagtgaaacttctgtgtgatccactgtaatggtggatccatctcattatccatagaatgtacagcgtcaggagtgaacccaggccaggcacagtggctcgtgcctgtaatcctagcactttgggaggctgaggcgggtggatcacctgaggtcaggagttcaagactagcctggccaacgtggtgaaaccccgtctccactaaaatacaaaaattagccaggcatgatggtgggtgcctgtaatcccagctactcgggaggctgagacaggagaatcgcttgaactcgggagatggtggttgcagtgagccgagatcatgccactgcactccagcctgggcagctgagcaagactccatctcaaaaaaatagaagagtgaacctgaggttcacttatggactttgggtgataataacatgcaaatgtagactcatccccagctctggtgggggatgttgataatgggaggagctctgcatctgtaggcacaggggttaagtgggaattctctgtaccttcttattttactgtgaacctaaaactgctctaaaaaataaaacctattttttaaaaaaacaaaatctaaacattacttttgaagtcatagagcttagattcaggggggaatatgaaaaaaatagaaaattagaatagattgcaatttagcaagtattgcagtaaaacaggatccacagaatagtgcttctttaactctgtggtaaagggccagtgaagaaataaattaccaatatctcttagatttagcagcctcttagttattctcatctttgaaaagctatttgtaaactgtaaagtgctcttgcctattagttatttgccactaatctataatggactccttttaaaaatgaaggtattcactccatctaccttctgctctggagaataatgaaattgcagttaaaaaatgctgtcatgttctcttgagagattggtgtcttgtaagaacaggctgaagtacgtttcagacaagattgggtgcagtcggggtgggatgactgtagactgaagcacatgtcaagattgggtgcattcggggtgggatgactgtagactgaagcacatgtcaagattgggtgcagtcggggtgggatgactgtagaccgaagcacatttcaagcaatgtctcttgtcacaaaataatctgaatggctcaggacaaattcaccaagtaaagtagaagcttgacatttgccaactatgtatcccataaccaagtactgtttttaaaccatgtttttcttaaagaagctaagcttttaatctcttcatattatatgcatatgatgaatatagaaaagccccttttaaagtatgaagaatgagcatttcacccggccactggctgattgaatgccagctactgcactggatgctgctacactgctcagaaatcagtacaagtcacaagcattaagtctgatagggtccgacatctggccgattaaacaatccttcggcatatgtaatattaatactctgtgcatgagcaaatccaatcacctattcaaatcagatcctcactgagtgatgcctggaagagtcaaacactggcccggccaaaagaggaccgagggaggcgctgggagaactggctcctaatcccttcctgctgctaattaggtagatagctttgatcactcaccttaattttctgagcctcagttctctcttctgttacatgagagggcagaccacgagatcaataagggcactttcagctttcaaaatgaaaaaaacaaaaaaacaaaaaacagatccactaactgatttatttcctgtcttattataatggattcatccatttacttattccaaagatgcttattatgaacatcttacatggtcaattcctgtgccacgtgtggtccctaaatgagaagggaatatgggaaagagagagagacagagtccctcaatctaccttcttccattctctgggtggggccagaattcactgaacatgaggaagtgatgagaagtggtgaggaatgggttggggagatattctcggcattgccatttatttagaacagggtttctcagcctccgcactattggttttgggggggtgcttgggggactagcctgtcatcgtaggttgttgagctgtatctctgacctcaccctactagataccagaagcacaccctcccgccatttgtgacaaccaaaaatatctgtctccagacattgccaaatgttgctcagaggagcaacatcaccctctgagaaccactgatttagaaccaccaggcactgtgctggattctgagcaaatagaaacgagaaagctgctggcctggcctggtggagctgactccagggcagctttgcgaacttcaatatgcatccgttccctggcggccttgctaaagctccatcctcaccccagagcttctcacccagcagctctgggtggggctgcaggatttgcatttttaaagaggtctcagggatgctgatgttgctgtttctccaggaccatctctgagaacatgtgggctccaccctgctgacaggtgagagtacagatgtccttttctcacatcataaaacaacttaatagttttctgaattcagaaattaggcctccagtggatactcagcctacagtaactctgaaacgtcacagtgaggaggaaaaatagagagtcccgtaagctagaacaatgccaatgggtggtcagtttcatatattccttttggctcctttctgaattagcagatgaacggtcagtgaaggggctggcctaggaacctaagtattacctaattttagagtttctgtggattctaaaccccaaacaactgcagccaagtttttacgacacttgcatttgtaagctggcgacgtttctgactgcaactggatgtgagcaattcacattgccctaaacgcatgcatctgcccagatagacccagctctttctttctgcactttctttctcttcccccggtgcccttccctagtccaccctgtccctctatttgcaacaaccccccctgtgactgtgatagcccagtcccccgttgccgggcagagccggcacatgcgggcttccgtagagtattctctataaaactgttagctcactgcggactgagcactgctgcttccgcttgctgtattgatactaccaaatactgtattttctttgaaaagtgtcacacgcccgcgggaggaagtggggtgtggtgtcacagcagcataggaggacaggagtgtttttgctactggtgtacccaagggcgacagctcactttgccatttcttgctctgactctgacgccaagttcatgggaaccagccatgtctctattcatgggatcaaaggttaagaaagtggagcccaggctctcgaaggctccttctctgaccgcgccctaggaaggagaggtttgccccatacctaccccatgatgtgttgagaacatgaccctgtcccatatgcatatccagtgcagtgctttgcaatatagtaggcagatattccaaatgcttcgtgactaacagcaaaaaacaaatgtgtgtgtcacttcatccccttggcaagtggttcagaggtgttctgggccatgtctgatgacccatgaaacaagttcctatggtattttcatgagggagaatttctaaggatgttttagaaaagtgtggtgtgatcatcgtagccatcttttccaccaaacactgtcatacgcattttccatggattaattcattaaatcatcacaacacagacatagacccaatccttcatagaccctgatgaagtgggtccattatataccttgttttgcagatatgataatgtagtcacagaaagattaagtcacttgtccaagactgtacagcttggaaactgatagagctggcctatactccatgacaccaacatttacaaactgcaagctccttcacatgttaactccttcctgggtctctgtgcctttttgaactcggccatgcaaaggttcgagaatggcaaagcctcatgcccaggggcttcagatccccttctcagtctaggtaccctttgaccagagcacctgagtccctggccccaacttgacgcccctgttttgggtggtgtgctcttcctcactgagcacctacatgacaggaagaaatgtcaggaggactgcaagggatccagcatctcagttagagctgctgggtcacaagatggtagagtcagagagaaggttgtcttttcagagtaaattttgacacaagaagcagagtcctacatttccatttactcctacagaaggcagcatctttgtgtctagtaagtgattatcctaaccatggttagaaaatgatgccagggaggctgagttcctcccaactttatctgatgaagttagcttctttctagactttgtccatagaaatcctcattgatcccaatcagccacttctaaaggcatgaatggcagaagcttggagggaattgcacaggcttatgacatgctgagaaaattacccagataggcacaggcgccctgacatccagaagagaacttagggtattccgagaaactccatctctgtttatatcacccaattcttcattcttcaaaccacagccatggagtagaaagaaagatcattaagccccaggtacaaggagaaacatcctaatagtgcttaagataattaagcaagttgccaggaaagcctgtccctacagtcataacatgtcctttgcaagtagggacaggtgggagcagacagaaacagtctacagcgaaaactctatgcattcatgtcctccctgacctaaccttcaaagacatttgctaacaagaaataacgtattagtttgggtggagacacttagccaccaaagctgggttcaggtgctgttgcttactcactgtgagtcctttgcacagttttgtgggttgtgggagatccaacacataagccctcttggctatgcttgtgcttagaacaaacggagaggcagatcaggagacagggagatggagaagcatgtccaccagttataacaaaggccagatcgatggagatggctaaaacgttcaggcaaataagttggtcgtctgttcacagcgtcccaggcgatgctggactgtgtcagggaccctctcacccctgccaaccgaggaggatgcgcccccaccccaccccagcctatgacatggccaaggatagtgcagaaatggttctgcagatcagcagatcctgcaacatgagaagaggagggtggagatgggtgggaacggtttattcatgtagaacatgttaaccaaaaaatgagtgactgaggcaagtttctctatcagttgaggtttattgagctaaagtttgaggacacacccgggaaaaacaccagccccagaagcacctgtgacctgtgctttccaaagagggttttaggaactcagtgcttaaggagagggggcaagcaggagggaagagggaggagggaggcagtgaggctctaattagcgcttaccaaatccatgtcttacataagataaggtaaatgtgtgagaacagggagcagaggaacaaatccattatgcacctgcctcagagtcaggagaagagtgactgatctcagctggcccttcttctgtacctgggaagatgagcttgaaatcaacattgtcagttgagttcctaaaacagaactcagttttagaagttaagcttaggttgcagtcctagggttgcaatcggcataggcttgttttgtaggggaatgtggatcctgaaggatttaggggccagaaaggaatttcctcgtaagcagtgtgtgacggtggccatctgggagaagctcggggccttttgtcattgtgggagcctggcttacgtagaatgctgtgacacagggttgtgaagtgaccgctgtctcctggggaaaaagaatggcacggtggcaggacttggcttccaggcttacctctccccttggcataactggtttggggggcctgagattttattttcttttacaaacgtatccatcagatcaatcactcttcttcctggggtacagggatgaggagtgaggataggttagagggatgcaagcctctctgtttgaaaacacagggagggaaaatatgagccttctcataatgaccatgattagcaactgctcggtaagtgatgggtgctgttgtcctcataaccaacatcatcatcattacagtttttatatcttttactgactgctgttttctagatatggaaattatatgacatagacctcaaatatctagtcccatgattcccaataagtacccacttgcccaagaagtttcagtacctggctgctgaaaatacaacttttacatccttagttcatgtgtcttaattcttgattcagaaaagctatcaactgtattctccatatctcaaagttaacgtgtccaaaataaaatgtctcatcttctcatgccatctagttcttcccgcagtgctcccatcttgtgaatggggatggcctcctaccatgggttggggccccaaaccttgaggccgccctgctcctccttttccctcccctcatcttcagtggcttggtacatcccatcaagagatatcggaatccctgcacgctgccagggtccttctgctggtgccctccgaccatcaactggaagagtgaagtcgcccccagtagtctctcttcttctgcacttgctccttacagtcctctcaacacagggaccagggtaccccctttctaggtgtaaataagtctgctctgcactcaaagctgaagacagcacgtagacccctcgggcggtgtcctacctgaactccaagttctcaccatggcctgtggacagccccatgggcacacccacctcgtctgtcttctctaccccttgctcaactccacgcagcccatccgccttcccagaacgtgcttggcagctccgacctcacacccatgtttcggccgggaacgttcacctgccattgtctgtgtgactcagtcctctcctcgtgcaggtctttactcaacgtcatttcacagagacccttcaggaccagcaaagccctccctgccgccccacccagcactccccacctccctcctctgcttagtttgtttcatgggagtcacctggtgtatttcatattatattcttctgctttcttgtctgtctcgtgcatctggacctctgcacaaaggatgggttttgtctctttggctgactgcagtgtcctaagacacttagtgcctagtagctctagtaactgtttgttgaatgaatgaatgagtgaatggatgcatagtcactaaatcagaaatcgtggatactgtaatcatagaacattaggtcataaataccaaggatcctgaggaagaagaagaaagaatatctatgatttggacagccatttttccaattgtggaacattgtttagcatttcaaataatgaaaataaacacatatagaaggcttactatgtgctgggcattgttctgttttatacatattaactcgtttaatctgtgcaatgcacgtaggagtttatggagtttcctcataccttatctcattcagttcccaaaataataccagcagattgtgggtgattacaacattttcaaggattcttccccagggcagctgcttgtgggagagctgaggtctagaaaggaggagttgagagcaggaaaggaaccaagcctgaccccacccccatgccagcattttgatttatggaaccctgggagaagagtttctccaaaatgatacttcatggcctccagcagatccccctcaaagaaaccaacctgggaatgaccctctgtgtggagatcaaggaggaaagaggcaagtgagcctttcttttctcctgctcgtggacttagagtaagagtgtctgggacatccaggtatatactatttccatttttccttttgacatcttcgatgatcaagatacctgctaaggatttgttcagaaatcagaattagttgtaaggcagttgcctgaacaactgaaagcgtaatgaccccacagagagcactaaggcaacagaaagtacggcgaggtgggattattaggttggtgcaaaagtaattgtggtttttgccaatacttttaatggcaaagtttttttaaaaagtatttttagtagaggcagggtttagccatgttgatcaggctggtcttgaactcctgacctcaggtgatccgcctgtcttggcctcccaaaattctgggattacaggcatgagccaccatgcccagcctttttttaaatttccattacttttaatggcaaaaactgcaaattactttcacaccaaattaataggatatttgatgagttttaatataattatcgtttttaccacaattgaccttcccctactcttaccctcaaaaaaaaaaaaaaagaacttaaaataaatccatagtcatttcaaaagtgacttcaataattttaaagtcattagttgttgggactctgaaaatgtaggaatcctgttatgcatgacagatttccacggtgggcaacagtcacctagcacatgcctggtagttcagctgtaatgtgggctaaaagctgatggaaagcctaacccctttttaaacagtatttctatgactggctgaactccgtggtggatggcaaggctgtgtcctacatcagtgagagcctgcccgctgcagccaggaggcacctcacagagactggaagcacagagggaggtgggccagctggggcccgaggatccagacttggtgagactcacagaccttggcccactaccctcctccctcctccctcctcacccacttttctcccttcttcacatcagtactggtggcagcaccctgagctgaaggagaaaagttcatattcaacatcagaagttattttatttgtatgtcgctttggtgagagctctgtcctgtaagaggggacctttctcatctaggagaaagtctacccgtacctgtccccatctgagctattaattctatagattctggaaggagaaaaatgaaagtgaaaagtaggtaagaagaaagcatggcagacatgcgcttggaatacggctgaagacggtagatgtggcaggtggtaggatgctgtggaaagggactgaaatctgaggcctgagtttgaattcaggccctccaagcactttgtaaccataggcaagtcacctaaacttgctgagccccagccataaaatctataaattaataagatggagataactaccatagttgtcctgtccacctgacagctactggaagggtttatggagataacataagtcaaagtgtctatgagagttcattacaataattaatgtgatgactatttttaatattattaggtgagtaactagtaacacccactctttctcataggattttttaaggacctcatgaagcatgagaaagattttgaaagatggtaattgtgcttgggtggagatggcagagctcagaaacagaaggaatggcgtgaacagagccatagagacagatattcagggaaccttcagcaaatcgagagaagtccaggcaggctgggactccgctgagagtcgtgctgtgtgaaggaggcaacttgaacccaataaacggaggctttttaataacaggttaagaagctgggactccactgagagtcgtgctgtgtgaagggggcaacttgaactcaatacacggaggcttttaaataacaggttaagaattaggctttaactcaacaaacactgggacagctttcttaagtaacagtgtaacttgaccagggctatgccttagtgggactatctattcatgtaacctattaaaatttgtgtcagaagattaataatgtcatcccaggtgttttattttctatatttcaaggtttaacttcaacactattgttggttttttgggggaaagtgcagagtgttgttaatgttggcaggcaggagggcaacacttggtctgtccacgaagcctccttcatctctagttctgactgagggttgactgttagccttcggtttcctttgtcactgtattgtaggggttattttaaaatattatcttcaatttatactttattattattatcattattttgaaaagggtcttgctttgtcgcccaggctggagtacagtggtgcaatcacagctcactgcagcctcgacatcctgggctcaagtgatccttccactttggcctcccgagtagccggaactataggtgtgtgccaccatgcccagctaattaaaaaaagaaaaaatagagacagggtcttgcattgttcctgaggctggtctcaaactcctaggctcaagtgatcctcccacctcaacctcccaaagtgctgggattacaggcataagctactgcacctggcccatacttactattttaattcacttttgagatcatttttgttggtgaaagctaatatttaatctctttattatactacttagtagaagtcttagcaacaaagcaaaacgctacccaactatgtgattttttttttactagttatcatctttcttctgtgcacattgtgaaaaagtttttttttatgtttcttttaacagcagtcacttttacctaagaaatctttctatctcataaagaaatgcaaaagctattggtgtagcttaatttgccaaaatttttctgaattgatgtttaccaaatttggctgagcagatgtaattggaaaccattgaatgctttgtttctcattcccagatttactattgattaatctgtgttctttcttccacatgtgagaggttttgatacaagtgatgactattgttattttaattctgtgagactctcccccaacactgagccatctcccactaaattatagtaatacaaatgctgtccaaacattttattaaatgaagaagtttgctatttcttatttcatttgctactgaggaagagaatgcttgatatttttttcaattgatgagagtatattatacttctattgctttctatttatatggaatttgtccccatcaggttcagttatgtggacatcctcagcatctctataaacgcattctgggagtttgaattgtggagggtgaatcagcctagctaaataggtgagtcagtgtccagagaatcaaaagaccagaattctcagttcagtacataatagcgtgtgacctaaagcactgagcaattatacttgatcatgtacctgcatcgaagctacacacaaaagacaaatgagatcacacttaaagctgaaaatagtgagcctctaagagtaaagatcctttgtaattttaaagtacataggggccgggcgcgatggctcactcttgtaatcccggcactttgggaggccaaggcggatggatcacctgaggtcaggagttcaagaccagcctagccagcatggtgaaacccagtctctactaaaaatacaaaacttagccgggcgtggtggcacgcacctgtaatcccgctactcgggaggttgaggcagaagaatcgcttgaacccaggaggcaaaggttgcagtgagccaagatcgtgccattgcactccagcctgggcaacagggcgagactccgtctcaaaaaaataaataaataaataaataaataaataaataacataacataacataacatcacataacataacatagtacatatcatgatggtgttttgcagctggggtagcaaaagcttggaagattggatggacatacctgatatccatcatgataatgactgcatccagatgaggacatcagagggtagtaagtgctctgcaagagatagatggagggttttgtgggagctccgtagcagagtgcagaggaaggtcacataatttaacccagatatgctcctgaaagactatttctactttcctcctgctctttttggtacacaccaatgaagttgagaaggcccattagaaaatatatcagagttgtaataataataactaacatttattgagcatttactttgagccagccccattctaagcaccttgtgtgtatttgcccatttaatcctcatggctctttgggatgagtaatagtattatcagtgatttccaaatgagaaagcaggcttagagagtttaaataactccagcagttcagtgtatgagggcatcgatcttttgtttacaacaagtgctgggctgaatcctttgctcttgactccctctgtaattgtctgtcacttaatttgaccattgtattctcttgcaagtaaaacaaatgcatgagatgaagagatttggtaaaatgttgcttttgaaaatgaactccctaagcaaaaatgcagagtctctagcatatatcagacagggggatcagctctggaggcacatagatgatgaagtcatggccccttctctcggaattgttgaggaagacagacgtgaacccataaatccaactgcacattgtagggaaatacagcagcatgggcgctggcactctgtctcttcccctatcccacaagctgaccacatctccaaaggaatgtgatcacaaagggaaattgtttatcttcactggggatgagggaagtaaggcacccaaatgcactcgttctgaggagtttttgctgaatgtattgcagatgagaccagagagaattgtgtagttggagtcaaacccctcttctgagtgtatgtagcatctcaagaatcaagtaggcgacatcctggtggggctctataagtccccacattagagggctgagagctgggagccacaggatcaaccccactcggactgtagaaatggcaggtgtgacgcaaatcaatatgacaggtgctgtctagcagtgcactcagagaactgcaggagccagggctgagaacttcccatggagatgtgttgatgggagggctctagaggaggggaaggaaggcttccaagaggagctagagactgaacaggaacttgaaagatgaggaagggggcagggaggatggagtgaaacagggaggcgttccagggagaggttgcagctttcctagaaggctgaagctgtgaaacacatggcacattggagaaacagcagcagttttgcaagatcctaagatcattcaggctggagcatggagattggatggagactgagaggtgaccaaggctggacagaggaggcagggtaagaagctgctgtgagtcacaagagaggtggtgcagaatcggtggagcaggagatgaagcaagtgggtcgtgaggcacaaggggaagggtaaagttgaagcagcgggtgagggccgggcgtcgcggcacccagcaccgagctggcaaaatgaaggaaaaggcaagtttgaaagggaaggcagggagttctgtatgggacctggtgagtttggggtccccttggagatttccaggagagagtcgaatgcgtgactttattgctcagacaaggggtctatggggggacctagcccctgccttgttcggaacagcctggccagtcagtcttcttgtgcatagattgttgtcataaagtatgagactaccatgtgttacacaatagaccaccaggatggctgaacagtagaaaagaactttattggcaatatcagtttgcacaccgggaagagacagtctttggcgtgtatggaaggtgctctctcttcaaagagggaaagtgcaggctggttttatgcctcccaggttccatattacacaatagagtcagatatattcagaaagctttggggaaaaatctatacatatttatgaggggagttaagtgcaggtgccaggggtaaacatatgtccaacatacatcccatgttcactttggggcacagttgtagcattaaaattagatcctaaatttggctctttacatcaaaaggcaaatgataggacacaatgacatttagtgtgcagcacctgtaagctgctgaaactggcttggggtctgcatttgcttatcgggaaagaatgcctggaagcctggttccctgtccaatcagagttgcaggggtctgggttgtaaatcagagttaggaagagtctcaaacttcgcctgattattcttgttattagggagactaacaagggtgtggcttttcctgtagctgtaggaatttaggaggttgtgatgccagccaagccctgaatcctcgacccctgggtaacttttgtttctttaaccttagaatccatcttagctgatgaaggggcaactgtcttggtctctcagatcacacgtgaatggagagtgaagatgagaccgactgaaatttagagtgcacagaggacagatcacacagcttagtcctgaggcaggctattccagcacatatttttgtctacagaaactctcatttctggttaaacacccagggaaatccccttccccctactatctgctccgaacaccaaaaggcaacccatgaaaatcttttatgttaatttctttcttgtgtattcattacacatcttcttggctcttaatatagatggatagatacgcatatttttacatccacacatatacatacataaacacacacatatatacttacatatacacaggtgtgtatatctgttaaatgtggtaatttacatacccagcagcattgtatgaaagtgtatgattcattttgtccttaccaacattaagtaatagcatttcaaaaatatttgataattgcatgggcaaaaacatattattgtttttattatatatttttcttttcttttcttttctttttttaagacagagtcttgctctgttgcctaggctggagtgcaatgacatgatcttggctctctgcaacctctgcagggagcaaagcgattcccctgcctcagcctccagagtcgctgggattacaggtgccccccaccatgcctggctaattgctgtatttttgtagagagggggtttcaccatgttggccaggatggtctggaactcctgacctcaagtgatctcctcgccttggcttcccaaagtgctgggattacaggcgtgagccaccatgcccagactattttattatatattttaaatattataattctttttacagcttaaattaggacttaaaatgttaatttttcctcaaataaaatgcattattaatttctaatgttattttattctcagctgtgtttgcctaactgcaaatgttcaaaagagcttaaataccacagaaccaaagctattttaattttttaaaagatctgatcatttccctttagtaatttgattactttaagattttaatttaatatgcagctttttcatatatattctttttactttacctctataatctctgtatttataacacatgccttaaaataccaattgcatatatttcttttcttttggtttttgaattatcatacagtaaaattgacttttggcttggtgtagttctgtgaatttaagtctagacttctgtgaccactagaacaatcaagccggagaacagttctgtctttccccaaaatttgctcatgctgctcctccctgctgcaactcctggcaaccactgatgtttttcttcatatagttttgtcttttcaggaatggtacatgcaattacatagtatcttattctgcatgtcttaaattgctcacctggctaaacatttttccacaattagttggaactatgatttttgtatcctgtatagcttgtgcctttgcaatttattttcttgggtcataaacagtgcctttcttacaaatttgtatacccatattatgtaagaatggcgtttacttacttctgttacactaaccatagctatttccctgggtaggtctttactgttaagtttggttattttctttaaatgtataagaccttaccaataggaataacacttgataaataatattgtaatactctggtgatccagtctgatgcagtatccctaaatctgggaaaggttgtaaaaaaaaaaaaaaaaaaaaaaaaaaaaaaaaaagatgctatcttaaagatgcatttttttctggcatgtagaagttggaaacagactaaatatgtagctacagactttagtaacgcagatcgtagagctactgtcaataggatgtcatgcaagaatgacaaggaagcctgagaaaatgtcagagaaacttgaaaaaaattttatagtaaaatgttaacttaaaaagccaaatataattccatacccacaggatgatcatagcatgtaagaaaaaaaaaaacacaaaacttgctaatttaaaaagactagggaaaatagatcagaatagtaactgatttcttttattggtggaaatctggagagactttttactaactttgtgtgtcttctttatttttcatcatgatcacctaaaaagtgctctgaactacacagagaaaagcactctgtgtagttcgggtgtaaaacgctgccatctgcctgaaaaactcacacctgagcttgcggttctattgaatgatgtgtgaagattaccacacaaatacctattctgtcttctagatgtcaggtgtatgtcaggtcatgtctgacatacatttctaaaggtctgtgagcagacctttacagaatagtgcaagtgaatctggtgaaacggccgtttaatctgcattgcttattaagtaagaaatcattgtctaggaagaccttcagggggacagagggttttgccccaactctcttccttgctgtaatggaagccctggtcaccctggaggtttccatcttctcttcctggggcagcatttcccagacgcctgctgggctactgttgcctgattagaaacccaccctgggaatagcagggtgacaccagaaaaggtcagggtgctttaactctggctttgtgagttagtgatccctctagactcaaacagaattaaggaaatcttcagaaagtcccaacagggcaaaaactcccgtaactgaagatgattcttagtgatttttcctgatttgtggagaaatgaagttttgtctaaaagacccaattggcccaggaaagaagggattctcaaagaaactctctccagagaactcacagctgttagccccgctcctgcctgggaattctaaactcacagggcaaagggcgcctcctaaagacaaatttgtaagtcatctacctgctaattcagcaacgtgacagatacggaacccagcaaatcatgatgtttacccaaccatctcctttagataaaacttccaaactctgcaggaaattaggacttcattaatatctgtgaaattaatgcccgtcaaaagctcctaatttgtctctcttgtggagtcaaagaacactggtatttagcatactggagatcccttttgtcttagctagatgaggtattacaggcccaagatctccaggtatgttactgattctccttccaggtctttattatttcaaatagttttctttctttatacaaaggcagaaaagacaatcaatgctttgtttcttatctttggcttacttatgaaagcttagaaaaaattataagtataaatcatcaaaaagagagacggagcaaggaagtaacttttttgctgaatatcagatgatagtttcagattaatgggacctcggaaaagtaggtaaaaaagaagaggtatctagttcacataagtggccagaacactcaataatggaacaatagatgaagaattagactagattcctggatttgtagctaacactttgataactatcatctaaacctcttggaaagcataattactgatttttgggcttttatgaagtattttgttcatccttatatgagaaagccctattttatagtagtcaattagtttggagttttctacgtggtttgtgatgttcaaaggcttagagtgtgtgtgtgtgtaactgtgaagaaagcagacctttttgaaaatgtccagagtaaataaggatcagctgccgaatgccttgggccaatcccattacacacataaatagaccatgtaagaattttgcggtgtcatatttaactagtgtgactaaaatagactcgctctatataaactcattttctgattactgtgtgctgtttcctgggcacctacttgaataacagaagacataaaatattggaaaacttttgcctcactctccaaccattgggcctaactccattaggttgaatggaactaactcttgagttacttctcaaaagcaaggttgagtgcagacttccagaaagcctctcccctcagcaagtcagtgtgtggttttgggtgagtccagcagtgtcctctgcagaaggggaagtgaaaacatttgttcacatggatagtggacctatgtgaggttctggctgtccatgataaagcactggttaagtagacatggggcaccaaaaataatatcttttatagcccccaaacagcgtttgtcttttgtctttttccagggcgcaaccatgtcgccatttcttcggattggcttgtccaactttgactgcgggtcctgccagtcttgtcagggcgaggctgttaacccttactgtgctgtgctcgtcaaagagtatgtcgaatcaggtaagcttgaggggattttcaaagcgggggaggaggaggagaatcctgctatgaactgtgtatgaagcaaggtcttccaggacatttgacatcatctggtggaaccaaatcctgccatttaggacgctgatgcccagcaaagccaaggacttcctcatggacacacatttcgtgatggactctaaaccaggacccgatggcccaccggtgctctattgcactgtatcatttttcccacatatacaaagggaaagagaaagctgggttgaggaaattacataaggagttaatgggaaggaactctaatgagctgaagtagaacatagccctatgtggttaagcctggttactttaaataagtctaggtagattaagactgcataatcttccaaccaactctaaagactgcttactgctgctttggcgaatcttcagtggatattacaaagcatctataattagccattagaatccaaatttcagaaaacgtacttttgcactcactaaggtcttggctgaatgaaagaatagtgatgtttcatcaagttcaaatacaggcagctcaaggtgagggggaaagtgggacagccacccaacgtcctgtttgtgggttcagaatgttccattccaacagtcttatgtgtagggaatgtctctgtggtcacgtcggccggcttccactctccaagatcttcacctctgcattggaagtttgccacggatttccaaaggaaaagtaggagggagtttagatcccacaactctcctgactgcacaccttttcttgtttccctacgtgcattttgattttagcagacactttgtagggaatgataatgatgatggatgcaggcttgcagtaactatggaagccatcacagttcacttacacaaaagtgtttacggagagaccactgcaagagtgctgggaccagagcatagagggaaaaaaagtcaaacaagtaagctgaaggaactcaggaagactgccttccctttagagcatctattcttgcagaagaaagtggcaataaacaaaaatacaaacagcaggtaatgaaggaacaaaaagcagtgtaaagaagagagggactgggggcagggatgtgtgttattttatatagggttgtcctgcaaaggcctgtgagcgagggacatttgcagatacaagaagaaactgactcagactttgagaacctcctgccagatgctcagagttcagattctggggttcccaaacctactattttgcatcccccaccaaaagcctttttgcttcacagctgactttgtccttccagccactctgaacacatcaaagccagagagactgtctgaatcatcttgatttcctttctgcccagagttctctcctgtttagttaaaagtgtgaatgccacttgctcccaacctaaaacctttcagatgtcacagacatctttgaagtgtaaaacgtctgagtttttcaaagccgcctttgacttaatgggtctcctggatccagttctctttaccatctcaggtctccctgacatttgcttcctgagggcttttttttttttttttttttgcatttggccttgcctttgaacttggtctaatgagccatgtggatcgagagtccttgtcagaaaagaaggaaactggttttcctaaatattagcctgtggagttggagggagtttagagatttttgcttttgattttattttgggcttgttctgaaaagaaatcactctgaatattatcattcaatatttacttctacaggatttaaacacatttcagttcttggggtgtaaggctgcattttccacaatgagccaacagaacaaggacaaacaggctacggggctgcggggttgtgagtcgttaaaacggtaacactctacatagatagggccctctgtttaggtgattacaaacgtggcgaatgaaaatgtaaaaagtgccttgctttggggacttttgccccttctcagggtatttttggcccttttctccaggcacagagaatggttaccatcaaaaggaagtatcggaaagggaagcttcaggtctgtggaagtaaaatgttaccgtgatcattaatattgccgttggtttctaaaaagcccaatctccagtccaattttttttttaccaacccacaaaaaatgtcccctttctattccacgtttagtagtctcatggtttatgtctttcctagccaagtttatctaacatttgagtttcaagcttattcaactccttgtatacccccgaaataaatattaatttaacaaatgctaaatgtctgctctgtttagctttgtgtgttggacagaaggggccctcgaaagttagaagggctttatttcctggctttaagcagatttttccccttttgcttaatcgacatctctgaattgctaaatctgccacttaatgtgcttatgtcacaagaaacaaacactcaaatgcaggtttctgcttctgaaatgattaaagaataaataccagagaaaatccaatgtgcgtgaaagacaagaaaaaacttcttaattagtaaactctttgccaatcacagagcggctttagggaggtttcccctagactgaccttcctgtctacagatttgttactatttccagggctcctgcctacctgcctttactcacttgcaggctggcagtcggcttcagccttgctggctccatgggtaaagatcagcaccacctctctgacttgctcatcagcttttgctgagggtgcatggtacatgtaaaatgtatcttcacccaagaattagagaaggaaataatggctcattatgttttaaagatcattgtctcttactgtatttatgtcaaatggaaaaaaatgtaaatatttcttaaaggagcattcattatgcgctgaaattacgccactatgtctttcagatgaacacacagtagttttgtattgactatgtttaagctggggccagtgaggttaatcagtcataggatcaacactacagattaataaaggagaatctcaaaggcataaaagattttttaaaaagtttgttgctcaggtgtttaaacccagagtgaagcaactaactgttgaataggaaaataacattttgaaaccaacccaatagtcccatagacagttgtttttggctgattatagaaatggacccttctgatcttaaagcttggaatttacatttgttttatctgagtttcttcctcaagaaaggatccccacacctctcaaaaaaaatattaaagaactgaaactcaccagatcatggcatccagagactgaagcgccaggcccctggttcatcatgattgcttacttacccctcccaagttcctgttttctcatacaaagttacatttcttccctgctatataaatccctagttttagttggtcatggagatggacttcagactgagctctcatctcctcggctgcagcacccaactaaagccttcttccttggcaattctcgtcatctcagtcattggctttctgtgcggtgagcagcagaacttagaatgcctggtgttttggtaacaatttccagtccaaggcattagcagattgttgtctgaattatcaacgctggacttataaggttcaatgcatcaccttgcatctggacccggggactgtctcattctgtcccatattgtctctgattgtttatgtgctacttttgtcttcccaacagaattctatatcccagagaacagagggagcaggtgctactgttgagttgaactgaattattttccaggcctggctgaaggaataatgagaccttacgtttctgttcctagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatgggtaacgttgcataaagtgtatgcacataagggataagcatgatggtagccgatgactggctcagaactcccatgtcaatctgagggtgtgattacactggcctcgggtcaccaggctccctaccacttcctactggtgatttgataatggcgatggttattctttatgggctgtagaacacattgacatcttcagatctctttgatgcctacatcaaagagatgtagaaagtctcttagactatgataaattatttaaaactgttaaagcaggcttggaatatctcaaattccccttaagtgggggatgagtttttgtctatcaatccagttgtcagtttcattcactttttcagttttgggaagaatatttgtatataaaacttaatcaagatttatgaaacaacaactctaatgctttttaacttagaaattacttgtttaacccagtagactcagaacacgttaagatatcaaaatcttaattttattaaacttcatcaatacacttttaaagtaagtaaaaagctatcagaatgcgagaggatagaacaaagatccatttaatgtttggtcttctctctctatactttgacaattcctacaatttttttcagctgtaatgaacttagcttactttgactaagaagtgcatcatacacaattcatcttagcacaccaagttgtcaaaaacctggattatggtagtaaatatttagaaatgttaaaaggaggagtaaaataatcaaagcgttaaaaaaattccaatgaaaatttctggggcacaaaataaaagaaaatatatcagtaagaaactgcttttacatgatctgaaatccagaaaatgttttcaaatgtttatatcatctgtgccaaaggagagaatcctgactttctgcttcttactttctataactcagatttttaaacatccacccaaaagattttaaactcagattttaagaaatccacccaaaagattttcaagaactcagattttaagaaatcctcccagaagattttcaagtcacaggtttcaaatgggaatgatacaagcctaaaaactaggtttttgtgtcagttttgtatttttgacctaaaaaaatggatgctttttaagaaagtataaaaatctttgctcgtatcactaaagtaatctttagagacaaatatatgccaagattttttttaaaaggtgctcaggcccatgcttagatatgtccaggtaatttagttgggcagtatctactcagcacttgtgtgttggcttgggaaaagggttcctggggccgggtgtggtggctcatgcctgtaatcccagcactttgggaggccaaggtgagcagttcacctgaggtcaggagttcaagaccagcctggccaacatggcgataccctgtctctactaaaaatacaaaaattagccaggcgtggtggcaggtgcctgtaatcccagctacttgggaggctgaggcaggagaatcacttgaacctgggaagcggaggttgcagtgagcctaattattttattaggtagaagcaggaatgggagaaactgaggaagaccagtttatttggtctacctaattttttttttaaagagtcgtcaattccccaattttaaaaatacgattctattcatgtttccttctcaattaatgaaaggataagtcggagggtgagtatctttttgttaagtagtcttcactgataggcaggttgctgttctatttgtatctcttcaagttgcatatgatttcttgcctaggattttgctgatttcatccttaacagacttttctttgcattctaggattatttagacataagcacatggtggcattcagatgctcatttaaccaactagcacattttttgcacttttaagctttggtgggtttttttgttttcttttttatttttttgccaaggttatttcttaatttacttttattttaagagccaacaggttgttgggacttatattttcccttgcttctattggaatctgcttttccaacactaatttctctaaagaaaatgattctctcaaatttgcctttcatgtttctcaacgccgtattgagagacaccttttgttttcccaaggttgtgactgttttcatggttgtctcccattcactccccaaaatgtgctggaatgtggctttctatgggtgctgtttttccagtagctaattggtttaatttcttccatcactactaagtactgaatactgccaaccttgtggtcacctggtgccaattttcattattccatttggaagcaggccccttaccatagctcttccatctccatttttgcctccatctttactccttattcacaagccagagaacaatggtgcatacatgccatgtcaaaagcacttttcttttcattaatctgttgaaactcatatgaaaatttatagttgttgcagcaatgcaagcttattttatcataaaattctcatggcagtaatgctgtgacataggcattgctattatgtctgtttttcagagatttcccaagacttagtgacttgcacaaggtcacataaccagaaaattatttagccacgattcagattcaatcctgagttccacaggacattacttgctatttcttagttactccggctcacgtggataacccatggacataatgaccaataatgaccttcaagtcatcttctttcttattctttttggtctgttaatggcatagtgggatggtttaatagattaacaacagcgctcagcttgtcttgaacttggatttgtcctttcttctccttatgtcactttatgggagatcctacatcatcccttaaaatgacactttgttccgccctcttctacataataatacagtactgaagtatgtatttatatacatttataaattccttcccagatcagtgtaattagaattttctttagtggaccatccaagactttcctaaaaatacaatctctctttgtgaaagagaaaagccatccccattgaatgccctgattaacctagacatgcatcccaggtagaaaagaagacaggggcctggaggcggcctcaaagaggcaggatttatctttccctccaaaagaagagctttttccccaaggaagccagtcccagtgcctgtgattcttttgtcatgatgaagatctgggtctgccctgtgacagtccttcagatacgcagcattacagggcaagaaaaccaaatagaatctgttttaggattttatttcttccttatgtaagtttttctctccaaataaaattaatgaattgctgggatgttttaagaaaagaaaggcgattgtcacggttgctacagtcgtctgatgacaatgagtttgagtacagtggagagtaacaatgattgtattctgtggtggaaatctcctgccatcgtcagtagccagtgatgtcattgaactcagggcttgtttcacattctgactgatgtttctctccttctcccaaccagttagagctgaaacctcaaggccgaatgctaatgaatgcaagatactttctggaaatgagtggcaagtgacatttcttcttcctgtttgggggtgaggagggcatggccttctcctcaaatgcagcttattttacctttgcaattattgtagaagagaatcaggagaaaagagaggcacaaaattgttttaaaattctcagaggtgctcaggcatgactttaaaagacactatctgggccggaaaaacgtagaaatataaaacatttatagcacttgttttaagtgatgtgaatccatatgcccaaagctcttatactctgtctttagtttagtttgggaattcagtctaaatacaaaagactgttgatgtgtggttatgtgtgtacacattgtctatggttaaatgatgtgctctaagaagctaccatattatcagtagaatacaaaataagtaagaagtcaatcaatatattccataaaattagtaacaaaatgctaacacttgaagttagtcacctcaagtccttttaggaacaagaaaaggtgagaaaacacattgctaaagggttttgattccatgttacatgtggactttggccacagaagtgaaatttcccggtacgatgtgctgagacaggctgtcagggctgtgtatgtgaatcaaatccccctacttagaaaatcctaagtcacagcatggacatgtaaacttactgatggtaaattcacttcattttttcctaaattaattttactaccaagaagaagcaagtttaactttatacatttatggtgctttctgagtttcggcttaccatatataattcctccgtgtctaaattcaaacaaatacatcagagaaaacaatattatgaaataatcatagaaaacttgaacactcactagatatttgatgatattgaggcatggtgaattcatcttttaggtgtgataataatattgcggttatgtttctttaaaaggcacactgatcttttacatatatatgctgaaatattttagtaaaaggcgaaagatttattcgatctgaagaaaaaccagtgaatagctgaaatattttagataaaataatatgataccatagttttgcttcaaaataatccaatggtatggggtgtaggatggacagggtgtattgaaagagagtggccatcagttaataattgctgaaactgaatgattgatatatgaaaattgattatagtatttgctcaacttttaggtatatttgaaattttccataataaaatttttttaaaagaaagaaagaattactgagatgggaaaaatgtactctgaaattttatttatttttcctcttggaaggtgtagatatacagtacacatagtacaacttttgagttggctgaaatagagtgattgcaggatatccgaataaccagatttgcataaaatgtgaaagtgctgacctaaataatagtatcaatgatgtttaattccttgaataagagaaatacattcctcccattagtttaaatcatgacccaatgtaaattgaaaaagggtcttgtctgggcatggtggctcatgcctgtaattccagtactttgggaggccgaggtgggcagatcacttgagctcaggagttccagaccaggctaggcaacatggcaaaacccattctctaccaaaaatacaaaaattagccagagttggtggtgcgtgcctgtagtcccagctacttgtgaggctgaggtgggaggatcgcttaagcccaggttattgaggttgcagtgagcagtgatttcaccagtgcactgcagtgtggatgatacagtgaaagaaagaaaggaaagaaaggaaaggaaaggaaggaagggagggaaggaaggaaggaagggagagagagagagggtgagagagaggaaggaaggaaggaaggggaagggaaggagaaagaaagaaagaagaaaagaaagaaaaagaaagaaagaaaaggaaggaaggaaggaggagggagggagggaaggaaggaaggaaggagaaaaagggtccttcaaaagaaagaaagaaggaaggaagaaaggaaggaaggaaagaaagaaagaaaggagaaaaagtgtccttcatcagaatgcaagtatttttggtaaatgattttaagatccctgctttgaaaaacaattccatggatggtccttctattcctgtggaacttaaatattttattagaatgagagagcaaattcaatcgggcaaaaacaatgatattccgtaaacaataatgacataagcctaggaaatgttttaagaataaagctttggccgggcacggtggctcacgcctgtaatcccagcactttgggaggccgaggcaggtggatccgaggtcaggagaccgagaccatcctggctaacatggtggaaccccgtctctactaaaaatacaaaaaattagccgggtatggcagtgtgtgcctgtagtcccagctactcgggaggctgaggcaggagaatggcatgaacccgggaggcggagcttgcagtgagccaagattgcaccactgcactccagcctgggagacagagtgagacaccatctcaaaaaaaaaaaaagaataaatctttgtaatatttaaaactttttatatctagatccaaattgacactccatctctaaatttttatgtgtcaaaaaaatctaattttaaaaaccaaagttatggaataacctaactagaaaattccttgttgatgacaaggaggagagcattcttttaagaaagctcattattagtataagaaatcgtcttctgaaggattcagaaaagcaaaacgtgttcttctcctcagggaacatatacccagaggtggtacagattagacaattagataaaattataacctaaaccacacaaatactgattaaccaagagatcagtgtgtgttgctttcatttcagtaagttccacagtgtgggcattaaaggttagcaagagttgagttttctaaagaagagggatggccttacaaggaggaaaaagtgaaggcttgagcaagaatatgccttgtgtgagggctgtggggagaacagcctaggtagaccagcaggctcctgctgaaaccagaatgaagagtcagagacagatgttggagggcaagaggagtgcatagtcttgggtcatgctttgaactaatgggaagaatatactttctcttactcaaggaattacacagtattggtctacaaaatttcacttatgttatggagaggtgataaaaatctgttctaagggtgtagctacaggaataaaataaaaggaacaatctaaaagaaaatactgttgcagagagatttcatggtagagtagatgaaatatctacagaatgcctgttaagtgtacatagttgaaatgctttataattctttaaaaattaggctgggagcaatggctaatgcctataatcccagcactttgggggccaaggcaggaggatcacttgaatccaggagtttgagaccagcctgggcaatgtagagtgaccccatctctacaagaaaatttaaaaattacctgggtatggtggcacatgcctgtagtcccacctacttgagaggctgaggcaggaggatcacttgagcccatgacttcaaagataaagtgagccaagatagtgccactgcactctagcctgggcaacagaacaagaccctgtctccaaataataataataataattaatccttaaaaatgtaagttgaatgaagggaaaaaatgttgagaatatctcttaaaatagctagactgggaaaatggtaggagtcacagaagtgggagatatggaaagaggaggaaaatgattgggggataaggaattcaaatttggataacacttgagataataccatgtctcccatgtttctcttccatggaagcctcacctcctctacctcaccaggaagtaaatggctcagctctccataacagactactttgttctttctctttgaaatccccttctgttgggtttttgagcaggaatcattttttctcttcttcctctgttctcctattattactcttgtaacttcagaattccccaatgtcatctcatgcccccctgccaactttctatttcacaccttcctgtgcttctctatccattcagtaaccaaccttcaacccacatatcatcactcagaattctccacctccagggactcacactcagaacttgctttttcagagctcatcttcctcccctggcaattctgcccttattctcagacaataagtactagcctttagtccagtttctcttttaccctatttattagcccactttctggcattaactctacctagcctggctcccatgataagcctttgtcagcactctgctctcattagttcccctttgccatggatagtctgatctccaaaccttgcattctcccctctcattctccccggctttgctagaaaaagtcatacagctaagtgtgttacaaacagatggtattagatgacattcctatggttcagactctatgtttggcttcttagcagacctctctgaccagatttcctgtacttacacattttaaggggtcaaattaaactaagtatccaaaattacatttgccacattcacgagtaacctatttcttttgtaacttactatcgtacttaattatataataactcactccacaaaacctggaagtaatttttatagcctccttttctttcaacttccacatgaatgcatcagtcaatcatttgtgttcgtgttgtctagtcaatattttttccatttcatcatctaattacatcattactacctcctgccatatcccatccattctcctatggtggtcctagaagtaacgatgccaagctcaaatctgaccatatcaagcctctgcccctactgcagtgttccagcatctgcaaattgtctgcaggaaagtgttcaaactgatctgacacctacacatcttctggaagtgactgctgatcgtttctgcttcaccctctgcactctggcaatgcccagctagtgctggacccccacccacaccctgaggaaccttagctctgtagctttgcttgttcccttccacccagagagagcacctttggcttttccccaccataccttctcccacacattagtaggagttacctgtccagaattcagcacagaaacatttctgccaggacgtttcttttccaacttccctctttctctccttcacctacctccacctgccttagctggtatagtttcctcatttccgtggtcccacagcatcctgtgaatacctctgttctgacacatcgattttctttccctctggactcttaactccttgcagaacagccactgtcaaaacacgtctcattaattcctttaactgtggtgccaagtttctggtgaggcatgcaggaagtacacaatgaatgcctgctgaactgttcagctggactcaccttggcacttagaaatctccttcatttctttttgattcccacacaatggctattcctaccattcccatcctccttggtttctggggatgcctcaatctcctctgattctgggaggttgaccttgcctccaatataagtggtagagaccccatcttctttttatttaatttttttatgtattttttttttcttgagacagagtttcgctcatgtcgcccaggctggagtgcaatggtgctatgttggctcgccgcaacctccgcctcccgagttcaagcgattctcctgcctcagcctcctgagtatctgggattacaagcatgttccaccatgcccagctaattttgtattttttttagtagagacggggtttcaccatattggtcaggctggtctcaaactcccgacttcaggtgatctgcctgcctcggcctcccaaagtgctgggattacagttgtaagctaccacgcccagccgagaccctgtcttctgtttgtctctacactttaggatgcagttgcttcctcccgccttctcctcctgctcctctgcctcagagacagctgctccctttcttggttgcacacctctcatcccagcagtcctgctctatcaataaactttacctctgacatcctcaactcttccttctctctgcagtttcttccttattcccaagacatactgcattatgcatcttccccaatcttgaacatcatctcttcttttttttcacctttttacctccttgagtttttttttctttccctaacacattcctttaaaaagtagtttatatttatcagtttctttttcttcccttctacttctattcttagaccctaagactctgggtctccaagattatgagttctcacaagtggttcctgcttcttagccttcaatttccttgatatctctctatcatacaatgctgaaaacttcatttcttttcagcttgcctgatgtgatattgtccaggttttcctcttaatttttcagctgcctcttcttggtctcttttgccatttcttttcctacctcctaaaaaatatgggtacacatatctcggagcctattccacaccatcatatattgcctcttaaggttggctgttctgtgcctgtgccacgtctccctgacttgactgttagccatgcaagggtgaggaataatgtgtttcttcagcacactcagcaaggcagtttactcacagctgctcaggaaacttgtaatttgattgactacaaacaagtgataggttagaccacataaatagattagaatccattagtataaaagaaaaaaaattgcaaaaaccaatgagctcattcaaaccagtaaatagagaaataaatatagtcaatacaaaaaaaattaaagaattctatgtttttacatttattcttttgtaatgattgaaatagagaataatgaaaatcacagaaaataacagggtattaattcatttctagaaattcctgatattttaaaaaaattatagtactatagtctaatgtagaaattgtgtatataactatatatttatagtttataaaaatataaactatatgtagacatatatgtatataaacatatatgtatagatatatgtataaaatatgtttaatatacatataaacatatatgatttttacagtaaaaacctgtatagggtccccataataattcactttcattccctgcatttaaaagtgtatttatacttatttttattttattttatttcatctggaccaaaatagaaacaagtcacatgttataaacaaatgacctactatactagtcacaagttgtaaatagatttggacatttagaccagaacttgtggaagaaggtgattaactcagtgatccttaatttaacccctcatttaccaagccaaatctattatttccagcctagttccaggtaaaaagaccaaaattacctactcttaaagtattaggcaaagtattatgtcccatctgtggaactgttagagggttactggaaatgctttttgtctggaagttggggttgccataaaacaaatctgcggacactacagaaaagacttcagtcctacaatgtgtcctgggatgtggctggattcctgggggaggtttctacccacacagctcctcctttgtctacctagagtgtttctaatctagccactgttagggattggacaataaggtatcttggaagataatttgccccaaacgcattgtcaggctactgccactgcttagccacaatagaagaaatttagtttgaatattattaactcattgtgaaatatgatgaacctgctttttaaatgaaacctcaatgttttgtatttgtaacaaaatagaagaagtaatccaagagtcttcaagctattacaaaattataactctgggatttaaattcattatccttatttatttattcacatatttatttgtgtatcatttttgttacagcagtggatatttttatttctttactgttccttgtgttattctctctcacctgctgtgtccactgtgctgtttaaccatgactgccttacaatttggtgtttcatgaggacctgggcttcagcaagggcatcctgagcattctcataatttgactatcttagtttttcaaccctttggaaagatgtcattcaggtatagggcactgtaaacagtgactatccaaagcactttcaccaatatttatgagcccagagtaaaatgaatagattgaatctgatggtttgatgctgatgactaggtaatgcacaggattacctagacaccaaaaaaatgcagtgagctattaattttctggcctttttcacattggtaaatatggttggcagctggtgtgtctgatcactgtggacatcaggaaccaggacacaatgtcccaaagttcctttctcctcacacaaaatcctggtcagctccccctagtctactccagcatgtctccaacaacctgctataaagcatcctggcacctctgaaatgctgttcccaagaggctgtcagtaaccatgtgattctctagaattacagacaggaaagcctttgccacttcctgccttttctgactgagtcatcattgatggtgacaaagagaggttgatagatcccttcaaagttctaatctctggttttgaaacttgaagaggatatatcgctcagcccagtcaaagaggagcgaaggattgagccagcaatccaacattgttttcaccctctaacaatatgccctatgatgaatctgtgttgtagaatttgaggaaagatgcttagtgtggtacccaccataatgagtacctggaatgttacagcaggtactcagagctggtcctcctccatcccttgcccatctccctcccctcctgacccagcttagaataggagtcgtccttttgcagaacttcactttcttcccctctctcttcctgtagacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggtacagtaacttggcatctccctccaagcttcgggttatgcattttgttgcgtcttcttaatcctctacgctggcatgctccactgtggggggtgtgctggagtaaatgctacctcagcgttgtcagggaccttgcctgaactgagaaggttcaaatggtgtgatccaataaaagaggtgcatgaggaagccaggtctagtcaggaaaaatgcccatgggattttagtttctgcctcaatgggggggctattgggggtaagtgggaagaaacagaagtgaaaggtatctttattacaaacagttttccagttttatagtcaaaacttcccccacctaatggcccaaccctgctggtgctactttttccagcaggcagcactctgccattgtagctaatggtttaaatgcttatgaggctcttgggtatcttaatagccatcaaacagatcagtttaaacctcagtaaccacatagcaaaggctatgacagagtggagacttgaaataactcctgtttctggctctcagcatcctagcctattaagggatactcttccctttaggctactgcagaaactgttaaagcacagctcctgtgtaaccagggtatccacatgccagatcgacttggcgggttttcatcagcctgctttcgtctaatcacttgaacctcctttctctctaatcatggatgtcactcaggaatcggtcctgcatgtgagactttgttggttgcaaatattctcagatgctcagaaagaggaaataaaatgttacagatgtctttgttcgtctgtagtgagctcagcgaggccatgaatttttaaatctagcacagggaaacgtgctacgaagagtctgtgatgcatgcattttcattcatgcattttaatctctatatgtttggaaaatacaaggatgataaatcagccagttctcatttatttaattatcaaactttttaaaacgcagcttcaaatgaaaaacactctgttaatactcttggcaaatgatacaacagggctgctgatcagaaactgctctgtgatcttagggggttatgagatctcatccatctcttaaatgctgttggtgctgatgttgatgccaacattgaaataaatcagcgtgtgctttattacaggggcctgaacaaacagggctaccagtgccgacgtaagtaagagggttttggttgcattaccatcattctttttatttagttattccttaggctatgaaaatcttaagctgtgatttttttcttcttttcagaatgcaatgcagcaattcacaagaagtgtattgataaagttatagcaaagtgcacaggatcagctatcaatagccgagaaaccatggtgagtatttacactcctctttgacgtgcagtgatttttatcagaacgttaaatgttacagcccacgaattcttcagaataatgccagaacttgcatcctcccatttatcagtgaacatccatctccccaaaactctttcctcttcaataatgattcttactgaattacccaaaccagaggatgaattagaaattagccaggcctggtggcataagcctgtaatcccagctactcaggaggttgaggcaggagaatctcttgaattcgggaggcggaggttgcagtgaaccaggaccatgccaccgcactccagtctgggcaacagagtgagactccatctcaaaaagaaaagaaaaaaaaaaaagaaatctgcacttgtacctcctaaatatacacaaattatatacaggaagaattttcattgctctacttttccagaaaaatggcatagaaagtggccagaaagcatagtttagattaattatatgagaataatccttgtggcacccccagctagaagtgacagtaaaagagtaaataaaggcaaatgatgataagatacagcaacatggcatttacaaggttagagataataacagaggcataattttatgttgagaagcaaatatttcttttagagtaaacgttgaggtataatcggaagacaaattacattttacctaatggaggggggaaactgggctagcacatgggcagtgtatcattatgaattttaaatttttaaaaatttatatgtatttaggaggtacaagtgcagatttcttttttcaatttttttttttttttttttttttttgagatggaatcttactctgtttacccaggctggagtgcagtggtgtcatcttggttcactgcaacttccaccttccaggatcaagagattctcctgcctcagcctcctgagtagctgggattacgggcatatgccaccacgcctggctaattttcgtatttttagtagagatgcggtttcaccatgttggccaggctggtctcaaactcctgacctcaggtgattcacctgtcttggccttccaaagtgctgggattataggcatgagccaccacacctggcctacaagtacagatttcttctatgcctatattacctggtggggaagtctgggcttctagtgaacccaccatccgaagagtgaatattacacccaataggtaattttcaatcctccctccctcccatcctgccatctgtagtctccaatgtctattactccactctgtcactcattatgaaatcttttgacttccttctcccaccgtttcctttttcattccacaaatcctcactgggtatctgattcatggaagataccgcattcttccaatgacagcataacacaaaacagacgtggtcctgcgaagttggagaaacagataataaacagctatgtatggcttcgatttatattaagtgctacaaagatagtgaacaaggtgcaaggtggagagtaagcatgtggcctactgagactctgtggtccgggaatctccccaacggagggaacattgaaactgacagctgaagagtgacagagctggttaggtgaagagcaggaggaaggaagctccttacaggctggaagaccctgctgagggagagtccaatgtgttccaggaactgaaatgggaccagtgtggtgacagctgcaagggctgcgcagactggaagcccacactggggaaggcaccaaggcctgggtcatgcggggtttctttggagcctggaaaaatgattgtattttgtgcaacttgtagtagaaagcccactttgggatgctgtagtagaaatagtgcgttgagatgtgaaagtgaaaccagaggagatggaaggaatcctccaagcggggaggttggtggtttataccagtgagacgtcagcagaggtggagcaaaggggcaggttctcaggtgattttgatgttagaaatgactggatttgccaaaagattagatgaaagaggtggatataaggatgatgccgcaggttctggcttctgcccgaggccgagcagtgtggtagataacagagccacgacggagtgaagaagactggaaggagagatgaatttttccagtttggacatgttgagtcggagaggtggacatccaagttgaagcatcaaatagacaatttcacatgagcttggaattcctctgggacaagggcccaaccctataaatttgacagtgaccatcatataggtagattttaaagttgctgaagagattgcctagtgaggaaatagagaaagttcaggactgactacaaaggaatctaaaatgagatgttaggtagaagataaaggacagagatagacattgagaaactgggctcagagaccgctcctcctacacccagagtctatgaagttacagaaaccagaagaagaagaggtgggttgtgttctgtgcagttgaggtgttgaaattgaggcccacgtgcagatcttcacaggcttaaatcagagaaatgtcaggggcatcttggaggcattagtctgattgacctgcagaagggtgactgaggtgatgacatgaaaacaacctgtaagttgatattatgaagaaggtgaaccatgaaggagatgatggacagagaacagtggctgggaaatgagaccccaaggatggcaagtgctcccgtggccagggagagatggataaagctggagagacagataaacaaaacagtcaagtctgttggcaggaagcgaagagggcctgagctctggtggagactggtccctggagcttccacagtttaaccggaagggagtagggcaagacagttgctgatggggatgggtgtggagctttggtgatgggcacacaaaggcgcttcccttagactgcatgtgtcccccatggagtttgatggctggaggaaggaaaagagaaagcaacaagtgccttcgaggaaaaaggaagatctatgagataattatcttagagaaagcaaggtgactcgtgaaaagcagtcagactgtggagcagagctgaaagtccatttgaatttgacggagtcagcctgctcaggagtatgattttctccaacaaaggggcaggttcagagaaggcgaagtggctgggtttttccagagtagaatttctcctaacatttagaagcagaaggagataaacttgtgctaaccggtgattctgctaagactcaaagaggttaaagtagtttgttcatgtttgatcacctgtacgtggcagagctggtactaaaattaagatcacaatctctcagaccatgtttttgcttgcttagatcaaattttcacctcccagacttcttcctttacttgatgccttcagcttttctagaaaaaaacgcaaatctctgaatcactgttaacctcaatgactaacaaagttcctggtacaaagtcttgagaaactgtcagctacataaataaatgtctgtgatattatcttctcccaggatattttgatttcttgttcactcaaggggacatcatctttgggattcttttgttcctctacccctggagcagtattgtccgatagaaataaatagaatgagggctacatgtgtaattttacatttccaagtagcccacattaaataaaggaaaaagcaatgggtgaaattaattttaataatacattttatttaatccaatctgttcaaatatcatttcaacaaaaaatcgacatttgaaaaattcagatatcttaagtaattttatacaaaagtcttcaaactccaggatgtattattttacacgtccagcacatctcaactctaactcaccacctttcaagtgttcgccagccccatgtagctcattggttttcatactggaaagcgtgtacatagcgtcttcatcagccatggtgtcttgagctgtttgcccctgcattcaagattcgaagtggtccccttccagcctggaccttgacctattaattgtccatatttaaactgtggaatataagtgagtcccgaaaattatttttttcttggttgaaaatggctgtagtaagtgctgagcaatttttaatcgattctacacaggctttctaaagaaccaacgctgaccagtacccctggcgggaacgttagatctattgctgtgctgatgaataaggcatctttgctatgcaccttcccaaaggaactgttgaattagaaacttctgcagagattataaacctttagaaaataaagcattttatcctgcacaagaatattcacattcttaccaggaatccaactatccaagtgttttgttgttcctgcaataagtttgatttaaactctggaaaactgttttttaaaaaaattccatgtcgatcactagcatccctctcccactcccctctccctaccccgataagccttcacatttattttgagacagaaaagagaatggctgggctctgattctgactgccaagcttatagatatcccagctctagagctgcgtgtcctgggcaagtttcttaccttctctgtgcttcatttcctcgtctgtcaaaggaggatactaatagaagcgacttcaaaaggggtattctgaggattacgtgagatatcacctatgtaatagatgatgcgtgtgacatatttgttaaccgcacctggcaggaactgctccctcctcttgccacctcagttcatgaataataggtgtgaaaatgcttctcacattaggcagtaatactgataaacccatagaaatgtttcctttaaagaaggcattttttttttttttttttacatcttccaaaggttaaaagcactagttctggactgaaagagaaaaggaaatatttatagtaaaacaggaagggaatcttcatctatttaaatgggagcactgtttccttagcactttttaaaataaccctcatgcagtcttcctgagcttttagcctgtctgtgtgaatgcctcagatttcagctgtctgcaaggttcttgctacatgcagaaggcaagcatgccccgtcacgtacagttgctgaggctgcctgccttcttcaggcatgactgtagggcttgacaagtgacaatgatggtttaaaatgcacacaatgccagtgttttcattatgatctctgttagttatgctaaggtatctgcaagaacatccaaagtcggggccccaggaatacacagatttcaccttctgcctttctttcagttccacaaggagagattcaaaattgacatgccacacagatttaaagtctacaattacaagagcccgaccttctgtgaacactgtgggaccctgctgtggggactggcacggcaaggactcaagtgtgatggtgagtccagtgggggatgagcatggcccgacgtggaccccctaggggatggagcaaggctttctggggaactggagggaggatgtagggggtaccacttccacacccagcccagacaagtcatgatcataagtatggtcttctggggcaataagccactatgttcctttccttgcaccctgcaacacccccacccacacatcccagaaaagagcacaacagttcaggttcaaggtcaaactcctagctccatcaccttctgccgtaccatagccctgggggaaatgaagacagtgtttctcctctcactggtctttctactactagtttcctcagtgggctctgggctgccccttcctaatcccaacaggtctagctgtgtggtaccctaacccttctcctttgcaccagccagtaagattctttctgtcatctcatcaaggagcaagcccagcacattcatttggctgacacatggtcctgcacagaaattctgtaacattagcttgagcatccatccctaaaccattgctgtgaactccaagtgcccagtaagaggctggcccggttgtgaccgtcattgcctgttttctggtctttcctccaaggccaggatcgcagcagagcctaacctgccattcattattgatggagtttctcagacctaccatcaaaaaaggaaacaaggcaaggctttcttgctgtacaactccaagttgctaaggcgataacgtttagaagctgagatgctgttacactaggattaaggactagggaagaaaaaaaaaaaccctcaagaactgacaaggcactctgctttctggttggggagagacgtgggcagagcccagagaatagagccacaaaaggagaaccacctgttgcatacagacagcttctgatttttttcttcttcttttactttttttctgagacagggtctcactttgttgcccagactggagactggtgtgcagtggctcgatcacagctcactgcagacttgacttcttggactcaagcaatcctcccacctcagcctctcaagtagctgggaccatgggcatgtgctaccatgcctgtttttgttttttttgtttttctttgtttttttttttttttagaggtatggtcttgctatgttgcccaggctggtctcaaactcctgggttcaagcgatcttgtctcctcagcctccaaaagtgctaggattacaggagtgagtcaccatgcctggtgagcacagaccttttcttatgatgaagtattaaatatataagccactttattttttcttggcagccctattttgatcagtgctactgactaatgtatgtcctctcttttgagcaatgaggtacgtgatggaaggcggcacagcatcttccgcattctccccttcttcatcccaatcctgttcacatgtctggtggaacccagagcgacctctcagtggaggcaggaggggttaggttttcaaatcattacctaaagcagacatcacaggaggccaacattagcctcaagaatccgttcctggccccaaaggacactgacacgcttttctctacacccctgttcaagaagacatggataggcagggtattaagagttcattaggaggtcagagacaaaacgtagtgtcccggcatcctgcatcctgacggtatccacagaaacaggagaaattctcgcctcttggttctcctgtgatggtctcaggtcgggttctctgtcctgggagcccgagaatccacttgcaagaagagctggtcccagcagcgccgcggcacagcttagaacttcccaggggttcctgggcgttatttcatggctcttctgcctgcttcgtttcatttctttccttgaatactctttcctttccgctccattctgttccccgctctctcctaccacctacatttcaagtgctcccctcccctttttcttttgtcccctctcctctccctcccctgccctggtttgttttccattcttgcttctgacactcccgggtccctgcccctccactgtgctcaccccgcctgctccgctcaccccgcatgcccccgcgtcctcctttctcgactcttctcgccctcttctccagctctcttccctccctctctgcctccctttcatcctgcctccttgcaggccgtcgtcttaagtagggcctccttagccttttaccctgccttctctttctccccacaataattcccaagaaaatagtcatccaaagggactctttgccctccaagaaactgagttacggcctgataggttagtaacaaagacttaggaccttctcgtggagatggtggtggcctttcttcgcggccatgcaagtcacagagaagcctagatgtggctacagttttaaggagcaaagtaaaactccatccctctatgttcaatcctagctgacaacctcacttggtgtcacggtgatgcataagaaaatggagctggggctaccgaagttgaaacctgacaccttctaaatagggcgaatgtgagttatgcgagttttgccgacaatgtggaatttggagcacaatcatgaaaaaaaaaaatcctttctatagtaaagattttaggccgggcacggtaacagacctgtaatcccagcactttgggagggcaatgcggaaggatggcttgagcccaggagtttgagaccagcctgggcaacaaagtgagacccccatctctacgaaaaataaaaaaattagtcgggtgtagtggtgtgcacgcctgtggtctcagctacacaagaggctgaggcaagaggatggcttgaacccaggggtttgaggctgcagtgagctatgattgcaccactgcactccagcctgggcaacagagcaagaccctgtctcaagaacaacaacacaacaacaaagattttaaatatgcagaaaagattttgcttcaggtgaatttttctggctatatctatgcctatatactcggtctagtaatggttaatagttgaccgggcgcggtggctcacacctgtaatctcagcactttaggagaccgaggtgggcagatcacttgaggtcagaagttggagaccagcctggccaacatggcgaaaccctgtctctactaaaaacaaaaattagctgggtgtggtgatgggcgcctgtaatcccagctactcaggaggctgaggcaggagaatctcttgaatccgggaggccgaggttgcagtgagccaaaatcgtgccactgcactccagcctgggtgacacagcgagactccatgtcaaaaaaaaaaaaaaaagtaatagttatttacatagaaaattctgctttattttattattgagctatttgaagaagagtggaccagtgaaaactacaggtgagggttgcccaaatttcacctaaatattttaatatctacatctatgcaataaatgatgaagatgaaaaggaagttgtatttgttgagcgcctgctcgatgccagtcattgtgctaagcttctttgcacacacatgtgcaaatcagcagataagattaagactgcatgatgtcatagcacctggtgcctgcttctattacaacactctctactcacagactctgtcagctggagtttggaaatctttatatctgatttttctgtattttaatggtgatgtttctttttttttttttttttgagacacagtctcgctctgtctcccaggctggagtacagtggcacgatctcagctcactgcaacctccgcctcccaagttgaagtgattcttctgcctcagcctcctgagtagctgggattacagatgtgcaccaccacacctggctaatttttattgttattatttttagtagagatgaggtttcaccatgttggccaggctgctctcaaactcctgacctcaggtgatctgcccgcctcggcctcccaaagtgctgggattacaggtgtgagccaccacgcctggcctttaatggtgatgtttcattagcaaaatttgaatttctaaaactaataattgtctttacacagtcacatgggcacacgctctccagtccaagagggatctcttggtcactggcaatggaagttagattctatgctactgttttcaagattcatgaatcagaatactcaccctgaattgtaggatccccaagctagaatcctgtatagatcatgagtccagtgctggagatccttaatcgggagcccccagagcgttcatgacttgcccaaggtcacacagtgtccacgctgtgcaagctgccaccagcaccccgttctccacccacctgacaggtgctcgagtatttccctctcctctttctttttctttaacatcttatgtgacttataaagatgacagaaaactttggttctttttcttcgagttacctttcataacaggttgtagatgtcaatttacgccatcagttcatgcgtgcaagaaatatcactttctttatgactgtgagatccacttagttaacattctcatctagtaatccttggggccctctacccttcccataatcacacgaggttttcaggaggcatgggtacaggggcctggaaactggggaatgtgctcaaacacccggttgctgttggcctcctcatctaagcccacactggtgaagcctgtggctttatgtttccacaccgtgtgtagagtttgtgatttttttttcaaagctgaggtcctcatgcctggtccagtcttgctaggtgtgttctgccgtgacctctcctggcattgctagcctcctcctactccatcccttcccacatatacactccggctccaccgtctgatatccatctgcaggctgaggctgcctcctgggcttcaacctaaaggctgggggaagctcttcatggcccaggtgggaaaggggatgttttggacccagactggagtgggcaggaatattcttctgatgcagggcaggtgagccccaaagtggggcttagcccaggagagttcttggcttcgcccaggaagaattcaagggtcggctgttggtagaagaaaacagcttcattggccaacggtattacagttctgttggtgttacagctccatgactgctcctgcagagcagggctaccccagaggcagagagtagcagctcagggcagtgctgcaatcctatttataccacttttaactacatgcaaattaagttcctggaaaaagggtggtaacgtctgggtgttgccatggcaacactaaactgacatggcacgcaggtgggcatcttctggaaagctgcttctgccctgtccctgttttagctagtcttcaatttggtctggcgtctgaaccccacctccagagttgagtcccacctcctacctcacttcccttccagcacgaggatcactaccagggagagccagggtcaacttcctcccagccgtggcactttaggctttcctccctatccgcaaggctctgtcttacctccagagagagttgtttagcaccagggggttcttccactcttgctcactatctgccttcttccttccagcatgtggcatgaatgtgcatcatagatgccagacaaaggtggccaacctttgtggcataaaccagaagctaatggctgaagcgctggccatgattgagagcactcaacaggtaggagcatgtgccgtggacacgttcccgccatggccgctcagcaaggatgtccatgcacttctgctgcttcacctgtggcagccctatgggaaatgccgggatgtatttctgagcaccggccttgcccttggctttcatatccatgcccacaccccctatctttgagatatttatttaatgcatttgtattatgcagatctttataaaatcttaaattcttcatggcatgagcattgcagaaacaaataaattcattaaagttattgaagattcattgacagctttatgtgaatatattcgggttatagaatagcctgggggaaaacacttatgtgctagcatcatcctcatggaacaccgagtccagggcaaatttggcctgctgtttactgttttggcattagctgaattcctagatccaaggataaaccctctttaagacttggcattgcctgtatcagctgttttcccatccattaactacctgtccttatttgtgatggaatgatgtagacagcatgagagaatcctgtcagccccagaaaagtgtgaaggaggcaaacgtgttcggctaatgcataaaatacagtagatagactctcccagaatatggggttccaaaagaacgttgaggataaggagatctttgttgaccctatgcatttaaacattttaaatggcctttgtccccatcgttagcaggctgagctgttccatcaatggtgggtgggtgggtggtctgactctctgtttgtcatccaggctcgctgcttaagagatactgaacagatcttcagagaaggtccggttgaaattggtctcccatgctccatcaaaaatgaagcaaggccgccatgtttaccgacaccgggaaaaagaggtagctgtcctgatcagcagtctaatcactgtcagtcattaatctcaattaaccctaacctaatgcccttggatttaagttatcagcttacctggtctgataggtgatccacctccagctaccaactaagaggctcccacttcttagaaaagaaactaaaaccttttacctttgtaaaaggcaggaggtgggggttagaaaatgggataggtctggagggaacaaccacaaatgttttcttagagtttcagcatgttacattctgtcagtgtcaaatggtttcacagaaataaatctgtcttaaaatttgatggtgggaaggccacagaagacattcttactctgcacctttgagacttaaatttaagggtaggaaagagaaggactcaaagccactttcatgacattatggcagtttttccagcctactgtttgaaagcagttcatgagtggatatgacccatgtttctgagacctgagtcgtttcagcatacattctaaaatacttagtgtccttggaagagtatgaaagataaacctagggatttaaaaatatagagactattgtaggcagggggaaattcctaaaaatttctcttatgttttctctgacttcaaatcaacttaaaaatgtaaatgaaaggtttgggttacatttaggaggggttgccaggcagtcaaggagactatgtcttagcaatgatcaacataggcagcatcttttttttttcttttttgaagacagagtcttgctctgtggcccaggctacaatgcagtggcacaatctcagctcactgtaacctctgccctgtgggttcaagggattctcctgcctcagcttcccgagtacctgggactacttgcgcacacaaccgcacccagcgaattctttgtattttagtagagatggggcttcaccatgtcgcccaggctggcctcaaatgcctgagctcaggcaatccgcccacctcggcctcccgaagttgtcagattacatgtgtgagccaccatacccggccaacgtaggcagcatcttgacttgaattctgggatgaatgatgcagttcagatctttaaaaatctgctagatttcatttcctgtctctctcacgctgtaaattgtagaaattgatgccactgtgtttgtgagccatgcaaacaattgaaaatcatttttttcctaaaatttggttaaaatccctagatgtccttgatgtggcattattaacagtgcttgtgtattttgcatatatggtcttttactgattggaatttgtttcttaagttgaactatttcccagtctattgaagaaagagacatagtccacactccaaaatccaaatgccaggctcacagacagggggtgctgccctcacagacagatggaaaggtattaaagctgcctgaactgtaggaaaccctctaaacacccccaattactatgatggagcctcagcatgggaagtagaagagaaagcatgtgctctcagtaactagaatgacctccattactccatgttcatttttaaccaccagcttgcattttcagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtaagctaatgcacgggagaatgctatggcccaactccaggaactgatgagccaagttcctggtcaaagaaattaaactcatagggccactaggattgcatgtgagtgtcagagacagctttcctgagggagcgctgaataaatagggaccccgagggctctaggcccatagtagcctcagctttctggaaacctgtgtctccaaagctactttgcttggagagtgtacatctcacacgcctatgagtttgatgtctttgggcaccaaagaaataggaaggtgcctcagccacttcctgtttcacacggtgtttgtgtttgtttcattttgttttctcttcttttgcttcattctcaagcctggagtgttgttttagtttgcatgtgatttttttctctctctattaaatatcttccagcttgtataagtttccttggggtgtgatagggctcggctctgtgtccccacccaaatctcacgttgaattgtaataatccccaggtgtcatgggagggacccagtggaaggtgattgaatcatggggatgggtttttctgtgctgttcccatgatagtgagtaagtctcatgagatctgatgattttataaagaggagtttccctacacatgccctctcacctgccaccacgtaagacgtccctttgctcttcctttgtcttccaccatgattgcgaggcctccccagctgtgtggaaccgagtccattaaacctctttcctttataaattatccagtctcgggcatgtctttattagcagtgtgataacagactaatacaggctgctataacaaaatctcacatactggctggcttaaacagcagaaattcatgttctcgcaggtctggaggatggaagttcaccatcaaggtgttgtctgggttgtttcttcccaggcccctctccatgctttgcaatggtcgccctctctccatgccttcatatcatcttcctcctgtgcatgtctgcatccaagtgttctccttttttgagatgacgtctcactgtgttgcccaggctggtcttgacctcccgaacccaagtgatcctcctgtctcagctccctagtagctgggattacagttgtgccaccacactctgcttaaattttctcttcttgtgaaaacaccagtcatattggattaggacctgccttaataacctcatctaaccttaattacctctttgaaggtcctgtctccaaatacagtcactttccaaggtcctggggattggaacttcagtatagacacaattcagcccataagaaaactgtagcttgagagtcctggaaaaaaattgtggagaaagtccctcctctaaattcttcctgccatacatgcaggtggggggttgtctccatcactcacagatgacaaggagaggaaggaaagagggagaggaggagcaaaaaaaaaaaaaaggggaggtgagaagaaggaagaagagataatttaagaaattataaccaactaccggtgactgcagaaaattttcaagctggtgatttaaggagggatgatatggaatataggcttttaggtaatttttgatattaagggtatctcatgtattaacggggctcctatttgttttacattcttggatgggactcccaggaaaattttaatcagagatgactgttctatgaatctgtgcagccaaaggcagcattatacaccacaactgctcaccagactttggcaggatgtcttacccagtttatttaatattaaacaaactaaaatgcaactgagcggtcaccacagctgaataatattgagctccatttggggtttggatttaaacactgatgccttgcctttcagcagaatcgactctgtccagcacatggtagctgatattcaggaattctttttgttcagttccacaataatatgaaccacagtaggctcatttggtgctaatctgagcataataggcaatgttacagccagtcttcattgtaatttagcagcaattaatgtgcaattataacctgttaccaaaaattgaaagcacattatatagatggaaattgtctttttggcttcttagtttatggctggttttagggtgttttactgaaagaagcaattactaaaagaggacttttaattgttaatgaaatgtttatctttctttgttcccatgtggatttccacatttgaataaggttaataaggaagacattaagttaaacctacaagccttagtcggtatcccaaggtgcagctgggagccccaggtttcccccactccatgtccaaagctgtctacttcttttcatcaggaccctgggtccctatacacggagaggagaggagggggagatatcaaagcaagacaggatggctgtttctctttctcacaacactgagaatactccaaaacttgtcttttctctctcttctggctttatgtggaaagtatgtttcctcaccaagacctctatacccttgttctcaaacaaattttaagcctaagaaaacaaattgtgtgttctctggggatgtgagcatcattcatttgcctgaattcccatctaagtttcatcccttcccttctatcaagtcagctaccatcaagctacgaacctgctccgtcgcttttaaacctagacacttacatgttcagggctgttgtcacatcattgacttcggcctttcccaaaagtcaataacagaaacaaatgacaaatgactgaattttagcaactgtgattcagagatcattttagagtctactttcccaggtctcatcttacctgactttcacaacagtcctgtaagttagagaatgcagtagtaattggaaactgaagcccagaggggctaattcatctgcccacatttccacagctaataaatgtctgtgaaataaaactagagctagaattttctgtatccaaatgccatgcccttaccattgccaacagtgtgttgctgcatcatttgcaaaaactaaaattgttgaaaccctccatcatatgccatctggtgtcctttgatataagagccacaaaatcaagtgggaaaagtagattttggagttaaatcttccctcatagctccaagaatctgagcaagttattctttgaactcagtgtttgttgttgatgttgttaacttctgtcttgcagagtgtgatgagctaagaattaaattagataatacaattaggtcgtaagtgtaaagtaggtagcagagtgtatgacacacagtaggtcctaaaatgtttcattcccattttggtgtcctttgatacgagagccacgaaatcaagtgggaaagtaaacttcggagttaaatctttccctagtagctcgaagaatctgagcaagttatcctttgaacccagtgtcagtcacattttaggacctactacatgccatacattctgctatgaataattcattgctgtgttgtcagagaaaatggtgtttacttatttatttttttttattttgagacacagtctcactctgacgcccaggctggagtgcagtggcatgatctcagttcaccacaacctccgcctcccaggttcaagcaattccccacctcagcctcccgagtagctgggactacaggcacccaccaccatgcccggctaatttttggattttttttttttttttttttttttttttagtcgagacggggtttcaccatgttggccaggctggtctcgaactcctaacctcagatgatctgcctgccttgacctcccaaagtgctgggattataggcttgagccaccgcacctggccggtgtttattttttaagtacacaaggagaactatatccctccattcttcttttggcctggaaaaactgggtaaaacgtaaagctaggatttatgtgcacttgcagtgatgtttcgagtacagtttctcctctccacactcaactcttctttcttcactgtgcactttatctctctggatttttattgtaccttcactcagatccctgagcaggcagggcacacttttaaaaatccattcaattgcttaataattttgtgaacccttggaaagagtacaaagatagtatgaaatagtgatgtcatgtccgaaaccagagaagtgctccattttgtctcaggaatggcctatgcaggatggatgggggttggagaaggaaccccttttcccacccaacacaggtgtctctcaggactctgtctcttttttaagaaatgggaatccaaattctaaaataaagttacttcttccctctccttctaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggtatggcttctgctccgacaaccctacctcccctctaacctgtctcagcatgataccttcaatggcgccctcattaggagacacgagtcattgcctccatatttatcttacatttcggtgtacctgccatccatccaaacatcccttctacacaccatggaagtattacttagaatgttttagtgtcatcaattgggaaagatctttacttctagatttgtttgtctgttttcctgttttttagaatttggtttcatttagcataacaaccaggcttctcagcagtccgtgacttaggggaaaatgtaacaagtgtttgttcatctaccctgcatgtactggaagagataaaagttggaaaatagatcaaaacgcacgtacactattatttttctcttcaaggctggcagaaaaagcagccttggagtgggctcatcagtgagcaagcccctgagctgggaggtggaggttggatgcgtctgcattcccactcggtgttgggaccctttccttatgctgaatttgccagaaggctgtgccgttctgggaggacttgcatcctggtctcctttttccttaaaaaaacaaaaattatccttttctttcctgactcaaaattattcaggatcattgtagaaaatttttataaactcaaagaagaaaatcacttataatcccaccacttaagatatactcgccattaatactttgaagtttctccttctatagattctctctgcagtggacttctaaaaacaaaaatagcaacccactgtaaatacctactgcactgtactctgcatttgttacactctattttgaacattttcttacgtctttggatattctacaacgtgatttaactagaacatctctaattttttgttctgatttaaataacactaaaatgaacatcctcgaagattagttttcatgcacatgcattatgattcttcttactggtttgtctcctctctgccaccccatcccggctgtccaccacccgcactaattagcagcctcaagtgggaccatatgactaagggccaaagaacacaaggggcggaggcttttccattttctgttttctttctttttgtttgtttgttttgtttgtttgttttgagacggagtctcactctgtcgcccaggctggagtgcaatggtgtgatctcagctcactgcaacctccgcctcccgggttcaagtgattctcctgcctcagcctcctgagtagctgggattacaggtgtgcaccaccacactcagctaatttttgtatttttagtagagacagggtttcaccatgttggccaggctggtctcaaactcctgacctcaggtgatccacccccctcagcctcccaaagtgctaggattacaggcgtgagccaacgcacccagcccttttcccattttctatctcaagccatgacgactggagagtgaatgagggaaaacttctaaggagacttgagccatgggaagaattaatgagggaaccagggaatgaatgaggaaagtggatggcaactggggcatccatcaccacctctgcagttcccagtagattctcagcatatgtgcaataaccaaatcaatgaataaatgcacttacctaagataaagagaagccagaccatggcaaagcacttactgagcatatgctgtgctcaaagcactgtggaggatacagaagtatataatacagctcccgaccttgagaacttcacactctaataagagtcaaggctgcatttctaacagtatgagtaatattagatcagaaggcagacacaaagtaccagagctgagagaaactagaaagaggaatttgaatgggcagaaagggccttgggcatgaaaggtgtggctgcaggagaggaagtagaaaagagtgaggtgtcctggtcaactatttaggagaatgcaggcccgcttcctgctgcagggagcaggctggaacttcccatgatgaaggctagaagagattttgtactagaaactccctcctggagatgataaatacccattggcctgggagggtgaaggtatgtcacctgcaggcaaagggacaaactctgccaccctctccatgctgttgggagggtgaaggtatgtcacctgcaggcaaggagacaaactctgccaccctctccgtactgttgtctagattttctgcacatgctggggctccctgtaatcttttccctttgcagtattttgaggcttgtagcaaactgctaaacacattttttcttttttgccataaataaagatttttactgtaaagctttcatagtagcgaaaaattggaaacaacacaaatacccaatgacagatttattgaataaattattatatggtcagagaaaataatactatataaccattttaaatgatgatgtaaatgcttaaacatcaatacagaatgttgtttatgaaatcataagtgagaatatatagtatttccttttaagcaagaacatttgcatgtataagcatgaaaaataatgaaaaactaacagttgttaattgggaggtaggattataactgattttatttttattatatctttctgtgtatgttactataaacacattttagactgggcttctgggcacttaggcagttgtgcttctcttggtgccttttccccatttttttttttttttttgatttgcatgtatgacagttttcatgtcttacggggaaggctattgggaatcccactttgtagaagataggtatgctcctttctcttgcctgtccatcacagcttcaggcagcatttgtttctgtccctcttatgagagatctccttaacccatttatgcctgaggttgcaactttttgaattttgaaatcagaccttggtgatgaccttgagcagtaggatataaataactcccacatgcttagcgttccaataatggaacactaggcataaatgagttccgtgcagctgggatgctttaccaagacctgagccacaagtgcatccacagcattggtgctgggagagaaaaaaaaacttcagcagagaatgtttacatgaaatgtaaatctgactggctcaagactcagatctcaaggaactgagtccttttagaaagaggaaagaaacaaaggaagaagcttgaatcaccttttccaacaccccgagttgttgtttttgagatgtcttaattattcaaaccttgcttgtcaaagtaactgattaaataccacaagtgaatgcaaaaggcaacgattgatacgtgatatggataatgctttgttctgggaacatgttgggaatgacctttcttgggaggacagttacctgtgtatgctagtgtagacatcagataagataaattaactatgtacttctccagggcattgttattttttaaaggaagttattcatctgctctctgcctccaaagagcgcacctgttgaataccagattattcaggagattctgaggacaggtattcacttgttattaattagggtcatttggattaaattgttaaagtttttaaagttcctagatgagggatatatcacctatggaagggtgaaaatatgataaagccatttaggaagctacaaaatgtgaaaattcctgtggacttggattccgaagttcaagcccagctctgccgtttatcaacagggctctgaggcacccactttacccctgcccaggacagagagtaagagttacaggcagaggggctgggagctgtaaaaccaggggccctaatgggacggcaccgtctggggacatagatgtacaggataattcatgaaatctgaacctgaatctgaatgaggctcaaatcaaaagaatcttcacaatgaattttctgtgtgctagatcaaaatgactttgtacatcatccaggctctggcataaattactggctcagggtctaacgtagatcagcattctgagaggctgctgtcttggcaagaggaaagaagggctagctcttctttcttttactttttttctaacatttctttgttgttaatatttacattttctgtcttacaaagtctgcagggcttgaaattgcacgatcccttctcagtacccccttcagtgcggatgccagccaacttttgcactactagatttccaacttagatttttaacagtttccattacttacattttaaaaagtaaaaaaataggaaaatccacaataaaatttgtctacaagaagagttgtcataaatcttttaactatccacttacaagtagatttaaaacaattagaaaaaaataattaaccataaaactttgaaacacagggaaaaataaacactgaaacagtttccctctttttagttatgctgcagtaaaagaaagattaataactcaagtatccaaagtttctgtgttctatctctgataaaactgtggaaaaataagaggatttatttctaaaatttgtttggaaaggaaagatgcatctaacacagtaaggatgctatttctttttaatttcaaggaaataattttcccttaaaaattaaaagtgaactaaagtctaccttcctctgtgtctcctttgaattctgaaaggccgatctgtattctgacatttaagtagtgttactatttcacacctaagtagctctagatcctataggaacagctctgtctctgggtcgttccctcaggttggatttgagggcaggccgccgtggttttgcaggcctctgaagagaggcctcccagggtgatgccaagaggcagaacgctagtgttcctggattcacatcactgcccttgactcccacactcccaatatgcaccagttgaacattcttggtcaatatcactttgaaatttttcttttatgaaaaagaaaactgagtttcactttctattcatagaacacacaaagctctacttccggttatggcttcagggcatgagtgtgtgagttactttgaacaagtcacctaacatttctttgtgacactggttctccttttttgcttcctaaggataacgtgaaaaataataataataacaataatagcacttgcagagaagtttggatcttttttggagaaagtaccatactaactacaagatattattatcatttaaaattaaaaagaaaaactccttgaacttgatactttttaaaaagtatgtcatcctggtatttccatagttttaaggcaaaatccatctaagaaagtttttaatttcaagcattttattcagaaactgcttcatctgaagctctcaaaaatgctgcaatccatgaacctttcagttgagctaggagccctggaaattaccacaattgtagcaaagaaaagaaaacccacggaaaccacatccttccaaagacgtgtccctgcactaagacaagaattaacttttcatgctgcccccatctgtagtgacagataagcctcttttctttaacgtcctctggcggcgttctgatcctgagaacgcttacacgttgttatttcagaaactggggatcactcagacattctgcaggttcccctgctatgtaaccaaactgtgatttggcaaatgttagattttatagcaaatttacaaaaatgagtcgatttacagctgtcaacctgaaataatcaaaaaggccagaatctaatttaaagagcatttattcaaactcaaagtttgaggatggcccacctggaaacaccccaaaagaatgaagtcagagttgtaaaggagggaactttagggtttccatagggagagacacaggcatttttagcaggattacattttttcatacaaggctggtgcatagttccaggaacttggttacaggcagtgtttctttttgggaaagggacatttaacatcttttacagagtgtgctatagtcatgggttttctgtcatctggtctaaggaaaataggacaaaaaaaggaaaaggtaatctttaacaagattcattaattaaaaaggcaggaggcggccaggcacggtggctcacacctgtaatcccagcactttggaggctgaagcgggtggatcaccttggggtcaggagtttgagaccagcctggccaacatggcgaaactctgtctccactaaaaatacaaaaattagccaggcggggtggtgggcacctataatcccagctactcaggaggctgaggcaggataatcacttgaacccatggggcggaggttgcagtgagctgagaccacaccactgcactccagcatgggcgaaacagtgaaactccgtctcaaaaagaaaaaaagaataaaagaagtcaggaagtgtttgtccctgacaattgtttaattctctctagtcattgtacagaacaagagaaaaaaggaagcaagttaatctataatctgagaaacagaagttgtaaccatatgtgactcagatcacagtcgcatctctctcaaggcgtaaaacgcattttaggaattctaacaccttttaaatgttatttattttcacacagtaatttatgggaaattaatgttgcactcacaatgtttccttacagttttctcgtccaaatacacaggaaataacgggcaatgagtgaatacatattcaggaattcttggactaaaagaacaagacactcactcagtgcatctgaaatgccgcatctttcctacatgcctgctttttttttgtttgtttttttctgagatggagtctcgctctgtcgcccagcctggagtgcagtggtgcgatctcggctcactgcaagctctgcctcccgggttcacgccattctcctgcctcagcttcccaagtagctgggactacaggcgcccaccaccatgcctggctaattttttgtatatttagtagagatggggtttcaccgtgttagccaggatagtctcaatctcctgaccttgtgatacacccacctcggcctcccagagtgctaggattacgggcgtgagccaccgcgcccggcccctacacgcccactttttaagctcacagatctgttctcatcttgatgtgactctgtaatattcttccaggctcatggcccatattatctgcccattcctttgtcagccattctcacaaagtcccaaaagtattgtcaccagcttcccagaagacatgagcatttgacatctccttcaagagagtgcctcaggaaagtgcatgccttctgtgaatctactatccctcttttgttttttgttgttgttgttgtcattgttgtgtttgtttgtttgttttgagaaggagtctcactctgtcgcccagattggagtacagtggaacgatctcggctcactgcaacctccatctcctgggttcaagtgatcctcctacctcagcctcccaagtagctggaattacaagcgtgcgccactgcgcccagctaatttttttttcttggtattttagtagagatggggtttcaccatgttggccaggctggtctcaaactcctgacctcaagtgatccacccacctcggcctcccaaagtgctgggatcacaggcatgagccaccatgcccagcctactctccctcctttgaaaccttgctgacaaactacctactctataaatcacgctcagatacactaaatcctacttgtcattcagacgctcaggcttctcagcttacgtgacccagaaagatgattttgctcctgtactgctgggtgtcttctgtgacttctttcatatgttctgtttaaataataccttgtctatgtaaataatacattccttgataccaagatgcatgtttcgctcttttcttttgtttcatttgcccgtagagtgctagataatgttcaggggctgggcacaggggggagcggaagagaaaaagaaagataaatggtctgactgtagatcatactggctaactcaggtgccaggaaggctggtcccgaatagaactgcagaggagaagtctatctttgacaaaccctcttcccacccctctctgacctcctgtttcattattttccccttcatcccagagttcacatgatcttgtacccactgtagctatcaggtctctgccttgatttttttttttttttgcgacagtctcactctgttgcccaggcggctcaatacaacctccacctcctgggttcaagtgattctcctgcctcagcctcccaagtagctggggttacaggtgtgtgccaccatgcctggctaatttttgtatttttggtagagatgggatttcaccatattggccaggctggtcttgaactcctgacctctagtgatccacccacctcaggctcccaaaatgctgggattataggcatgagccaccgcgcttggcctctgccttgatccttgatggcaaaatcgttcttctccatctccttgtctctcccccttaaaacttctgtcacttcaggaacctcttctccaccaccagtcttagagaaatatctgataaatagcatagagcagtttaatatgtgttgttcctagcaacgatttcttcctaaagtggagcagagtggagtttccttattagacccaacattacgttgtatttgaggtgattacagttcccatcctgaggaggtgacacgcatgggactcttcaggggaaactgtgggaatatatgagcgtcagaatcaacgtactgcagaaattcaagtgctaaaccacagaaaagccctcttttacaaagtaggaggaagagcaggggggaaaggtgatagggaggatcccttggggtggtaagaagaggaacagaggagttaggagtatcggaggacaggagaggaaagaatttcaagagagaaaggatcatatatttaatgtggtgaagagttgacaatcaaaaactgagtgtggaatgtgtcatggaggaggaacagacaatacagtgtgaaggagtgagtggtggataggcagattcagtggtgatacagaaatcttccagaaagagttttcagaagatggaagctcattatgactgcagagtgtaagggatgagaatcatgggaaatgcttgagccagagatggagaaaccagacaagagggagactattcaggttgtagccttttcagataggcttctttcacttaagaatatgcatttaagggttcttcttttctttctgtggcttgagaactcatttttcattgctcagtaatattccattgacaactaatgatttgttatgttcttttgttttccttataatgacagactccatggatcaagaattttagagtagggaggggtggtagaggttatcaagtcagatcccctcattttgcagcaaaggaaatggagctccagagaagataagcctagctggtcacaggagagtgctcttttctgtggtcaatccaaaattattagtaaagttgagacttcaagatacctaaacacaaatccaactcacaacttatttaattggaaaattgttcattccatgtcctaaaccttagacccaagcaagaggggttccgcccagcccctcacttagaatcctccctttggcctttctcaaaccacactccttcctgtgaagccaagaggtcgtctctgttcctaaactactccccaggacctcggaattccatacctaaacagcctcaagcctgtgtagacatctccctaggttctgtccttgaaaggggcaggaggagactttcccgatatggccaattaactggtgcagaattttgagggatcctgaatttgtcacgatccttcttggtcattatgaagttatatttcccaagagacagaacatataggaatgtagagcatatttaattgaattgttggtgagcttgattaataacacttaaacctggggacccacagtgtggggcctccctctgcacactcgctccaaatcttgcaaaggttggggctgtcctttttctgattataatgcaacttaatgcttttcttccctgtgtgataaataataacaatgtatgtgataaagttaatacataaggagttcttgctatatgccaggcacagggctaaatactttatatgaattctttcatttaattttaaatatgaacgatagctcccctttcttcttcagagcagaattcccaactctttccatcggctgtcctatgagatgtcccaaagaagagttgaattctatctctggttttcatcttgttgtactacagtcttcgctgttgtaacatttgttacgtgtccttaacatatgatactttgaaaggtgtgatggtaaatttagatgttttgtcataaatattttgatcttaattttatttattttgcagagattgcaaatattctcttgtgtaaaatttattacgttggtttactagccttcggagaaaaaagatacctcgaaaaaaatgactataattattcttttccttcttttcccatcttgtttttctggagagggagtctacaaatctgatcttatttgcatgatatttgccaagttctcagtgcatttacaaaattaactgttattagtctgataaaaatcatgagtttatttctttaatgctataaacctgtcattcatcctataatatatgcacatttgccagccatttccttgtttactcaatatttgattagctgtgttgaatagtcatcacaactaaacacttttccattctctttattctcattctctcctttgaaaagtgtaatcactgtaagaagaaagcagtgtagaagctaggttgtattaaataacttttgaggccacttttacaattcaccctttactaattctagaatattcacaaaatgtcctattcctccctttaaagaactatcttgtgttttaaataatgatatattttgacagctctaggacctttatctgctccaaatgatatttgtgtatgcaaacgcagtcctatgagaattatacaactgattttgttaaatctatcactttgatcttgtatttaatcatcattttttttaagacagggtctcactctgttgcccaggctggctttggactcctaggctcaagtgaacctccagcctcagcttcatgaatagctgagattacaggcatgcacctctgcacccaacttaaataccatttctttaaaacatcaataacacaaacataagagtcatacagctttgattacccacctatctacagaatgtcaacattgtttattgccttcagttgtctggaaatcacaacaaagctgtaggtaatggtgactctctcattttcatggacagggttcatttttcagaggaggaaaccaaggccctgtgatggtgggatttacctgatcacacagctgattagcgacagtctcatttctcacagactagaatttccattcgacagatgctttgccaggagttgttgacagtcggcaagactgggacgcgtttggcatgtcccatcccccaatgccatcacagcttcaattctcacccaccggaaagaatcatttgcctcggttaatgtattacccgccataaagacgtgaggtctagactagtaagtgacatttacaattaacccaacacaggccacattctctccctccctccctccccaccatctctctctctctctctctctctctctctctctctctctctctgtctgtctctctctgtctctctctctctctctgtctctctctctctctctctctgtctgtctctctctgtctctctctctctctctctctctcagcctgcttggtatcctctctcagcaggtggccagaacctaaacggcagcccaggagggaatctaattctgttttcttctttctttcgagagccatcggccagagaactgttcatttgcttcttctgggaagtatttgctggtttttggattggttttggttttgtctttcctggcttttaaattgcttcctagaaggacagctgccatcagttatcaattgcccactgaggaccaatgcagagattcatttccacacacactattttgtttaatacccacagcaaccctaggaggtaggagtattactaccccatttcacaaactaaatgaagctcaggagaggttaagtcacgtctccagagttataaatagaggggctttgaacccagggctgagtaaggatgaagcccacattctttgcaattactctgagtctcattcttcttggtttgtttctatctatgccagcccagagtctttccagcaggcagacacttctttttgcttgcggttctgcagaggttctagtcagctgtgggttgccttcaactctgagctctccttccccagctgtttatgaaagtttgagcctattatatttgtatttaccttttatgatgggattttggattcagcttttaaaaggcttatccatccctcaaaatgtgctcctcaaaatccaaacctctggactgtgtagtttgtatgtgcatacatttgtgctaattttatcacagagcagaacagatatttgacagatttattgtggagcctgcagttctcttgggagggttaaatgtggggcatccaacatactataaatctccattgctgttaattaataatcactagtaacgtagtcttcttctcaccctcatgttagtaaacactgactgtgccctgtgatctcttagactttaatggccaattcaacccccccaatgctcaccactagtgtggcgtctgattcagacctgagaataggtgggaaggtgtgtggaatgcatgggagtggggctgaactgttgcctccagtcccctcccaccactttctccacatctaaattgacagtgttaaattctgaaatgtcagcctttctaggaatttgtaagcatccaaacacttagaagaaaccgttcactcaagcactgttggaaatggtttcgctctacactttcatacgctttgctctcgtgactacttaaaagaagattccacctttgtggcttgtatagggccattatagtttgagtaaaaagctgaggttagaacagaagctctttctgtggtgctgatgagagcaagaggtagcatgagaaagcaggtgtgtgcaggcaaagccaatgacgactctcaaattgggtttgaaatctgtgttaagtcatgatttatgtcagctgagaatttgggcctgtccagaagagaaaagggtgggcttcacttaaagatatatggaattagtaaatcagatcggaaactaacattgaaaaaagacggatgcttaccttgacctggattattgagataattgccacaatacttggtttccccattctgtggtgaccaggcaaggagtctcactgtcagaccagaacaatgtttctactattacctcctatgccccacggcctcggttgggttcacatcaaaacgtaaaggttaattctgttaagaaaccacccaggtgagactttcagatgcaaattcatgcccagacgcaccgaaggtcctcacactttatggattactgattctgtgatgcattacaaccctttaaaaaatcaggtttctctaaagtgttataaatacatttattggaaaaaaaaattgtctcacatcattgagttgctgaggctggttacaatcctggctgatatgcccaccacagcctgaagaccacccagccctacttctgactgtggccactcgagggccccagctctactgacatacatcatgtcctctgccagaagaactccgtcataaactgtggcttgcctctgccatgagttaagtcaggactggagaaaaataaggttaaacttgattgcaagcttcagggaggaatgactgacatgacccgcccactccccccacgccacgcccacagaatatgctcagtagctaattactgagtgttgagtgaatgaatgttttcaagctccgcccttggagtcagagaccaaaacacattctccttatcaccctgcaccctgtcactttcaataagtatacaatcggcacatgctaagtgccctaagtgcctggcaccatcccattgtctggccagcaggtcaactggactctcccttgtgccccccgctcatctgctgggttgtaacacgcaagcatctagatgccacagggcatcccacctagattccccaggcttcctggggctcaaaaacatagattgtttaaatgattttgacagtcttctgataagtgatttcacaacagaattagttcccctgaaatgatctaatccatttaaaaagtagtcctccttgttgtattttctctaaagagctaaaaattggaactgtgactgggtatggcggctcacgcctgtaatcccagcactttgggaggccaaggtgggcggatcacctgaggtcaagagttggagaccagcctggctaacatggcgaaaccccatctctgctaaaaatacaaaaattagctgggcctggtggtgcatgcctgtagtcccagctactagggaggctgacgggagaatctcttgaagccaggaggcggaggttgcagtgacccgagatcacgccactgcactccagcctgggagacagagtgagaccctgtcttggacaaaataaataaataaaaatgaaatgaaataaaagttggaattgttttgtttttccacaggaaaacctcttttttgtgatggagtacctcaacggaggggacttaatgtaccacatccaaagctgccacaagttcgacctttccagagcgacgtaagaggctttaaagggtttgggagttttccactgttcttgtcagttcttgctggtttttttttccttttttcccacttggcatgcctgaatcccagggccaggtgaacccttgggaatacatcgagcaaggcgacagttttcccaggttgtgaaactgaaattcgtgtcagtttggtttcatttctctgtgatttaaaactaactacttagtttcttaaggaaccatcccgattcatcaggcttctaactaacctgagcacagaagcaaatatgtaacctttggaaaggaagcagtgaaatggactgcagacctcaagggtggtccccagggatggagcttgtagctgaggcatcttatggaaagcctgatgtggaggcataaagctttagggagcaggaagaggcacttagtccatctgagaacaaagcttctccttcctagtgccggcagcctgagacacctggagacggggcaggctgtgtgtacctggtgggactgcacctgcatccacagttctcaccaccactcctgcccatgctgttccctttgggtcccacttcctgctccccatgacatgcaagtaaaagaaagctctgccactgggctccttggaaaatgatgagtacatgctagcttcctttgctcagcgctcaataatccctccctcccatctgcatgaacactttgagtggtttaggttgaagtgggttgagaaatggatttggtccgccagcttcttaaaatccctggctggaatggctgtttatcacatctagtgggtagcactctgctgagatcattgctctgggaaacctcagcaatgcacccagaggtaattttactggatttctgcagcagagaaatcatcgggcatttttcatgccggaaagaattcacttagtccactgtcgtctccagccagcccggacccacgctatccatcctgtcctaaatgccttccaggaaggagaattttgcattcttccacaagatccagcaagcttcccttccaggaagctatctcttatatccgaccttaatcccaccagtgatggggtaaactcatttcctttaaccttgtcaccattgaagatgaagtgtaacttatcttgcatctgctaatatcctcttttccacctcatgggctgtaagtgttgcccaggctaaaggttctcagtacgaaaataaaccagctagttctattcagaatggtgcatacaggtctatgggtgccaaccagagtttaaaacaaagggagaaattatttgcctattatctatactattacttttttttttttttttgagtcagagtcttgctctgtcgtccatgctggagtgcagtggtgtgatctcagctcactgcaacctctgcctcccaggttcaagtgattatcaagcctcagcttcctgagtagatggggctacaggcgcccaacaccatgccctgctaatttttgtatttttactagagatggtgtttcaccatgttgcccatgctggtcttgaactcctgacttcaagtgatccacctgcttgggcctcccaaagtgctaggattacaggcgtgagccaccgtacctggcctatactattacttttaatgtctgtgtatgttttattagcaatagcaaaaacaacaaaaaaaatgacaatgtgagcattattgtttaaaatataagaacaagtactagatacaggcaggactcacttaagatgccagctctgttttatgctgttaggactgaggctggaggtgtctgagcctctactttcttatgtgtagaatgaatggacaacatcttccttgttaggattaaacagagttatgtgtgtatgccatttagccatacacagcatgtcagaaaaaggtcagtctgggtttgggattttatttcgttccatgacaacattcatgttgaaccttggttctccttcccccaggttttatgctgctgaaatcattcttggtctgcagttccttcattccaaaggaatagtctacaggtaaattttgctttgtggaaacaaatgctaagatatcggctttcctggctcagttaatttaatcattgcaccgagtgctgtgagacagcccatgtgatttcctgggagtaagctccacacataggtctgctgcccacaatgattacatggatgatgacttacaaccaaggaagacattccagtctcaacagcaggaaagtgctgagctcattctgtcctttatgctggttctcacttgaattccttctttcaccttccttttcccattttcactgtcctgttttctctttcttatcataccttacggtttctttctcttttgtccccttcatacctcttatttttgcttgtctttgctttgagccacctagaaatgcttatggaattttcttcttctctgctgtatgacatcatttcacgttcttctgtccaagctcttagattgacactattgtatctcaatctcctcacttcttttctcaaaatgtagttggcacttatttaacatacaaacctttacaagcttactgtcagatttccaactcactgcagattaggaggaaaaatagaaaggaaaaaaaagaaaggatctagtgaggaggatggctgagctgctggagagcagataattagtattgaagctttggtgcttacagagtgtagaattcacttaacaaggaaggatctctccattttctgagggtgcagtcaagtgagggttgccctatttggagtcacacaactaaaggcttagaggaggtttgagaagtaagtattcttaagcagcctctttgaatgtaattttttttggtctatctacaaaatcatagattaagaatctgttttataattttttaatcttcaggaaattgagaaatactcaccagaatattattttaaaactcttagcagaatttttttaaatttttctttatatgtgtaaggcctgcaatgtatctaaaatatttttgtacctaggcactgactaaattgtgtggggtggatggatagatggatggatggatgatggatgagtgaacagatggttggatgaatggatgaacagatatttggatggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgtacctggatggatggatggataaatgatggatggatgaggaatggatgaacagatgggtggatggatgatgtatggatgatggatggatggacaacggatggatgaacagatggttggacggatggatggatgggtatggatggatgggtgatgggtaaattgaacagatggttggatggatggatgggatggatggatggatggtgatggatgggtggggagataaataaatgaaaggggctgggcacagtggctcacacctgcaaatcccagcactttgggaggccaaggcagatggatcacctggggttaggagttggaaaccagcctggccgacatgacaaatcctgtctctactaaaaatacaaaaattagctgggtgtagtggcccttgcctgtaatcccagctactttagaagctgaggcacaagaatcacttgaacctgttaggcggaggttgcagtgagctgagatcacaccattgcactccagcctgggcaacagagcaacagtccatctcaaaaaatttaaaaagttaaaaaaaaaaaaggggaagtaggaataaaaattaggagggactggagagagagagagacagagatcttagactggaagggaccccgtgaaacctaaacccacatgcctcggggcattttatttccctgtgtcacaaagcttctttctatcatgtcaccatgtaaattattaacactcagaacaaaaaaaaaaaagcaatagatgtccataagtagctttactatcacaacaaattgtacccattttcgagtcttaccctgcccatgcatggaagttatgttctttaagccttcttaggcaccaacaagaaaaaaaaatgagtttattttttgtgctcattaggttgcaggagacccttgaaagtcatcatcaaatagttataactgaggataggtcaccagacaagtatgctggctttaaaactggcctgctgcataataagaaataagttgccttataataagttgaatagtaagaaattattcaactgtctgtgtgtaatttgactcacctaaacttttaatttggcaactgaattaacaaaaggattcaattcatttctttcttttgacctcataggataataattttctgaatttgttcacaaaactgatacattagttttgaagggctgccataagaaattaccccaaatttggtggcttattctggaagctagacatttggaagcaagatgtgggcagggccatgcccccaccaagccctcgatttaccagcctctggtggctgcaggcattccttggcttgtggctgcatcacccagtctctgcctctgtcttcccatggccttctcttgcccccatctgtcttttctaagaacacttgatggatttagggcccacctcgataatcaaggataatctcaccttgatatctttaacttaattacatctttaacttaattacatttggaaaaaaagaccctttttccaaataaggtcacatctacaaggttctgggggttctgacatgaacatacctggacatatcttctgggggccaccattccacccatacagctgatatcacagaccatgtgtgctctggatgtgcaggtctttgtcaagcatggcagtgggtactaaacatagagaagtcccaacccccagaaacctgatgagccactttctggggtttcttcagaggtagaatggattgatgatgaatggatgaacagatgaaaagacacaagctgtacattcaaaaaatgtccaagtgaatgttattccaattaaaagtgcaagagctgaaaggaaaaaatatatcaccagacttaagtaggggagatggcaaacaaaaattcttctgtgaaggtagactttttagagtggaagaggctttgcagatggaagaagtgactccaggaaaggcacagcaataggaaaatggaggaatattcaacaggtgcatccagcttcaggggcaaggctgctgttggtcgatgaaaagcatgagatgtggagaagcaggtgtggtggcgtcactcaccatctgccagaggaaccacaaaatcgacggcatcttcaaagatgatgtaagccctggtttgggtcaaatgtaaaaccacagagccggaaagtatgcagatgtggaaagaagaatctagaacttccaatcttagagtattagaactaagaagaaccttaagattatattttattgacaataaaactgggcccaacccatgtgtttgaagccactttcaatgctttcacgtgattctcattggacgttacaggaccccatgagacaagcaaggcaagtgtcatggtccctgttccttggatgagtcttggaggctgccagaggggaaatggtgaggcggagccagccggccgtaatgctgggattgggaagccaactgtgatgcccactccacctcttccaaatagaaaagctttgcctccgttaacctcatgatggaatgaaagggtgcccctggatgttctcttctgcttgatgccatgatggcctgcttctcctctgacagatgaaagcttgcagagacatgcacaggctgtggactctgaagttctcccctgggtcctgatgccccatagggtgtaagcatgacatgcctcagaataccctgggcctctgggttctctgccctctccagctggctccaggggtcctcactggtcttccttggcactccttcctcacccccatggggggctggcttcacatggcagcctttcagaacctttcccatattgacctagatccctcagagctggccaggcgcagtggctcacgcctataatcccagcattttgagtctgaggcagaaggattgcttaatgtcaggagttcatgaccagccttggcaacatagtgagaccttgtctctacaaaaaattttaaaaattagccaggcatggcgatggcacacatgtggtcaagagtctgaggtgggaggactgcttgctcaagaggttgaggctgcagtgaactgacatcatgccactgcactccagcctggatgacagggaaagacctcgtctcaggggaaaaaaaaaaacctgatatcaagggaagcacctgaattatctttaaaaaatcaatttcacaagtacagaatgagaagaaactgggataatggcacttcataaaggaaagcagaaaaacacctgaaggttttagtttacaataaactcaatattgggcattactgtgatgaaactatgaaaaatatggtgcaggatcttagtccaccgtggcaaaaggcaagaggatggtaatggagctctgggtgccgctgtaacctgcaccaatcagattgtctctctggaggattctggcttcattctgagccaagtcagtcgagaagaaaacggacaaattcaagatatttggaaggtagaggccagaatgtttgcccttcatccagtttcccccagtggccacatctcatgcagctgtggtacaaggtcaaaagggtctgaaaaccacatcatgaggagcgaagtccctgatcttggtgagagaagagaaaacttgatgtcatttttttcaaatatttggggtgtcacatatggtaacaatagaaagcccccttggaccaataggtgacatcacatggaagcaaagttcggttaattgttttttaaaaaatattatcagttacatttccctaagaatggaatgggttcttttaagaggatactagttctccaaggaaacagaagtttgttggcatgacattctggcgttggatggattccggttctcaaggggttcagtattagttaggaacaaacttcatcaactggacttggaattaggtgcagtataattcattcacaaatatgtagaaaatggcatacagtaagtatattttttaggttttcctccttcgtcattaccctcaggaaagtcctgggatcaagggtctccaatgggtatgggtgctctgtcctccttatactgagctgcaccccttggtaaatcagagaaagaatccatagcagccagcgtgcccttgcagaatctgctttgtctacaccccacttggtgtgcaagtggatagatacataagcgcctctcgtgagcccctctcaggctgcaatgagacaaactccctcgcctcctatggaattttatgttaaccaaattatattgattaatgtgagatttgcttcacttttgtttttcagggacctgaagctagataacatcctgttagacaaagatggacatatcaagatcgcggattttggaatgtgcaaggagaacatgttaggagatgccaagacgaataccttctgtgggacacctgactacatcgccccagaggtaggaatgcagtgacaggctgctcccacctcaccatgccctggccacatgccattgcttctttagcccctgaaaatcagaaggttttaaatatcttcattcaagatttgtacctgttttcttaagtatctcataaacgccaccatgcatgtgggtttctattattattttgtggggagcgctacttttacaaatcacatctctccaaggcttgcagagtttggcatttcctttcccccagccttaaaacatattcactctgctcagacctaccagaaggaacagctagtgaagagccaggtggagcaagcgtccacccaagtcaagtggtgaaactgtggggtcagaagacctggactgagtttctaagccaccactgatgtaagcacagagtgattgccaaagtctcactgacttccatttcctcttctgtaaaatgggtataatgctgatgtcattgtgttattgtgagcattagatgagaaagagtgtgaaagttaaaactcacccctgcccccattaaaaaataagaagaagacactgctgtcacattctggacacacaaagaagtgacatttgcacagaaggcatccatcaattcaactaaacccacctccccccttttcacagaatcctccccagctgcccacccagggagattagtgacacccctcccacttggtctttcccatggcacagcacttgttctggttgctttttcatcttcaaatctccctgcatgactggatatttgctctgcagtcatggacagattcatattcactttttaaaaattttcatttcgaaataattgtagattcacaggaatttgcaaaacatagtccagaaatatctcccaactgtgcccttcatccagtttcccccagtggtcacatctcatgtagctgcagtacaatgtcaaagccaggaaactgatgtccatccaaagtgtacatggtgctatgccatcttctctcatgggtagatttgtgtgatcttgttcacttttacatctaaggacctagtgcaggtgttggcatattaaggtgctaatagataccttctagaagagtaaatggatgaactaactaataaacgtgtgattggagatggttgtttgataaagactctggcagacctctgatttcctgggtaaaattattcagcagcaagttcctgtcattgccaaaggagttgtggccatctgagtcctagaactatgtagctttgccctgtggttgggtgatatgtaatttgaatttagccttggcttctattccatgaggaatgatgtcttttagcttacatggcattgttgaactcacagagcgaggcttattgattaaataactttctgatcgtagaaatctatgtttcattcagtttggcacagatacaggttttgatgctataaaccattttcatttgaagtgaaaccaaagctcatcaaagcacgagtgatggggacttaagaggacggactcaactcaattactgaattcccctttgtaacaattctgaaatatgcccaaatgcactctgctcagaccaccctcactgccatccccagcagcagtctcctttgtcactccctcagcctcacctgagccatctcaatttctttcctcttcaccttgcaacaccttggtgtggctgccttactctgatgtattcctgtctacagattttgggtgccgggtcttttccacggcaaaccttccttcccgatttccatctgcttcttgcagaatccggcttccacagcttgcttctctctgcagcttcactcccttcttttcttttacgtgtgcttgtctccacgtgattcagtgcttggtcctcttctcttcttactctacatcctccacgagcaacttcattgatgactgtggtcttcgctgtagagtcaatatggcccacctgcacttcttcctgctgcagacactacgtccactttcctgcttgagacctccaagtaaatgcatgagtccttcaaagacagcaggtccaaaactctctctgttgaacttgctccctacttcactctttccttttctttcttggtgaattacatgtcatccatccagtcttctagagagaaaactaggaattatacaaatttcccctttctttcttacccttcaaatccacccaaacaccaacaccttctataattggaccctctcatgtccattcactgccctaaacttgtgactgaattcagactctcccttgattccttctccaagctcaaacaaatccccttgatccagctccgcccagatctccaggtcctctcgcccttactgctgttaccctagtgcagaacatgagcatctcttgcctggctcttggtgacacccttccatctgctttcctcccttatcatccatcaccagggcatgctctttacatatcttcatgccttttgatctgttagaaaagcatccccaagatctgtctatttatatatgaatcatatacattgtcaccagctaagatagactgtgtgttatcaatgcctaaaaaggaatatgatcaggttatactaacaataatatatagtttaaaataactaaattgcattaatttatttattattattatactttaagttttagggtacatgtgcataatgtgcaggttagttacatatctatacatgtgccatgctggtgtgctgcacccattaactcgtcatttagcattaggtatatctcctaatgctatccctccccgctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccagtttcatccatgtccctacaaaggacatgaactcatcatttttttatggctgcatagtattccatggtgtatatgtgccacattttcttaatccagtctatcatttttggacatttgggttggttccaagtctttgctattgtgaatagtgccacaacaaacagatgtgtgcatgtgtctttatagcagcatgatttctagtcctttgggtatatacccagtaatgggatggctgggtcaaatggtatttctagttctagatccctgaggaatcgccacactgacttccacaatggttgaactagttggcagtcccaccaacagtgtaaaagtgttcctatttctccacatcctctccagcatctgttgtttcctgactttttaatgattgccattctaactggtgtgagatggtatctcattgtggttttgaattgcatttctctgatggccagtgatgatgagcattttttcatgtgtcttttggctgcataaatgtcttcttttgagaagtgtctgttcatatccttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagttgaattagatcccatttgtcaattttggcttttgttgccattgcttttggtattttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccattgcttgtttttctcaggtttgtcaaagatcagatagttgtagataagtggcattatttctgagggctctgttctgttccattgatctatatctctgttttggtaccagtaccatgctgttttggttactgtagccttgtagtatagtttgaagtcaggtagcgtgatgcttccagctttgttcttttggcttaggattgacttggtgatgcgggttcttttttggttccatatgaactttgaagtagttttttccaattctgtgaagaaagtcattggtagcttgatggggatggcattgaatctataaattaccttgggcagtatggccattttcacgatattgattcttcctacccatgagcatggaatgttcttccattggtttgtatcctcttttatatcattgagcagtggtttgtagttctccttgaagaggtccttcatgtcccttgtaagttggattcctaggtattttattctctttgaagcaatcgtgaatgggagttcactcaagatttggctctctgtctgttattggtgtctaagaatgcttgtgatttttgtacattgattttgtatgctgagactttgctgaagttgcttatcagcttaaggagattttgggctgagacaatggggttttctagatatacaatcatgtcatctgcaaacaggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattccgtatgatattggctgtgggtttgtcatagatagctcttatgattttgagatacatcccatcaatacttaatttattgagagtttttagcatgaagggttgttgaattttgtcaaaggccttttctgcatctattgagtaatcatgtggtttttgtctttggctctgtttatatgctggattacatttattgatttgcatatattgaaccagccttgcatcccagggatgaagcccatttgatcatggtggataagctttttaatgtgctgctggattcggtttgccagtattttattgaggatttttgcatcaatgttcatcaaggatattggtctaaaattctcttttttggttgtgtctctgcctggctttggtatcaggatgatgctggcctcatcaaatgagttaaggaggattccctttttttctatttagtggaatagtttcagaaggaatggtaccagttcctccttgtacctctggtagaattcggctgtggatccatctggtcctagactctttttggttggtaagctattgattattgccacaatttcagatcctgttattggtctattcagagattcaacttcttcctggtttagtcttgggagagtgtatatgtcgaggaatttatccgtttcttctagattttctagtttatttgtgtagaggtgtttgtagtattctctgatggtagtttgtatttctgtgggatcagtggtgatatcccctttatcattttttattgtgtttatatgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcagttttggatttttcctgctttctcttgtgggcatttagtgctataaatttccctctacacactgctttgaatgtgtcccagagattctggtatgttgtgtctttgttctcattgatttcaaagaacatctttatttctgccttcatttcgttatgtacccagtagtcattcaggagcagattgttcagtttccacacagttgagcagttttgagtgagtttcttaatcctgagttctagtttgattgcactgtggtctgagagacagtttgttataatttctgttcttttacatttgctgaggagagctttacttccaactatgtggtcaattttggaataggtgtggtgctgaaaaaaatgtatattctgttgctttggggtggagaattctgtagatgtctattaggtctgcttggtgcagagctgagttcaattcctgggtatccttgttaactttctgtctcattgatctgtctaatgttgacagtggggtgttaaaagtctcccattattattgtgtgggagtctaagtctctttataggtcactcaggacttgctttatgaatctgggtgctcctgtattggatgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcagctggtaccagttgtgcctttccatgtttagtgcttccttcaggagctcttttagggcaggcctggtggtgacaaaatccctcagcattttcttgtctgtaaagtattttatttctccttcacttatgaagcttagtttggctggatatgaaattgtgggttgaaaattcttttctttaagaatgttgaatattggtccccactgtcttctggcttgtagagtttctgccgagagatcagctgttagtctgacgggcttccctttgtgggtaacccgacctttctctctggctgcccttaacattttttccttcatttcaactttggtgaatctgacaattatgtgtcttggagtcgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagacacagatttggtcttttcacatagtcccatatttcttggaggctttgttcgtttctttttattcttttttctctaaacttcccttctcacttcatttcattcatttcatcttccatcactgatactctttcttccagttgatcgcatcagctcctgaggcttctgcattcttcatgtagttctcgagccttggctttcagctccatcagctcctttaagcacttctctctattgcttattctagttatacattcgtctaaatttttttcaaagttttcaacttctttgcctttggtttgaatttcctcctgtagctcggagtagtttgatcatctgaagccttcttctctcaactcgtcaaagtcattctccatccagctttgttccgttgctggtgaggaactgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacaaacaggaccctcagctgcaggtctgttggagtttgctagaggtccactccagaccctgtttgcctgggtatcagcagcggtgtctgcagaactatatttattaatactacaaaaatatctatgcttcatcaaaataatgagattaaatgactttttaaaaatcttggttttggccaggtgcagtggctcacacctgtaatcccagcactttggtaggctgaggcgggtggatcatgaggtcaggagatcaagaccatagtggctaacacggtgaaaccccgtctctactaaaatataaaaaattagctgggtgtggtggcacgtacctgtaatcccagctgctcaggaggctgaggcagggcaattgcctgaacccgggaggcggaggttgcagtgagccgagatcgtgccactgcactccagcttggtgacagagtgagactctgactcaaaaaaaaaaaattaagtgctaccttccctggccaggccacactgtgcctctctgccattgcacatccttggtctgtgaccctcccctcaaacagtcaccttctccctaaagttgccaccggctttaggaatcacctgctgttcccttccctgtgcaaccacagcacctctacatccacctgaccaatccattgagcttctccccatcagggaccatggcttatccactcacaggctggagcagcagccctcagctccttcctgaataaacgaccacacaaagtcaaacaccctaaaagttcatctctaagtgtatactgaattccccacctctgggcgtcttttgttaaataaccctccccagcttccccctactccacctggaaaaatcccacccctggtcggaggctgccctcccaccatccacttggtgaagttttctttcacctcactcagttccccattgccccttttgccctcaaaaaccaaacaaaactggagctgtgttctccctcctcagtgccttagagaaatgttagcctctcttgtgtgattctaagtcgatgctgccctgcagggtctttatgagtgttccgctgctgtctcacctacaaacgtgtctgtaagcaccttcagggaggggactctgtggcctggggaaggccgactaggtgaggcagagaattaaaacacaggaacacacaactgctgggacagaggccatctggcaggcacccatcgttcctgtgaggagaactcaaatctcagaagctcatgcatttcgtagcagagtcaggagctacacatgaaaaacacacctgtgctccctcaactggggatcgtctcactaggctgcacctcctgagagctaaagtgcgtctcaaaagccccactgttccccctgtgttcctataataggagcaaagagaggctgatgtctctttggaggtgcaaactcattttgacaaagaataggaaggcagttaaacagggaaatatcgtactttttttttttttttttgaggtggagtcttgctctgttgcccaggctggagtgcagtggcacaatcatggctcgctgcaacctccgcctcccaggttcaggcaattctcctgcctcagcctcccgagtagctgggactacaggcgcgtgccaccatgcccggctaatttatgtatttttagtagagacagggtttcaccatgttggccaggatggtctcgatctcttaacctcatgatccgcccgccttggcctcccaaagtgctgggattacaggtgtgagccactgcgcccagccggaaacatcatactttctatggcacactagacactcagtaaatccagatgggattgcaatgcatggaagcagctccctggagaaagtcggatttccctggaaaccacactggtattggccccaggaggtcactgactgctggggcagcactcacccagttgcacatcatggtggcagagccccgcctgtccagacctgacttcccagcttctgaggctgaaggagaacagatgaggcttgctctggcgtcgttcggtgaaaccactgttcctctctcgctgctttcccgggtttccttgtgcattttgagctgtgcatctgattctttgggtcaaagcaaggactgaaaaagagcagaacacaagaagagatcacaatgaggcaaggtcccggggctgagagagaaaggggccacccttgctggtgtttctccaccacagtctctttaaaaattgggcatgggccgggcatggtggctcatgcctataatcccaggactttgggaggcggaggtaggcggatcacctgaggtcaggagttcgagaccagcctggccaacatggtgaaaccccgtctctactaaaaatacaaaaattagctggatgtggtggcacacacctgtaatcccagctccccaggaggctaaagtaggagaatcgcttgaacttgggaggcggaggttgcagtgagctgagatcgcgccactgcactccagcctggccaacataagcgagactctgtctccaaaaaaaaaaaaaaaaaaaaaaaactgagcatagtgtgaccatgacagcttgaggtttaaaaccaagaggcacattatgctatggaaggaacatcacgtggtaaaatcctgaaagaccagattcagaacattgctctcagctcactaactaggagactttaagtaagacctttggcctttctaagcccaatcatcaccccctataggagagggataactgtgcctagctcaggggggttcttatcaataaaagacataacgtctgcaaaactcctaacacatatcagtattcctgaggcgaacactctgctgcacgtgtgagtttgcgttttacttcttcctcctaaggtaaaactgaaattttttaccaacatcgccaagctttgaagccttaatttgcaccacagctgtctcctgtccttccaaattttctttttgtttgtcctgccaaaacgaagttgtttacaaagatatgtggttcagagacgtttctggttgctttgacgccgccttgtgggcaagtctcggaaattgcatgtgtccctggcccagcaaattgagcaaagattgtattaggtgcatcttatatttccttatcattctccctgggtctaccttcagatgattccttaaggcaaagcctattttttctaaattataaagtaaactttagcatgtaaatatcgaggtaagagtagtgggtagcatttttatattggaaatcagtaacattgcaaaattctgtttgcaactttattttcagaaacggggacaagtgcatcatcaaagcagatatttatcataacatttatagttgtcccataagacaaatcatcttgactttgctacttttcactggatctcacaagaagcttataagaagcgggccagatatgattcccgtttttcacaaacaagaagggtgaaagggtcctcccaaaactacacaataagggattaagccagaagtagagcctgtgacgttttacatggccagaaaaactcttgtgctgctgttgatattgttcttctgtttgtttagcaagtctgccttagagagacttcacagcacccctgggcctcacttagcactgatctgtctcccaggagtgggccccggggtggtggagggtcagggatggggttgccgtgcacatcagtctgctccatctaaaaaagctcaccgacatcaaaacatctggctttcctagaaaatactggaatgtctggaattttttttttttttttttttttttttttgacagagtcttgctctgtcacctaggctggagtgcagaggcgcgatcttggctcactacagcctccacctcccgggttcaagcgattctcctgcctcagcctcccgagtagctgggattacaggcgtgcgccaccacacccagctaatttctgtgtttttagtagagacggggtttcgccatgttggccaggctggtctcaaactcctgacctcgggtgatccacccgcctcagcctcccaaagggctgggagaatggctggaattgtggtgtcattttcttttcaaggccatcagtgctgcaattctgccattcattccaaaggcccattagagaaggaagagaaaaattccatgtcatacgagtagcgccaacaaaaaaataccttctgcgtgcgtgtgtgtgtgtgtgtgtatttatgtgtgtctgttcacagatgcacccagctaagcccaaacacattacaaggtagaacagatgttcatccccaagagagtctgactgtcttgcttttaagtttagtgcctcaatcctattattccttctccattttgttttggctaataaagcaacttgcccgcaactcatccttggagcagcagtcatgaattaacgaagattttttttccctcttttccattaaaaaaaattttatgtgccactattatgtcctagggttttgtttttaattgtgggaaaatacacgtaacatgaaatttaccatctgaactatttttgtgtacagttcagtaatgttaaaaatagtgccaggtgcggttaatcccagcactttggaggccgaggtgggtggatcacttgaggtcaggagatcaagaccagcctgatcaacatgtgaaaccctgtctctaccaaaaatacaaaaattatctgggcatggtggtatgcacctgtaatcccagctactcgggaggctgaggcaggagaattacttgaacccaggaggcagaggttgcagtgagccgagattgtgccactgcactccagcctgggtgacagagcgagactccatttcaaaaataaatagataaataaaataaagtgtattgtatagttgtgcaatcaatctccagaaggttttcatcttgaaaaaccaaaactctgtccccattaaataccagctccctattccccctccccacagctcctggcagccactattccacttcctgtctctagaatttaactattaggttggtgcagaagtagttacggtttttgtcactgaaagtaagggcaaaaacttctgttaatacttaaggtaccttatgtaagtggaatcattcagtatttgtctttccctgcctggcttacttcacttagcataatgttatcaaggttcactcacgtagcatgtgacaggtttcccttcaccttgaaggctgaataatattcctctgtgtggaggtaccacattttcttcaacgccttccctatccctcctccctaccctctgcccagaccctggcgactgccactctcagcttctatgagttcaacgtgtttacgtttcacatataaatgagatcttgcagcatttgtttttctgtgcctggcttgcttcactcaacatcatgttttccaggttcatccatgttgttgcaagtagagattttctcctttttcagggctgatactcccctgtgtatatatagcacagtttctgtatccatttatccactgatggacacttagagtccatatcttggctattgtgaatgaagctgcaatgagcaagcaagtgcagctgtctcctctacatactggttttatttccgttggtaatttacccaccggcacattttccttatttctttcatccatggatgggtcctaccatgtaccatctcagagaagcttaggcacagtttgttgggatgtcagacgctgagcagaatggcgcgtgccctctaccttccaatgtccaaaaaggaattcattgaaagatcaacatacaaagccttttttgccagaagagtgggttggtgaaaggataggaatctttcaaaatgttaggtaggcttccagactttaaatcctcctccctaacagatagactcagaccccgctatcgagctgtaggtagctcttagagatctttcatttctagatttgagtgctttggggttttttttgtttttgagatggagtttctctcttgttgcccaagctggagtgcattggcatgatcttggctcactgcaaccactgcctcccaggttcaagcgattctcctgcctcagcttccggagtagctaggattacaagcacccaccaccacacctggttaatttttgtagttttagtagagatagggtttcaccacgttggccaggctggtctcaaactcccgacctcaggtgatccactagcctcggcctcccaaagtgctggaattacaggagtgagccactgcacccggcctagatttgagcactttgctatcctaggttctctttcctggcacaggacacaatttgattctgcatgtcagtgattagagttgtgccccctgaactgaacagccatagatagcaaggctttaaggaagggaactgtccagatgacctctttggatgcctgattactacagagtttatgcaaagactcaggacagtacaagtcagcaaagcacgtaggcttggtttccaggctcacaccagagccactgaagaacttagacacataccagctttcttaggtccaatatctgccacctaagttcccatgtcactgatgggaaaataaaaactaatggcatagtttcattgtttctttataagcagaggaaaagtacaaattgaaactgaaaagtgtttactcagactcaaactcaaaaatttcagcattgtttagacactgctctccagtcattggcttcccaagagatgggtttcagggtgatctttcttgcacaccatcatcctcgaccatttactgagtggccttgagacgctcaggaagagttgtcactcctcagcctcattcctgttaatttcctgtctgccttttggttgtgcagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaaggtaagaagcgaagccaagagcgtcttcataagacgagcattaggtcttctggtcagttttctgttcctcttagtttccaacttgcatgtggcaaacaatgattattattgaactgggtttaaatgggatgtgcaccgtctgtgttttaatagaggcaccaatattatgagcattaaatgtcaaaatgagtgtaagagaaaccctcatgtgcatcagttataacataacggcccaggaaccagttccatgaccttgaatacgctcacctggagatgtagttggttcattaaacaagcacagtgtgtggcttaaaaatcaatcttctagctacttgggaggttgaggcaggaggattgaagttggaagtgtgaggtcagcctgggcaatgtatcgagacccctgtctccaaaacaataaaggggaaaaaaaaaagaaacaaaatgggcatttaggctgggtgcagtagctcacacctgtaatcccagcactttgggaggccaaggtgagcggatcacctgaggtcaggagtttgagaccagcctgaccaacatggagaaacacggtctctactgaaaatacaaaattagccaggcatagtggcacacgcctgtgatcccagctactcagaaggctgaggcaggagaaaatgggcatttatgttatatagagggtttttttttattttactcagtcttttgtttcccatagttttttattagaaatattcagtccagttcatcttcccctgcctctggttgaaatcttggacaggatgtatgactttttggcctgctcttagataaaagacaacctattgtcactcttatgttatgaaacactgtctcagtggggaaattaaaaccatccagtctgggatattattcatcacataacttttttcttttttgagacagtctcactccctcacccaggctgcagtgcagtggcatgatcttggctcactgcaacctccacctcccaggttaaagcgattctcctgcctcagcctcctgagtagctgggatcacaggtgcacgaccacactcacctaaatttttgtatttttagtagaggtggagtttcaccatgttggccaagctggtcttgaactcctgacctcaagggatctgcccgcctcggcctcccaaagtgctgggactacagatgtgagccaccatgcccagcctcatcacataaattttaattttaaagctgggactcctgcttcctttcctctgctcagagctcgtgattggcagctgctcactactggaggagacagtgttgtcatgctcttgctggctgtgttcttgttctcttccattctaactcctgagtttctgcttcagaccttaccaggtagaagctgagagaggaaagaggatgagcagaaaaaaacagttcttattcggctggcagcctcctacccctgaactggaggatggctaaagctgagacttcaatgaggcactctactaggttctgcagaaatacttatccttgcagatgtgtttggctgaaacccttgagatacaggcattcagtccagtccctggcctatatactgtaccaacgctgattctgcaagactctctcactgttggtttcctgcccagcagattgtcttgggcagtgtactagtctgttctcatgctgctgtaaggacatacctaatactgggtaatttataaaggaaagaggtttaactgactcacagttctgcatggctggggaggcctcaggaaacttgcaatcatggcagaaggcacctcttcacagggcagcaggagagagaatgagagccaagcgggaagggggaagccccttatgaaactatactctcactatcataagaacagcatggggggaaaccgcccccatgattcaatcacctcccatcgagtccctcccgtgacacatggggattataggattataattcaagatgagattctgggtggggacacaaagccaaaccatatcagccagtacagttgacctttgaacagctcagcagttagaggagccaacctcctatgcaatgacaaatctgcatatagcttttgagtcccccaaaacgaccaccaataacctactgttgaccagaagccttaccaataacacaaagtcaattaacacatgtgttatatgttatatgtatgatatactgtattcttacaatctaagaagctacagaagaaaattctattaagaaaattataggaaaatgtgtttactgttcattaagtggaagtagatcatcataaagatcttcatccttgtcttcatgttgagagggctgaggaagagggggagttggtcttgctgtcttaggagtggcagaggcaaaagaggtggaggaggtggaagggaggcaggagaggcaggcacacttggtgtaaatttgattgaaaaaatctacatattagtggactggtgcagttcaaatccaggttcatcaagggtcaattgcacttaaaatacctacagaccagctctccccaacctgccctacccactgtccaccagaaatattgttgacttcttcactctaacaaactctgagagtacaggctattaccatcttagcagcaatctccagaattcaccatcaaaacggaattcagcgccctatccgtggtagcccaggatccatcgagaatacaggcacagtattacaggtggaaactgggctctgagaatcacaaggtgtgagccaggagctcccaaggcaaacccacgtggagacagaggaacacctgagagccatcaagaaagatctggactctagacagactcagagttggccttttttgaggatgcgaaatattctccacagtgtatgggcgtagcaagttgtagaatgaaatgaatcatgtcaatacaacatgctaaatacatagaagaataataaggacctacatatactgagctgtcccagcaaatatttgggtcaaagagacccatcactgtaatcaagagcctagcacatctaggctgggtgtggtggctcatgcctggaaccctcgccctttgaaaggctaaggtgggaggattgcttgagcagcccgaaattcaagaccagcctgggcaacatagcaagaccccatctctacaaaaaatctaaaaattagccaggtagggtggctggcgcctatggtctcagctactcaggaggctgagatgggaggatcacttgagcccacaaggtggaggttacaatgagccatgatcacaccactgcactccagcctaggtgacagagcaagaccctgtcccccccgcaaaaaaaaaagagtctagcacatctaaaggaagtggaccaagaatgcaggtgttttggaagaaacattgttttgatttctggcatttcatatgtcagctggttaaaaaataatcatcatttagagaaataatttttagccttgttcgtgctatattgaaaatgggaataggataagatccttcaacattggaagctatccatgggttctaaattaaaaactagaaaaatattagcaggctcatcttttttcactaatctacttttttgcttttgaagaagtacttagaattaaatgtaaagggaatacacttccacctctctaataaaagtgacaacttgtcttgggcattagaaacttggaggcaactccagggctctccctggaaaatcaagatcttgaatctgagaagtgctgacaaagccctcacaggatccccagcccaggggtaaaggaacaagatgtttaaaaatttgagccacttccattcagctttcactttctgactatgatccaaacaagcaatagcttagaaaactccctcaacaatcaattaaaggcacttttaatgaccaaacacagataaaatgaaaactaatctcaaaattaaccaatttttttaaaaaggctgacaacagtaaaaataagttagtgggagccgggcacggtggctcacgcctgtaatcccagcactttgggaggccgagatgggcgggtcatgaggtcaggagatccagaccatcctggcttacacggtgaaaccccatctctactaaaaatacaaaaaaaattagccaggtgttgtggcgggcgcctgtggtcccagctacttgggaggctgaggcaggaaaatggtgtgaacccgggaggcggagcttgtagtgaaccgagatcacaccactgcactccagcctgggcgacagagcaagactccatctcaaaaaaataaaaaataaaaaaaataataagttagtgggatctggatataaagttttttattttatataaaggcaggttcaaacactattacaattgctacatttgtagcaataaatgtagcaatcgtaataatgaactcagtgtgaaatgtgtcagcttgggctccataacaagatatcacagactgagtgggttaaacaacagacatttctttctcacagttttagaggcagaaagtccaagattaaggtccagcagtgtcagttcctgatgaggactctcttcctggctggtagacagctgccttcttgttgtgtccttacagcagagagagagagagataaactctggtctctctttcatgtgagacttctagccctattggatcaagaccttaccccatgacctcatttaacccgaattatctccataaagcccttacctacagttacattgtgggttagggcatcaacatgtgtattttgagaggacgccattcagtccaaagcatgaggctgcactgcaaagcctgggccagcaaaacccactggaaaaaagtgagcacaaggcttagtctgtacaacctgaggcgtgagagcacctccagactcaggggctgtctccaagtgagtcccaaggtggaggctctggagggagagtcacaatcccccaacacccctcatggcccataaatgccagcttccccctgtgcttcacaaacccagcctaccttgaggatatgcaatacttcaggccaggacggagagtgaaggagggacagaggtaaccagaagtaattccgtggagagaagttggaagtgatgatttccaaggagagaaagattggatgggaagaaagggttccttccagttggaggagaaaaggtgaaaagccgtgtgctggaatcctactcagcaatgaaaaggaacaaactattgatctataaaacaacccaaggcattatgctgagtgcaaaaagccaatctcaaaagatcacatactctctgagtccattgatataacttcattaaagtggcaacaccatagaaatggaagtcagattagtggttgcctggggttggggtgctggggacaggagggtgggcgtgactctcaggatgcagcacaggtagatctttgcagttatggaacagtttgtatcttgcttggcgtggaggttgcccatatctgcacatgtgataaaatggcataagtagtatatacacacacggtaccaggccagctcctaatcttatgctatcattacgtgggatggaaccgttgggagaaatagggtgaagagcacccaggacatctctgtactgtcttatcaacatcctgtgaatctataattatttaaaaacaaaactaaatctaaggctaaatgccttgcaaacacccaaataaaaagtcatctgcagagtttcagtggcaagagaaagagttgccacaagagaagaaaataaatttggttgaatagagcagaaactaagataataaagtttaaagaagcaaacaagaggactggtgggtgaaagaggttcttttcttttttaagacagagtgtcgctctgtcacccaggctggagtgcagtggtgcagtctcagctcactgcagcctatgcttcccaggctcaagcaattctccagcctcagtcttccatgaagctgggactacaggtgcatgccaccaatgcccagctgatttttgtattttttgtagagacgggttttgccatgttccccaggcaggtctcaaattctggagctcaaagcaatctgcccgcctcagcctcccaatgtgctgggattacaggcatgagccaccattctcagtaaaaagaagttctaaatgaagcttgcccaacccacgccctgcatacagcccaggatggctttgaatgcagcccaacacaaattcctaaactttatgacattacgacattttttgtgatttttgttttagttcatcagctattgttagtgttagtgtattttaggtgtggcccaagacaatccttcttccaatgcggcccaaggaagccaaaagattggacactgctgttcaaagttgacatagaagagtttggacttgttatttcccatgtgagttagtaaaacttccatgaactttctcttacacatattcttgcagttgggctgataaaattaatttccattatgcaatctgctgcccataaactggcttgcagctttatctctattcctcctttgctttgatccaacagcccccacattcttgagccccatttgttgcaaaaataaaaggtaatgccctttctcagaaacgtcttctagggaatttgacaaaatgttatgaaacccagaagtcataggtcctccggaaaagctgaggatagcagcatttcatggcatctgtgacagcagcagtgccagacccgttgccattggcccacctagggcatggatgcatgtcgtgcactgaacaattgcccactgggagaggctgtgctctggcaagaattccagtggggacactgctgtccagttgatgattgccaaagaaacaccctttactccccgtctctactaaaagtacaaaaaattagccaggtgtggtggtgggcgcctgtagtcccagctactcgggaggctgaggcaagagaatggcatgaacgcgggaggcggagcttgcagtgagccgagatcgcgccactgcactccagcctgggtgacagagcaagactccatctcaaaaaaaagaaaaaaaacactctttacttcctcatttatccatccaggatgtcctgtctatttgtttgaaaatgatgggaaactaatgatatagaacataaatatctcttcctttcatagaaagacatatctgaggagggactgaagagggaaggcaggttccaggtacaatctgtcagcactactgctggctgtcctctgcagcctggagctgctttcttgcacagactgtccaataaacttaaacaaacttcaactacatcctggctattttttcccatcaatgtaaacctccgtcctgacagcttttacagacaaaatcaagtcttcaggtattttatttcctcagtgcagctttccaggggcggagcttccagcctggccccactcccatgaggtcacctgtcatcctcaggacctcagtgggttgagtcgctgcaaggcagaacatatactaatttaccgttctgtgcaaaactggaaagaatattgacgctcagagctggagaccatatgctcttctcattacacatttaattttttaaaatatatttttaaattttgcaggtacacatccaagctaagaaagcccattgacatgatcctcttggtacaaataccacatgttcactggaagaaatagaatagaaaacccagcctgcagcacacacggcccagggcagttacttccagcctactttgctgaagcatctcattagaacaacatgagcgaggttttggccccttcctgagacacttacgccatctatctaatctcgtttcatccaaatgtccttaagaagcagagaccaatcatttatcatttagtatcattgtttcaggagaagggatatagggcaagtcacttattccttttgcttcctttttttttttttttttttaaggagtcttgctctgttgcccaggctggagtgcagtggtggtgcgatctcggctcactgcaacctccacctcccaggttcaaatgattctcctgcctcagcctcccgcatagctggggttacaggcgtccaccaccacacccggctaatttttgtatttttagtagagatggggtttcactatgttggctaggctggtctcaaactcctgacctcaggtgatccacccacctcagcctcccaaagtgacgggattacaggcatgagccaccgtgcccagcccctctttgcttctaaaacatcaatcagctccatgtgatgactcctgctgttttatggtttgtataaatgtatggggtgcaggtgtcatttcgttacctatgtggattgcacagtggtgatgaagggcttttagtacccactccattttctgagtctacagaaaaatatatcttaccgtgaacttggtgcttcttttctatgctgaaaacaggcaaccgagataaaatgaggatagaagatgcgtgatctgcagataaacaaaatggaaagacagcttattcacttactctgcaggcatctactgagcatctatgttgtgcacggcactatgctagcttctgtaaggaatagatatgtcaatggtgcccggcctccagagcttacagtgtggtaggaaagaagacaaccttggaaaaaagatacaatgtgctaattctccagtggagcgaagatgttgtgtggtacacagatgagagattatccatcaggatgagggggaaggaggccgcttgtcatcaaagtgctagatcctctgaagctcggcttcctcagctgacaactgggatgatgaatttgtttctcttagaatttgtttgaaaatcactgaggcatctagcacagtgcctgcctctcaaagaacattggttggagtggatgatgtatcagtcgtaagaatcatgagtgatgtgaatgatgtatgatagggtgatcaatcctgaatatgacttgaacagaagagagagagctccctgtcaggggaggtaatcaaagaaagtttcacaaggaaaagggggtgaaagctgagccctgaaagataaggcagaatttaaagatgaggggagggaagcaggagtcgactaggggagggtatctcatggcaagatggaaatgtcattagtgagggacagagacaggaaggcaggtggtgttttcggtgagcagaaatgtctggactggagagggtcctaatgggaaatggaaggtcctgtgagtcagcgtcagactccagagagccttgaatgccagccgaggacccgaggatgtcagaactctccaagccctagagatcaccttgtctagcccttcctttacacacgaggaaactgagactcagaaaacttatccaaggcgacgtgggtagtcagtctctcggatagctgtcgtgttatttccaccgtgcagtggctttctaattgggtactttggaaccccaagtttccctagagagtcctcagcagtccccatatggtaagggggagagaggaagttgagactgctaagaatttgccaatcagatacaccgggtgattgcacaaacatttcacccggaactttaaaagattctcctacttttttttaaaaaagcgaaaaaacttcactttacaatagcatgttgtttggtctttatatttttttggtagaacggagcctttgaagattttcaagtactcagataacacaagtgaagcactatttcagaacatgcaggctggctatgtttatgagcagtaaaaacaagagactcgcaatttaggtgtgaatggaggtcaagtccctgggaaagcctcctggaaaatcacgcgttccaccatgttttctgttttaaagaaccttaggctccttaaaatgccctataactcatggttacttcataaataaacatctagctgatgtaagaataaccggtaactactccagacacccaggggacctgttacttttctaagttaatgtttagactctcctgtttcttaatgcccttgacaggttttatttaagtttgaaaaatatccaagtttctttcctgtcttgccagtgttcattttaacttcttaggcagaaagaacaggagaaggaacagtgcagagaggaatgtacatatgtatgtatgtgccagctcagaaattattagatggaccttgaattaaatattgctcctccagcaggtttgcaggagctgagggtaattctcttcactcagatgccttgtagagtccaaagctgactgtctgggactagtttctattatacctgagtccccacaatgctggaatcattctaagaatgcagctttgtaagaaatcagactggagtgatggataattgatcaaatgacaaattatcactgactctatgctgttgggtgtaacagaccaggagttatactgcacaaatgcgtgcgtgtgtgtgcatgtgttcctgtacgtgtgtgtatgcgtgtgtatgcctgtccgtgtgcgtgtgctcacatttgtgttttagtgggtgtgcaggtgtatgtgttcatgtccatgtgcatgtgtatgcatgtgttcatgtgtatgtatgtctgcacgtgctcacatttatgtgcatgtgtgccagtgtgtgtttatgtccatgtgtgtatgccgtcacatgtgcctgtctgtgtgcacgtgtgtgcctgtctatgtgcgtgtttgtgtgtgtattgctgtcttataaatcgtcacatcagccctgttaggagggcacttggcttactttacaggtgaggaaactgactcaggtttgtcagttgcctaaggtccaattaataacacagggcaaagccggtttcaaatcaggtctatgcacctcagaagataacgtgtcagactccagcaaatttagaaaggcttcttcaagggagagtgccaggacaggttgactttagtcagtcctgatgaaggtgagtagaaaaatgaggttagaaaagaaggggctggtgcaccaggaagcaccacgacctcctgatgcaaaagggtcatccctggagacctcagggctcctgctctgctccctttcagctcttcgtgcgagaacctgagaagaggctgggcgtgaggggagacatccgccagcaccctttgtttcgggagatcaactgggaggaacttgaacggaaggagattgacccaccgttccggccgaaagtggtaaggactcgctcatgggccgcttggtgtcagccactctccctccgctcagggccgtctgcctgtccaagtcaccgcagctgctcacccctgccggtgccccaactccccaccagccccactctccaggaggaatgcacgtctctaacacatgttactgggctggtggggcagggaggggaggtcactcttgtttgcaaaatttaatctctgtcgtcaagatgcgcctgcatgaagaatggattgctgtgtgtccacgccttaggttgaatatgaatttgtgagggtgactattaaacaagatgggggttgtgcacatgacacatacgtacttaatggtccagtctgggtaacccaaacttggacataaaccctgcatcctacgtcaggaattttggagctgttttttccatgatgtttattaaagtatctgtaaagtgctcatataacgacatttcctaagggtaattgttaggtgttctttggtttaagggagaaactaactaaatccgtgctttaaaaaagataggtctgtacatttccatttatgtcctcactggcaaaagtcattaagctacatcagcaaaggcagaatgacctggctcacctgcgagacgggccaccataaagtgaagtcaaaaataaagcaaggttgggctgggcatggtggctcacgcctgtaatcccagcactttggaaagccgaggcgggtggatcacctgaggtcaggagttcgaggtcagcctggccaacatggtgaaaccttgtctctactaaaaatacaaaaattagctgggcatggttgcgggcgcctataatcctggctactcgggaggctgaggtgggaggattgcctgagcccagaagtttgagactagcctaggcaacatagtgaaaccccatctctacaaaattaagtgggcttggtggtgcatgcctgtagttcaaactcctcagtaggccaagacaggaggattacttgagcccaagaggatgcagtgagctgggttcacaccactgcactccagcctggtgacagagcgagagactgtctccaaaaataaaactttttagaaaaacaacaaaaaaaagtcattaagaaagtaaattttaagttatgtatatcacaatttctaaaaataatgatttttaaaagagtagagcaaagttgtgggtttgccagccttaaccattccctgtgattgcctggatagacatgggccatatccgtgctgaagggggccaggctcatggacttcccaacagattccaccccagagaacgcacaggctattagtcatgatagcgaatggccagaagaagcaggtgcatctcattcccagggcaagaatagttgttctcaacatctgtcccaagctccagtgatgttccaaggacccaacaggccagcctcaagcactctaattacttgtgacagaaccacatctaatacgtgggttagtcatttgtgataaaataaaaattttaccttgtttttagctatcagaactattaaaccatgtctcaccttccactgcagattaaaattgacttaatattttgcacataaaaatcaaaactttgatctaagcttaccctaaaggacattcccagttctgccagtaggaaactttccctgacctgtggtctgagctgccattgacctcacagccccagggccccttggagggtgggaggggcctggttcttcatttcgcttctctgtgttcatagcactttctgttgataatggttgttctcaatcttgggacactgaattgaacaccatactgaacagcatgtatgaaatagatgtttgctttccctttctctgttgtttggtttggttttggtttttttgccatgaaaaccaatggaccaagtggtctgaaaggagtctgtcccagtctgtgctgtctaaaaaagcccaagatacttactaataaaattaacaagggcaggggactgacaacagccaagaacgttgataaaagaacaggaatatgtaattgtgaaattccttctctcttcccatccctccgctcacaccccctcactccctctccccaccaccctcccttatccccaccttgtgttccatgaaaactgaagaggcagaggtcaaattcaggtggatcactttttcaaaggttgccaaccctgcttcatgtaaaccattagaaacattagatcccatttgaatgtctacagtcgtagtctttctgtgaatttatgaatttatattattattaagctgaggacacaggatcacagccatgttcaatgagagctgggcatggtcatctgtaggcattgcctccatttagtgtctctgcaaacaccaactttgccatacgcagatcacggcctagataacaaaagtgaagatcatgaacttaatggctgatttttcttctctttctttcttcccttaaactctgactaagaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgacttttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaatgaaatgcttgttgaatcaggggcaaacggagtacagacgtctcaagactgaaacggccccattgcctggtctagtagcggatctcactcagccgcagacaagtaatcactaacccgttttattctattcctatctgtggatgtgtaaatggctggggggccagccctggataggtttttatgggaattctttacaataaacatagcttgtaacttgagatctacaaatccattcatcctgattgggcatgaaatccatggtcaagaggacaagtggaaagtgagagggaaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttgcagcagtcaattgagttgaattagaattccaaccatacattttaaaggtatttgtgctgtgtgtatattttgataaaatgttgtgacttcatggcaaacaggtggatgtgtaaaaatggaataaaaaaaaaaaaagagtc

SEQ ID NO: 37363 - DNA, 24344 bp, Homo sapiens
ctgggtttgggtgcagacgttgttgcttgggcgcttctccgctgcgtgtaggtgaagggggcttcctgaccgaggtaagccgggccccgaggctcggagttgagaagggagactaccggtcggcaagggctcggtgggagcgggacaggtcagattctcggcccgacggaggggctagtggtctggcgggcgactgaccgagcggcggagcgcgcgggacacacctacaggcccctgcgccccgcgggcgggctggtcgggacgggccgcgggtctcctgccggggctctggtacgtggacctaggcggggacctcagggtggagtgccgggaatcacccttgtgcggtgattcgagggtaggcgggagagaggcaccaaggagatttgaagattgaatggagagtagggggatactcttaactttttgcgtggacgctggatttggcaaatatgctttcaataaaggcattcgcagaggcattgaaagtagttgtagggcctaaaacgcatgaaaggatgaactcatattatctggacctttttttttttaatggctttttggagttaacaggactggtttacactcttatgaataatcatgacacataactgactgctcagtttttacaaatatgtattcatccttaggaaagagatctgatcactgtcttgaactaaattagtttactgaatgccagctttttccaactggacaaaagcaagtatttttcaccatttcttgcaagttctgttcattgaagcaatgaaggacaataaagaaaacaaaattatgaggctagcagctggcggactgctcctcatctctgggctaattgggaattaattgacccaggaaatgtagtatatggactactgaaggaaaactactgactgaggttggaaaccccaagttccacttaatgggagtatcccagagaaaacagtattagtgggctaagggccgattttttgttgttgtttgttttgagacggagtctcaccctgtcgcccagcctggagtgcagtggcgcgatctcggctcactgcgacctccacccgcgggttcaagcgattctcctgcgtcagcctcctgagtagctgggactacaggcgcgcaccaccacgccaggctactttttgtatttttagtagagacaagggtctcaccatgttggtcaggctggtcttgaattcctgacctcgtgatccgcccgccttggcctcccaaaatgccgggattacaggcctgagccacctcacctggcctgttttttttttttttttttttttttgagaccgagtctccctttgtcacccaggctggagtgcagtggcgcgatctcggctcactgcaacctctgcctcccgagtagctgggattacaggcgccagctaacacgcccgactaatttttttgtatttttaatagagaggcggtttcgccatgttggccaggctggtttcaaactcctgacctcaggtgatccgcctgccttggcctctcaaagtgctaagattactggcgtgagccaccgctcccggccgatgttttatttttaaaagtaaaggaaaaaggtggcattctttcagaagaagatattgctagttttagagcaacatcttagaagggtgtcctgattgtttttagcaaatggaaaaagatctgggtagtcttggagaagaaactgttgccttttgcttttcctttaagaatatgtctctgtagtttgggagaaatagcaaaagaaccacaaagatttctcagatatttggggatatgtagtttcagtccactcaagaatctgactttaggcctcaatccgtcaccagctatctatgttaatttaggttagtttccctttttgtaaaatgaaatgatctttgagctcattggagtctctgaataggtgtaaaatcttcattttagttgagagtggaccaatttaagtgtgcccggcgtccaggatagtcctggagctaaaatgggaggagagtggggacaatctgctatctgccctgagtctgcccaggagtggacataccaagttggacaacatcttgtaggtaattctaacccacaggacttactctcctgcccattgctctgtcaaacatagggttctttgaggaggttcaggatgagacagacctattcgtttggggtggcagtttttgaagcaaatggttcttaagaaattacttgttatgcccgaaacaatatttcttaattttgtagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggtaatgggtttagtgccctgataaagcagaccattatttacaagaccaagccttagtgtctgagcaaattgacctaaagtacaaattctaattctaggaatgtgccttctcatttatatgtgctttggatgtgaaacaactttttttttttaagagcatgatcattaagctcatgattcctaagggtgtggaaagaatgaaaagatactgtcattttttggagtgtccatattagagaaataacaatgtccttccaaatttattgatttaagacattttcagtaattgaaaattgtttcctttgttaacttagcagtgattaaagatattggggttgggtggggaagggtaaagatttgaaaagaaacattttgaacattttcagacaggtttttatagctcggcaataatttcttgttctgaatgaacaaacaggtgagctttggcagaatattgatgacgcctgatagttctagtctttgtgacagttagattttaatcaaagtattctttttgacacaattattttttcagctttattgaggtataagtgataaataaaaattgtataattcaagtcatacaacaccatgttttgatatatgtatacattgtgaaatgattaccactatcaggctaattaacatatccattagctcacatagttaccttgttttgtggtgggaatacttaagacgtacgctcaacacattttcaatatatattattatgaactatagtcaccacgctgtacgttagtcttccagaacttattcatcttataactgcaagtttatgcccattggccagcatctccccatttcccttaccctctagccgccaccatactactctgtgtttctgtgagtttcacttttttacataacacatgtatgttatgagcctgcagtatttgtcttcatgtgtctggcttatttaacttcgcataatgtcttccagattcaaccatgatgcaaatggcagtatttcttttttaaggctgaataatattctattgtgtatatataccacattttcttcatccatttatctgtttatgagcacttttgttgtttctatatcttagccaacctcttgacacaatgtagttattctttattagctataggccattaatacagggtttgaataatatgcttctatttgattgctggggctgtgggatttttgcctttgtagctaaatcagcagcaagttaaagtggtgtaggtctgtgaaggattgtaacctcctcttcccccaaacaagggcattgcttgtccaaatatgtgatcattataaatgtgtatatgtctaaatatgtaagtcaccataattgattgactgattgacttctaggaagaccctcacatttattgctagttccagaggcacttctcaaaatgattctcttttctttcaggtgacattcactgtgaactacactttctttccacgaatttgagcagaacagtgttgggaggcagttttcagtgtctgtcctacccgctggttgacaagctggctagtgtgttcttggagttccgagtcatagtgagaaggatctctgtgtgcccttattctgctccacttgtgccctagtcagtttatggatagtggatgcacagatcacagccttttacaaaggctagtgtggcatagtgtttttaggcgagtaagatagacttgctgttttaatatcagtactgacatttgttagctgtatgatcataagcaaattacctaacctctctgaagctcagttttctcgaagattgaaattaaaataggattattagtttaattgattatgtgtgtcatgaggatttaatgaggtaatatatatacataaaatacctaatccagggtccagtattaatatttggtgtttattgttgaagctgctcagccatcactgtctttggttgaagggaaacagcttttgagttctgttctcaactcagcctcatgagtatgcacagattgcttattgtttgtttttcttttaaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggtgatgataagagttactggtaaaaaaaaaaacctttgggaacgtgatataaacgattgtatcagttttaatccaagacaaatggaaagaagtaaagtggaactaccctgagttgcatgtctacctgcctggcctttctagtaggatgtagtagctaagtcactactgcagcttggggtttggagtctgactctggtttaaaaccctactccaaaacccaagctgcagaataatgtatgtaaaatacttcctgacacaagagaagcactcaataaatgtctcccaccccctctgtaggtttatttttttttccctacagagtcaacacatgatttgaactcattatttttaaagatttactttgtaatctgtgttattattgtttcaaatatttatatcattttcccatgctggagctcactgtaaactacaatattattttccacatagttctgttttgcagcttttgcctttcttaacaaaaatgtctttttgtaaaatattagatgaaaagtatactttgcaacagtagcatttccttttgcataagatctggttttaacctgagattatttcaaaaggaaatttctactcaatctccaatacctggactggtttttttaccctctgttgtattaccagagggttttccagataccgacgatggtagcagagtaacttatgttctgaagtaaattatcccaccacagtaaagtcatcccacatgtatttggttcttaactattaactaatgtaagtgatgaaacgttttttcctacaaggcagtttttttattattttttatttttttgatacggagtctcgctctgtcaccaggctggagtgcagtggcacagtcttggctcattgcaccctctgactcccagggtcaagtgattctcctgcctcagcctcccgagtagctgggactacagctgtgtgccaccacgcccagctaatttttgtatttttagtagagacgtggtttcaccgtgttggccaggatggtctcaatcttgtgatccacccacctcggcctcccaaagtgctgggattacaggtgtgagccactgtgcctggccaaggcagttttgtaatctgttttattttcagatagataatttgttctgactttacaaaatggaaaacaggttctatatccttggcagcttaatacaagtactgtcttatacacactgtgtatattcagtgtttattgttactgttcttagagttcagacatgttgctgtagtcgaacttgaaaaggtatttgggtatgctgtggttagagtgtcctttatatctattttataaattcatttaaaagccagaatttttcctagaactagattgtgaaaggctactggaaaatgcttataatttaccagttatcttgagagttcatagctttcagttcagataccaggaacttactattttgaaatttgtagcatgtaatttttgcatttgcttgcagaaccagcaaccctgccagtttcaggatgggatatattattttcttccttttctttcctaggcccagcagtgagaaactttcacaatctgtaatagatggtgtgactgttctaggaggtcaattccatggtatgtagttatcctgagttggaaattaaactaatatttaaaaaactttaatttacaaaagtaatgtatatttatttagaaaagtttgaaaatacagatgaacaaaaaatgtttaaaaaatgaactcctagatacaaaatactaactttaaaaatcatcttccaggtcgtttctgggcaggcatgttttgtcttacctatggtagtactataggagattatagctgggaaattctgaactaatacaacttcctttactttggtaaggctgaatttcctcaaataaaaacctttttaagtacttgaagatgatcattctggggagcttttatcaatattattaggtcttccctaatagctggttccctgtgaaatcagctgttacctgtcaagtagtgatgggaaatatttttgacaggtagttctttatgttatatcaaatgacagagaattaagtgaaacaaaacagactaggatccccttctcacactgtgtctgttgtgaaggcactgcctccaccatgttttgaggtgaatattttcctggtgtgagatctttctcattaaaacaaacgtccactcttgacctttgaaacctcctctcgagttccgactgtgttcccttcctgcacggtcagtctggcctctgctgagggctagctctgcttaccttctctgtttcctcctcttctgtcattcttcagctttctgcaggtgagtctgtatccttacctctccttgaaataaatgtctccccagcccacccctgacatccatctgcattgttattgccaaatctggtgggtattgtaaagtagggattattaaccagggacctctgtggcatgtctgggaaagctgcagaggacctgtggacctcatgatacgatgtacagagtgttgccggcacaagcactttcccagggagtgcatgcgtacctctcctcagatactcagagggggctgtgatctaaaaataattttaataatttatgctttaaagatcttacagttgaagtctttgtagctttccataatgttaaagctctttctttgagcttctacttgcttggccactattccatattggtcttctctgttggctcctcttctgtctctttcagggagggcattcctcgggaccctctttcattctgcatgatttctgaatgattatctctactgccatagcttgagctaccttttttcatttatttatttatttatttacttatttatttatttattgtttgagatggagtctcactttgtcgccaggctggagtgcagaggctcgatcttggctcactgcaacttctgactccctggttcaagcgattctcctgcctcagcctcccgagtagctgggattacaggcacatgccaccacacctggataatttttgtattagtagagatggcgtttcatcatgttggccagactggtctcaatctcctgacctcgtgatccgcctgcctcggcctcccaaagtgctgggattacaggcatgagccactgcgcccggcctcattcatttgttaattcatcaaacatgttttactacctgctgtgtacatccctctagtagtctatttctgtttcactgtgtatcacaacccatagtaagaaacccattatgtgtcatgacatgtcaatgtgtgcttgtgtgtataactgaaataatagtttcaataaacaatgctcatccagcctacatgacatgcagtcatctgtttaaaatgcacaaatgctggttgtgtctcactaagtaaattccatggcccattggcaggctgtggcctgcagtttgtaaagcattggtctgagtggtgtcttcccttaggtggcctgcttctgtctcatgttcaccctgccccaaactgtattctttctgtcatccccagaatggttgtctttttcagcattttcattctgtcgctagaaccatcactcttctagtgttttagtctagaaaaagttgagagtaatttttttaacctttccttcatttctctcttcagcttagtgtatttcagtaaatgaaaaaaggttaatgtagctgcaacatagggagaagaggggctaggagaagagagtagggaggtaaggtgggactaattcatacaaatcttggaggtcatggcaagaacttgggctctattccagatgcaatgggactccattgaaggattttatgcaagagagtgatatgatcacattttcatttaagccagtccctctgtttgtcacagagagaagggaaaggaaagttgttaagaaagggaaacagaccagctaggccgctcttgaaaaattggtattgcattcaaaggattttgtgatatatggggagaacagaactgtgaagaacacattccaggtttctgagttgatgagttggatagataatgcttttcactgggtatatatactagtcatttagtaaatgtttatttggtaattttgatattggtcacaaaattattttgtttcttactttagcatgtcttttagaataatgggttcctctagtaaacacttccattaaactaatctaagctcttatttgtattttttgagcttctccatctcctcccatctcatcattataccagagctaaggttgccttcataaggtaccatttctgttaaataacttcagggctcaagaatttaaagtgactcctttttgcctgcagtcaaattcttgtgtttgaggttcaggtccaactgacaggtgtagtcactgagtatttacttattggttactggtccatctttgcgatccatttttctttgttttttgctcatggtgcttttcttatatgttagctatgtttaactgtaagctggttttctttctttttgtttttgaaaattatgggacgtttttgaggtttacaatgaaagtatagtcctttggtaaagtttagtctggcttctgctgggtacctggggcactggctgggttcactttaaattgattcatgacaggccgggtgtggtggctcatgcctgtaatcccagcattttgggagtatgaggtgggtggatcatttgaggtcaggagtttgagaccagtctggccaacatgatgaaaccctgtctctactaaaaatacaaaaattagccgggcgtggtggtgggtgcctgtaatctcagctacttggcaggagaatcacttgaggctgggaggtggaggttgtagtgagctgagattgcgccattgcactccagcctgagcgatacggtgaaactccgtctcaaaaaaaaaaaattcatgacaaagttcctttggactcctgtggttatgtatgttgggcaggaagtccatgcaagggcctgtgcttggtaacagctcttcaagaatgggttttcccgtcttccctgctcagtgttaagataactgtcctgggaatggtgacatggggtgattaatttctgactcatcctcggactgaagatatagttctttgggatttcaacttcatgagagtctggtcttctactgggttctgcatcttagatcagcatgggctttttttgctctgaaaaccgtagctcaatttctagtttagaggaataacttcagaacaaaactggcttccgaactagcttagatcttggagttcttgccttcgggtatgttttggcctgataattctgtcacttttcagcactgtagttctttttaaaaggaggtttttgtcttttatctagcatgttggttgtttccaggaggatgattcatctgaattatgtagtttgcaatgttactggaaacagaactcaattattacttgtctgtattgctttatatttacattgttacctgtttatatgtaatgattggttttttggcttcttatagtcatttatatttctttttaagatcatttttatgttttctaagatgtctgagatgacacaaaaggatttgtcaccctgaaattcctacacatgaatgcatttaaacttttttctctttgttaagaaatgcggtgaattgctttttgtatttctatgacagattatggcttgttaacaacaccccagctgcactacatggtgtattgtcgaaacacgggtggccgatatggaaaggcaactatagaaggttactaccagaaactctctaaggcttttgtggaactcaccaaacaggtgaaaagtttattgaacatggttaaagttaaacaaatgaataaagtaacatggtctactgaacaaattatcttgtttgtcatgcctcctctttccttttccaaagatgctgcatatctccttttttgtttttctctagggctacacaaggttctggtctatgtatcctgctaacttacattggcgtttacttggcaaattatgtagtacattctgagatactttggggaagcaaacatggtgggggtcttgacgatggtatcataagtattcattcagatgaatttgatcttagttaatgtaggtgctgttggcttaatacctgaggcatgtactattgagattttcttctaggtatattggcttgttaaatgtagagagatttgagaagtataattcgtttgatcaacaaatattgagtatatgtccttaccaggcacaattaactaaaagcccttgctctcatagaacttataatttggggtgaggatagctgggagaggagacaattagaaaaaaaacaaatctgcctgatgatgatgtcacatactataaaaagaatgacatgtcattactgcccatttgtctgtgtgcttattcttgcatttgaatggctcccttgtaatattacttttaagagaccctgttaattgagactaaattctaataaagctctatgctataagttgttcaatcagcaaaactattctgttgttccaggtgtttttaaattttactttagtgttttataattttaaaaattgaaaaatgaacacaattataattgataaaatttaaaaattaaaatgagttaactaaatatttacatatgcacatatgtatatatgctttatatttcacatttatttttataacttgaaatttttcttccatgtgtctttttcctttgtaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggtatgtcgtactagcactgcaaaaatttgtttttaatgctctttgaagccaatctcacttataaactaaggtggtaaagtgagttaagaatcttgcagctattcctggctctgccacatttagacattgagaagtcttcccactctcagagccattgaaacatggtctgctctctctgcctgtaaatcacaccattcctcatagtctacaggaaatcaggtggggaaagcaaagtcaggaaatggcattctagagcagtggttctcaaactggcatgtgtcagaatcactttgagggcttgttagcacacagattcctgggctccacttctgagtttctggaggtctggcataggatttgcatatgatagaaatttgcatttctatcaagtttgcaggctttgttcccagtgcttgtctggggatccctttttgagaatcacagatctacaggggagcatagtaagtattattagataccttatctgaattaaatacactatggaaagcaaatgtaactctgcttatacagttgttagcaatcagtgttttccactcagtgcagaataggaggaagacttttcttcagattttagttgtagtaagaggtgttctggatttatctgcattatagaccctaaattatttgcttaggccaaacctgacttgcagatatgttttgtttggctggctgcatttgtgtgtttgtctgtgtgccactgtttaaaaattccgtgacttctcttatatattggaatctctagcatctctttaccaaaatcagaaaatgttcacacatggcattagtccactacagtcagatagatgctgctcccctaaaataggacatgcattctggaactctacagacttcatccagttgcctcattcattcatgttattatgctttacttagtaagcatttaaaatgtcagtgtagtcaaccaatttgagctccttttcattgaattgcttgttttgacatttacttgacagttcagttctgccacttatttatccatttcttaaatactgagctcttactctctatgctctaggctttgggactacagtatgaacaaaaccatagtccttgctttcctgaagcttgcatcatgtcctttcatcaatcttatgatcccattcctgacaaaagccttttacttcttagttgtctcatgttgaatttgtcactctgctgctgtcatggctaaggaatagccaaattttctaataaatttgatgtgacaattgctgagatttcagcaactttatgtaaatttcacaggccagttatctctcaaagttataattctttgctcttaattatcagtgtttctttttattggtggtatgaacaaataaaaatcatttctgttagaattaaagcacatacatcatctagtgctgattattttttctatgtaaaggagatcacggtcctaggtaaattacattcagaaatacatgtagctttcaaaaaacctttatgggacacctgtctagccaaaccaacctgcttataaagtggaattttatggtagtattatagcaaatatcagcatagattttgaatgctccttttttcactttgcagtgaaagaatttgacctgtaaaaaccactaataaactatgtactatttaaagattatacactatttaagattaagacattgatttttaggtggataattttaagagaaaattctaaaactctttataataaattcttagactgaaatgcatgttaaattatcctgtgtgctaggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggaggtatggtggggggattggctaccctctaaaacaagacttagtagtgaaatagttccatattttacaatcatttgtcagaagggcacaatttatgacaaattctttacattagtgggcagaaaattaaaaaaagagcagtggtaatacccagtcatttgaacatttgaggcattggctttggaacctgaaggtactcttttcctccttatactggctgagttttgtgatttgaagctttaggaagttttgcttccatcataattgaaactttgatgacagttctgtggtcactccataaaagccctaaattctaataggaaatctcatcatctgatatattaactgattatgataagcttagtaatgtgagatttgtttcattttgctattttagaaataaatctcaggctagctttaagtacacaatgtaattggaaattattataatctggaaacagcatactttaagaatttaatagattttttttttttttttttttgagacagtgttgctctgttgcccaggctggagtgcaggggcgtgatctcggctcattgcaacctctgcctccctgggctcaagcaattcttctgcctcagcctcccaagtagctgggattacagatgcatgccaccacacctggctaatttttgtacttttagtagagatggggtttcaccatgttggccaggctggtctcgaacttttgacctcaggtgatccacccaccttggcctcccagagtgctgggattacaggcgtgagccaccgtgcctggccagatacttttatttaaaaaattaaagaggtgaagatcaggagatacaggcttcttaaaagaggaattctcatagaattgttttaaatagtgttcaaatgtattttaggcttttttcctggcatacatgtaaattttcagtcagacatttttggcataaactaaggcacaactgaactggctgataattttggtagcctttagaactctcattatatttgtttttgtagaccatacttttgatggcaagttaagtatcattgtttttgtctagattggagaaagtttgaatattggtgttgtacaaactgcatatgcaaatggaagttcaacacggtatcttgaagaagttatgaaggtattgaaccatttttgttttctggtagtttcttaattaagatcatgtttctgtgagaaagatactgccctcataaaagtgattatgttgtagtgcatgaagctgagctgctgttcatgtaaaggtaaagagaaataaataagaaaaaatttagttgtccttgatgaataaaggaaaacttctttccttccttttcttggagttttcctttagaaaacttggaattctttctctgtgcctttgtaatgaatgtaagtctttctaaaggcctaataagccagttttatagctcaggaatacttttctttaagggcctagagtcaccaatttcaaatataaacatcaaggaagatagctcacctatctcccagtctcaggagagtttaacttaggtgtttgcgtccaatttgtaactatctacctgtcacagaggtatgaaaagttttattactcctttagagaagggcagttaacacaggtggccatccctattaccaagtaagtttaggataaactatgtgtgtgacaaatggtggtttcaagttttcctatttgaggactagtgttaaagaaaaaataattcatgacacttgttaaaatggtaaggcagacttgattcaggactgttgtgataggtacagggactaatgtgatggagttttgcagtggtaggagaaagattgggctcaactccaaatatagtaaggaaaagtagggctttatagccaaggagcagggtgtgtggggggtggtcagtggatgaaaaattactgagaggaaacatgagggtaagtgggtggtattttggctaaactgatctaacaggacttttgctgaaggtaggccagggcggtcacatattacctgggggatggtagagaatgagaactcagatcagatgtcaagagtggtcatgtatcaggatgagggattctcgctaagctcacttagcatgactcttattaaaatcgggctattggaagacatgcctaaggacaaggcctagtcaggcccacctaaacctaactaaagtttggtcaaggagagaatttttgtcattagccatcttttatcttagcaaattgtattggaatgtgtccgcttggctatattaaagggtgagcgtttatctttgctatctcttagcaaattagcctgtgattgaacatcagtttggcttaatacttattcagtaataaaactgtttcttacccttcttttttttttggagaggttttctggggtggtgggagattctgtttctaattatttccccggtgtccaccaggtgaccacccttggcaccacactacttgctcggagagttaccagggttcatggacaaaactggaagtctgtttgcctatactttctcattatcgagaagttttccaacttttttgtacctcattttgtacctcgttctggcatttatactagttttagttacctttccattctctagaaagcaggaattacaaagtcagattcctgcaggatttggacaggtaaagtgaatgagggcagcagggggctaaaaacaggtcagtatgtgccagctgatgtcaactgtagtcacactcttcaagagaagcaggaaatctgaattttcatgtgatgttcctatttgtttaaaaagaaacagtggctgggcaaaacgaaatatatcttgaggctgctagtttatgacctgattttaatatatggttataataagctcattcaagggattccatctggggcccatttgcctgcctttcacagggattgggttatttcacagtacttgggttattgttttaggattttcattttctgtcttaaaaatttattacagataaaataacctagtttaagaaactgttacttctcaactcactgtcttccagatgaaatatttttagcccttgccattcctgaggtctcctacatccaatctaatgctgatctttcttttgcagtttttctactatcaatctttccttaaccattcttaaagctctctcagatccatccatccatgactttccctattcactattgctgatccagccactatttcttactgggattagtcctagaagcctcctcattccatttcttaaccttctaattgaacttgctgctatttgcaaacaaagttttattggaatagagctatgttgatttgtttatgtatggtctgtggctgcttttgcactgtaatggcagagtaattgtgacagagaccatatggcctgcaaagcctaaaatatttactgtctggcctgttacagaaaaagcttgcaattctgctctaagctattctccacactgtagctaaacagctttctaaaacagttaggtcatgtcacgcccccacttgtaatctttcgtgtcttataaggagaccctcatctctctcaccgtgctttacccttggctgcgtgcttccagagtgtgttcatgcttccattgtatacgtaccattttgtattttaatgcttaatcgtcttcctcactggactcggccccagtattttgttcccctttgtatctctgggatactaggtatgcaagaaacatttgacatctgagtaattgctgtatttctttaaatgcatgtgttataggtacctgtctattgcactaagactggtgtaaaacatttgcaccacaaggctcaagagtttgacattggagtttattttgaagcaaatgggcatggcactgtaagttctcttaattatagttggccttagctggcacttttctttatgatgagacttctatatctgggaggtaataataggtaatattgtactttgttgaaataattggatgtgacaaaaagatcctttggttatcttatatattgatgtattatgaaactgtgattctcttttacatggtaatgattcttctttgaatgtgaagagatatactaaggtgttttgaatagttttttaaaatttacagttcttaatttttttataagtatgttgtctatgcattttccggctggccataggagaggaaaagaaaaattcagtcgctatggtgaattgcaaagtgttggaaagttgataattaataagaaatgaaaatgaatttaaggtaactagtgataggcataaaatgtttcaatttacattttacataaaattacattttaaagtgtataatttagttttttgtagattcataatgttcagaatatttttaaaatgtttttatactcacctcatttaatgaatacacttgaggtggctatcagaacatttgaatcaaagccaaataattttcctcattaatttaaaattggcttttggagggcataaatataaaaaggggaaaaataagttcctacaaaatgcaattaagatataactttagtgatcgaatggagaagttggtaaattattttctaaagggtagagagtaaatatttttggattttcaggccataaggtctcttacagttgtttaactctgctgatctagcttaaatgaatctgtgtggttgtgttccagtaaaactttacaaaaacaggtgactagcctgtgccttattttatcaagaaaaatgtatttcatcaagtagttgagcatagtatgctaatcttgctcagtattaggcctctagaaggcagtaaaaaagatgagtatttccaaatgagataagactcttgaggagcatgatgaattatatattgtaatgactatccatgacattatttgccatattttgatgaatactatgaactcttaattttgcctagctcatccccttaagttttagaataaaactatactagctgcaatgaattatatccttcaaagtaaaaaggatacagacaggctctaagtaacctggttgcacagaaatgatttagctggttaaagggaaaacatgaacttactgtgtgtgcttgcctcttgtcaaggtggtgttttctttgtaatcagatgtttaaatttttataaccagttatataatccgcaaataaaatttttcccctagtactatcctctgggttttaatgtgatcttacattaatttcatacattttaaggctgccactatttttcccctcagtttctccagattgactaggagggaaaagtgggttagctagaataatagtacttatgactaggttttggatagtgttttgagactgattttatattcttttgctgcaggcactgtttagtacagctgttgaaatgaagataaaacaatcagcagaacaactggaagataagaaaagaaaagctgctaagatgcttgaaaacattattgacttgtttaaccaggtcagaactgatggggcagtggactcttggttacctttacattattcagaagatggacagaacagagtgtgggtgcatacaaaattaaagtggagacgtcctggcctggtggcttccttctaatagtggtatattcagttgagatttataatgaaatggaatgacagaacattttttaatatgcttcccttcccctacctcttatgatggaaattttcaagtatattgggtagcttctacctaggatcacagattcagctactcagtgtatacatatatattattaatttttttttaaccaaacctcgatgaaattaagtaaaaataactggttgtcaggccaggcacggtggctcatgcctgtaatcccagccctttgggaggccaaggagggcggatcacgaggtcaggagatcgagaccctcctggctaacagggtgaaacctcgtctctactaaaaatacaaaaaattagccgggcatggtggcgggcacctgtagtcccagctactcgggaggctgaggcaggagcatggtgtgaacccgggaggcagagcttgcagtgagccaagatcacgccactgcactccagcctgggtgacagagcgagactctgtctcaaaaacaaacacaaataactggttgtctcattgacaaaggacatacatgtgggttagttggggttggagtgtcgtttggctatggaaaagcagtactcagggtagaggaaagcgattcaattatttgagtgtcttgcacacactggacactttatataccttgctgtgtaatccttacagtaacacagggagaggtgttactgtaatttccattttataagtgaagaaacagagatttatcttcagttatatcttataccaaagctcatatttctccattttaccttgatgctttctatcaatcattgtggggtaatatctcaaaagggatctatttataaaaagaaaaatgagtgatggaatgttaggctgagccttagagttatccagtctaatttcattttataaataaggagtactaaaggcaagtttctcaagagctagtttcagtattctttgttatacctttcattgtcttccacagagatcttcacctcattgttcgtattttatccatccacaaaaacacttcatttaatcatgctgcatgtgagaaagcacatgatataggctgagtatcccttatccaaaatgcatgggactagaagtgttttgggttccagattcactggattttgggatatttgcatatatataatgtgacatcttgggtatggcactcaagtcggaaacactaaattcttttgtttcatgtatgttacataagattaaaggtggttttatagaatactgtaaatttagtgcatgaaacaaagtttgtgtctactgaaccatcagaaagcaaaggtgtcactctgtcagccacccgttggacaatctgtggttgtctggcatcaccatcattcctaaaactctgaatttatatgctatcaatcaataagcaatcaatcatttttttacacttattcacacacaagtattttaatagtaaaaaatatgatacatatctggcatgcatggaaacgatgtatcatagctgaaggaggctgagagggtctttttcccttggggatgctgaatgaactgcgggcctgcctttagtgggttttttttgttgttgttgttgttttgttttgagatggagtctcgctctgttgcccacgctggagtgcagtggcgcaatcttggctcactgcaacctctgcctcccgggctcaagcaattctcctgcctcagcctcccgagtagatgggattacaggcgcccactaccacacctagctaatttttgtatttttagtatagatggcgttttaccatgttggccaggctggtttcaaattcctgacagtgaggtcaggagtgcatttgttttttattaagagacaaggtcttgctatgttgcccaggctggagtgcattggctgttcacaggcattatcacagcacactgcagcctcaaactcctagcttcaagtaatcatcccatctcagcctctcctgagtagctgggactgtaggtgtatgccaccacacctggcagttgtatacccacattttgacctgtcacaggaggccaggtgtggaatttttcacttgtgattattttggcactcagcatgtttcagattcaggttgttcaacctgtactgtgattggttttctaagaaaaaacatccatttccaagatttgcttgtgttaagtggtttcttccatttgtttccccatttgcaggcagctggtgatgctatttctgacatgctggtgattgaagcaatcttggctctgaagggcttgactgtacaacagtgggatgctctctatacagatcttccaaacagacaacttaaagttcaggtgtgagagaaactttaaagtaacttttttgaatattagctaagtaaaacctattatcccaattctcattatatctcactgacatatgtttcctatttcattctgtacatacacatatgatacatagaaaataaggccttatgggccaagcgcagtagctcgtggctcatgcctttaatcccagcactttgggaggccaaagcgggcggatcatgaggtcaagggattgagaccagcctggccaacatggtaaaaccctgtctactaaaaatacaaaaattagctgggcgtggtggcacacacctgtagtcccagctacttgggaggctgaggcaggagaatcacttgaacctgggaggcagaggttgcagtgagccgagattatgccattgcactctggcctggcgacagagcgagactccgtctcaaaacaaaaaaagaaggccttatgatacctaattgtattctcttacagctgaaaaaaaaattatagaataactaagttcatttacttaacattctattgtctgtgaagtatttggtttccaactttatgatataataaataatatgaatgacgcatcacttttttaaagagattttattatggaaaattaaaaatagatataaaaaaattaaaaatagatataaatgtagagaaacaacataatgaacttttgtgtacccagcttcaacagatttcaattattgccctatacattcttcataccccctcccaatactcttttgtatattttatttagagacgagatctcactatgttgcctaggctggtcttgaactcctgagctcaggtgatccttctcccttggcctcccaaagtgctaggattacaggtgtgagctactgcacctggccccaacattattttgaagcaaaactcagatgccctgtcatttcaagtgaaagtacttactctgcattatgtttagttcacagagtacttcctgagggagagaattcagataaattgctaattgatttctgtacatgtttatgccagtttacacattcaccaacagaatttgtgaaagacaattggaggtactaaagccacagttcacagaaatggctgattgttcagattatttttggcatatttaagaaattcttatcggtcttcttatataatgggctaccacttatcctgtttttgtgtgtgatatgggacttagtcatatcgtatttactggccattatcttagtggtaactctaagcatttgtggaaatattttttgccaaaggtaattctttatagactgaagaaaaagagaaaagttgcacaaatgttgaaattaattaccctgaccttggagaaagaagttttaatgtaattttatatttagtctggcacttttcgtagaatgtatgtttaacaggttaagcttctgaaaggaagtgtaatagagtaacaaatatgaaatgcttgcacttaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagtaagctgggatagttctattgaaaaagagcctaatattaggtgatgggcaggcaaactattttaatggtttttagaatctcactatgatgattaaggctttattttgttgagccttttaggttcacattaagactacaaaattattttcaccagcagtaattatacaatttaacaaaattagacccacttagtttatttccccaaatatttttgacttattctagacttcctgaaagtgtcatatttttaaccatggcaggaataactaataaatacttagtttatgcactataaggtagatgatccttttctcttcttttaaaaatatactcttgtgacatgaaaacaaccagctttgtagttcatttctaagtcaactgatagcattctggactcttgatttgtttttcaaaatatttcctttaaatgacagccttactctgtgcctgtttccctgacaggggtcaagacttgtggtctggatttttattatttggcctcttcacatactccttaaagtgtgtgcaaagccagggcaaagtacagtgagtgcgctgaatagggaatcaggaggagacatttggcagctttcctgcagaagcttaagccatctcagagtctaatgaatatccatgatggatgaggagatggcaacagaggcattagtacttacttactgttaggccaattgtggattaaagttttattgaattttttcagttgtggaatgatagctatttttataatctgaattgattaaaaacttaccttatttagaagaatttggtctgttttccgtttatttaagggctttggaatttgttactgaaagatgaaaaaaggttttcattagaatttgttagtgaaacaaaatcaagaatcacccctctcttccccagagttccaagtaacatggtcttgcccatgttagacacatgctatgtctttctcatctaatctcttttaatgtaatttgcaggaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaa

SEQ ID NO: 37364 - DNA, 86052 bp, Homo sapiens
gttcagtgtgaagctgcagccttcctaatcagtgacatgtttacaagaagttgagatatgcggaaaaagctggcagcagaaactttattcctaggtctgcataaaatcaaagtggcctggcagctttaagggatgtgtttgcgtttgatttttaacacatttaagtgtgtatgctgtttttcattacacattattatatgtgacagagacagtgtcacagctttgcaagtataaaggatattttgaaagtgaaatgcaagccaaacatttatggaaccccagagcacctttgggagccactaggatcctattgatgtggctatgctaatttaagaacatctggtttaggagattatcagtgctacactgattgttttgcttttcttcataaatatgttaagccaatgtttagggatcatggtattagaaaaataggattttaatttctatacattgttttataagtggcttgcttactagcagtcttttttttatataaagatgtttaagttctaacagttggtggtcacctagatatcagtgatttgttatttaaacaaaataaggcacatggctgaatgtctcatagttctctattccattggcaaatgtttgaagccaaaagacttgactcaatgtagaaaaattcctgcattttagcctattttgaaaacatttgttaggtgcttataatgtcaaagtagttttacccaataaagaaccaaaacttccggtaagtttaattgagggttttcagagaaattcatctcgtttaccctcctcttcttttttaaaaaattactgttttgggtcaccatccaatttttatagcggccaaacctcccacaggcagcagcaacaggcgcttaaaacttgtgaacattttaggtgttggtaacaaatacaattttcaggtgccagagggcacatgtgatcttttacacaaaaatgcctctgacccacaatcggtagttcatcttgaattgtctcttctgttagtgatcatgaataatagataaacatttattaggtgagtgactgaagctaggggatgtcctctgtgactgtgagagtttctctctgaacaaagttagttggaccattcctgattgaacttctgaccttgatctcgttaacacctgctctaaggaaagattaaagggaggcagcctgccagctgcatcctttgctgtctgggcagacactacagagatggcccatatatgggcctagagatctgtacattttagaatttaaaaatgatcaaggaaattgttttgtaaattttatttgggagccttagatttaaccttaccattgtagaccaagagattgttttggtgtgcttttgttaaatatgctaaatattgtctctggatactgagttaaagtatttttttttggatgtgtgctaatttaataaaaatacgacttaatatttgccaggctttggaccatgatgggataatcattagagatatttgctgcttatttgtattatgaatgtcttttctaaaaatttgattcctgggttactttgaggtgactgaagtcatgtaacagcagaaggagttaaggaaatagactaaaatatgacttgatttagaagggaatttccatttaagaaatgagaaatggctgggcgcagtggctcatgcctgtaatcctagcactttgggaggccaaggtgggtggattgcttgaacccagaagtttgagaccagcctgggcaacatggcaaaaaccagtctctattattatattaaaaaaaaaaaaaagaaatgagaaatgaatagattcctaaaatattttccagatctattttaatgctgataagcttttgttttacagtattttccttatgattaatattcataagtatgattaatggagtgagggatattttgtaaaaacccatcaaaaatttaagtactttgatttagcatgggtagttttaatctcaaaattgttattttcggtgtgcttatgttaaacacattaaatattgtaaatattgccctttttaggaaattaaaatttggtagggtatttactagttggcttttctctattttttttcaggttactttatttttcttcttgcagtcatggtttttaatcatttgaatagttgagctttatgtctcatattctgttaatggaagtagctgcttcagatagtttgcttaggtatattgtattttgtaattgtctattcaactgtgtgggctgtggtcaccacttattttgatgatccacagtgggtcagccttttgtactaggcaccttcagatacattgtctgctcagtcttgctgtcagtactgtgaaaataagcaatgatgtcctcatgtttttcatatgaggaaaatgggactcagagaagataccaaatgtatttgccaattattatttacataacagccattcattgaactcctgctgaatgccaggctccattccaagtgccagcgttattggaatgaagaaattataagctcttggacccaagaaatcacaaactgatactggggttcaaacttacagctgcttggttccaaaatgtctgttgtgttttcagtttgaaattggagtttttatttgaaaatagttttgacttttgtcttttgaggtaactcttgcatgtgtaaatcagatctctaatgatttagttttatttccataggaggattttcacaatcacaatggaaacactgtaaaacaatgtaaatagttttaaacttttctattgttttgaggagatgggcatctcagataacaagaatcattgattagaaaatattggaacggtgaataaagttagcttctagacctcagttaccttaagtagaagtgggtataagggagagtgattaaaagaccagaggtcttaagccaggagtataccaaactcaagggaaacgattatggtttagatggagaaggtaaaaggaaatggatttgacttaaatttaaagcactattgtgaatgaggtcacaggtactctattgggaggcatgtaagttggccttacctctatggaggaccatttgacaatattaagatccttaaatatattggtgtcctttgattctgtaattctgtttcttgaaatttatttcctggaagaaaatatgagatgtgcaaaatacatatatttttcttgcagtattccttaaatgtctagagataggaaattggttaagttatggtatacacaaatgatagatatgctgtatacaaatatttaaatattaagtaaaaaggcaggatataaaactatgcatggtgtaaccccaatttaatttatgtacatcagaaaatcaaaggaaatatatctcaaaatgttaatgatagttataatgggtggtataattatgggtaattttggttttcttatgtactgttgtctgggtaagatctgaaagtgattctatttcctttggaacaattttcaaggacttgaaacctattcttgaattccaagtatgtgtcccaccacctccttttcaggttcagactgtaaaattaaagttgcttttaaaaagtgacatttggagtcgggcgtggtggtgcatgcctgttatcccagctactcgggaggctgaggcaggagaatcacttatacccaggaggcagaggttgcagtgagctgagattgtgccatgcactccagcctgggcaacaggagcgaaactctgtctcaaagaaaaaaaaaaaagtctgatatttggatgagtggagtaacatcctaattagaagatctttttcatgataatgttttgagtgttaacatatcttacttctagagctttgtgtttaagttggcagtttagaacagtgtgctagtgaggccacagtcttgcttcataaccagatactctcaaatatggctgggcgtattacaaatgaattatatatttcttatttgccttgtcaatgcctaactttgtagaaatgaatggcctgggttttaaggaaaatagatgggaggtaggggttggagggtgctgtatgtggataaatcagtataaattcctgatcagaaaaactgctcaaagaccatgggttattgagtattaagtagctctttgctttatccctgtgtaaaaatagactttttttttcatttttaaattgtctgatttaaataccctatacattaagactttgtgagaataataccaagaatatactgagaatattttgagactttaaaaatgtcagttttgaagcatatacagttaatatggaaatttttcgtggaatacatttttaaaaaacacaatattacggtaacaaccatggatgtgtgacctttttcacctgttggattaattcattagaccattagtacatacgtaaggcaaggaccctaaatctttttgccttctgataaactactgactacatatgaataaattctaaagagatgaagatttttaatggtaaagtgggttaatatgagaattgatgttaacaagtagaaaacaaaagcataatttgggtagaaaattagttggagttattaagtatatgatgtgatgttatggaactgaggtagctggttttgaattagttcctattaaaatgattgagacgtggctggccgtggtggctcactgctgtaatgccagcactttgggatgctgaagtgggaggatcgcttgaggccagaaggtcaagaccagcctgggcaatctagtgagacacatctgtacaaaaaaagaaaaattagctaggcatggtggtggcacgtgcttatagtcccagctacttgggaggctgagacaggattgcttgagctgcagtgaactgtgatggtgtcactgtactctagcttgtgtgtcaagagtgagatcctgactcttttttttttttttttgagacagagtctcactctgcacctgcactctcccaggctggagtgcagtggcgcaatctcgggtcactgcaacctccgcttcccaggttcaatcagttctcctgcctcagcctcccgagtagctgggattacaggcgcccgccaccacacctggctaatgtttgtatttttagtagagacagggttttaccatgttggccaggctggtctcgaactcctgacttcaggtgatccgcccgcctcggcctcccaaagtgttgggattacaggcgtgagccactgctcccggcctagaccctgactctttaaaaaaaaagaagattaagacctgatgggtactatactgagtttaatatttatttactttttaatttttatattttcttacaggtgattggtctgttggacgtttttacacctgcaaggtctctggaggaattcaatgatgtgtgagtaaattttttgcatttgccttcctggtctacagaatgaagactaatagcccatttctattcctgaaccatttagcaacatatagacttcaaaaaattctttattcctatcatgcacctctttttgggtgtagggatggataccagaagatgtatgttatgggtggtgcgtgttagtatttacatcatttcaggcacattgtaccccattgaagagtcagtcttgaattcttacaaaagttccatggagaaaggagtggagagagttttgactatggattttcttttcaaagtgtttatcccaggtttggttttgttgttgttgttgttgttgttgtttttgttttaaaagacacggggtcttgtgatattgcccaggctggactcaagctcctgggctgtagtgatcctcccacctcagcctcctgaggagctggaactacaggcacatgctaccatgcctggccgatcccaacttttaaaggtgctcttcaagaaatgtaacggatccccagccatatagactccctcctcttttatcgcccatgcatgtgggagatgatactagaactacatgctgatccttgaagtattagatttctatactgggataaggggcagactctacctgttgagaaaggcttcttctctcagctttgtaaccacctctgttgttttagcctgggatacccctagaaagcagagcctgggattctcaggaaccagtagtggggggctagggaaaatgaaacaggaaaggagagaaagcttctatgagtatatgttgagttggtcaccactatggacaattgggctgaaaactgccaagatctaagaagctgtacgtaatgcacctcagatggggatcattaatacactggctcctgaccccattggcaagggttgccacgtatgtcattagtgccttcacatgcccaggttgcacattggtgggccataagacagattccagcaagtgttcccatgtatgtgtgaactctctactatagtagcttttctagtatctgagttgacacagctctccctgcccccagttcacatatacactataccatgaaagagaaaaaaaccttaaacacagttatacttttggtcacattgaaattttggcattcctaaatggagagtgttactattatgaaagccaaaacagaactgaagatcgtgacttctcttccttaacctccattcccccattgaccccagggctgaacctaaccagtttctcctcacccttatcctggtttcagtttctcccattcttatcctgggctgattgcaaacaccgtttactccttccccacagaacacaaaggggatatgtttgaacttctatgttctgtctaaggaaagggagaaagaaataaagaagatgaaatggaaagggaaggaggaaaggtggcaaaaacatttctccaccatttgaatttagttggaacagtgtatggctgagagtagaagagtagaagttaagagaggagaatttggtccacctacaagatctccttggctacattaaccttgatcctgctaatgaaagtttaagaaacaaaggaaaaaaatagccaataactaagaaaaattgttcttctcgcagccctgcttgatacaacaatatggaggcttccagagattactggatgttactcaggggcatgtatattacagtttgttgagccctactgtatgctatagttggaaaagggaatgttacagaatgatggtttttaaaaatagttttcctaaatgtagaagaaatgctgaagtaatgtgtttgtgaattactttggaaaacatttgagttagatctgagctgtatcccaaaattttaggtatactaaggatggatttatataacaaaggaaatgatttgctgacttgtgcaaagtgcaaaatgctgtattttggcctaattgggcattctggaaccggattaagaacctatttttcctatgtgaaaagaccttaattaaggccagtgtctatttagaaggttaagtgttactgatagtggtgcctttgtttggctccttcatccatgtaaggacccagcaactacaaatctacctttgaactaaggtttcattcattcattcaaccattcattcattcatttattcaataaatactatggctgttgagcaggaatccgttctttctatttaactctagctggatactgttttttataaacaataactgagtttacctcttggaagcaaatctcattactacttgttgactacttactgaatgcagaacactgagcagagtgttagcacaggctcagaataatcagaaacagtcgcccttccttttgatgaaagtgtctggttgggggaaacgaattcaaagcacttttgtatccaagctaccaattggccatatgaccttggacaagtcactttaccactgtaggcccagtcatttcactgtaaaatgatgagaattgaggtcgttgacttctgaagtgttttaaattacagaaagtctctgaaaatagaatgaacttgtttgccctaagaaaaatattccattgtttactttttattgtgatgttcatatcactgaaaaaatcactgtagttcgactatagttatttcagtgttttctttttttttgagacagcgtcttgccctgttgtcacccaggttggagtgcagtggcaagatcttggctcactgccacctctgcctcccagctcatgcaatcctcccacctcagtcccccaagtagctgggactgcaggaatgggccaccatgtccagctaatttttgtatttttggtagagacagggttttgccatgttgcctaggctggtctcgaactcctgagctcaggtggtcgccctcctaggccactcaaagtgctgggattacagacatgagccgccacacccagccatttcagtattttctaaagttattttgggatatgcataagaaactaaacatcttcacctacacttgcagggtttgcaaatttaaataccttcagggtcacacaaagaacataaatgaggttcagtgttacacaattgggagtggtggggtctgtggcaaaatacatctgcacctcctaaaagtattcaaattcacattgaaacaaaacaagtaaacaaacgaaaacctacacttctggccaaaccagacataatttaggctagagtggttctacaagctgcctgtttagagcaggctataatttgaacacaaatttttaaatgctaattagcaaaatctctataattactttcagatttatagttttttttttttctttttcttttctttttttttttttgaggtggagtctcgctctgtcacccaggctggagtgcagtggcacgatcttagctcactgcaacctccgcctcccaggttcaagcgattctcctacctcagcctcacaagtagctgggattacaggcgcacatcaccatgcctggttaatttttgtatttttagtagaggtgggatttcactgttttggccagactggtcatgaacgcttgacctcaagtgatccacccacctcagcctcccaaagtgctaggattgtaggtgtgagccaccgcgcctggcctacagttggcttttaatcatgtgatacgtgtatttgtccctttatgtttcggttagcacttttaatttatatacagtcatgcatcagttaatgactgggatgtgttctgagaaatatgtcattaggtgattttgtcattgtgcagacatcatagagtatacttccacaaacctagatggtataatctacacacctaatctatatggtgtatcttgttgctcccatactacaaacctgcatggcatgttactgtactggatgctgtaggtaactgtaacgtgatgctatgtgtttgtgtatctaaacataactaaacatagaaaacaacagtaaaaatatggtactgtaggccaggcttagtggcttactcctataatcccagcactttgggaggccgaggtgggcagatcacttgagcccaagagctggagaccagcctgagcaacatagggaaaccccttctctacaaaaaaatttaaaaaattagccgagcatagtggtgcatgcctgtagtcccagctactggggagtctaaggtgagaggatcatttgagcccaggggcagcggttatattgaaccatgattgcgccactgcattccagcccaggtgacagagtgatatatgtggtccactgttgactgaaacattgttatgtggtacatgactacttcagatttttgctatgttttaaattttaattcttacaaatgaagactatacctttgagaaaggaacaataggtagtgcattttgaacattaggaacaatatacagttactgaatctggatggagatgatttttggaaaatgtagtgttaaaagatggatatactaagttgctcttgaccaccataggatgtggttgtacagatggcaaaattttgtaaagatacagtacatctagatctcttaaatgactggaaatcctttgggcctttctgttggcttcttgatagtaatgtttggcaagatactgcatgcatatatattcctgtgtattcagcagatattaccagtagaaatgcaaaaatcttaaatagccaatatttgaacctaacaccagagcaagctgtaattcagtattactataatattgccttttctttgtgtgtgtgtgtgtgtgtgtgtgtgtgtttgttttctttttgtagttggggctacaggctcacaccactagactcagctgtttttatttttttgtaaagacaaggccttgctatgttgccttggttggtcttgaactcctggactcaagcaatcccccaaccttggcctcccaaaatgctgggattacagatatgagccaccatgcccccccccacccctttttcttaactgtagtggttctttgcgcaagcatagtagacaagaattttttgattcctcctgggaactatttcctcaaatttcatggaaactgaattgtcatgagttaagtggaaattagtcttctgatactttttcctttattttacaagttcccatcccaggtttcttatactgaattccttatctctgcctcattcttgaagagggaaatggaagtggggttttggattctaccatgatagaagggaagacctacaacaaggctattcagcagcctttgttttagtgaaagccaatgagaagagatcacttcttccacttactaacaatgattgctcaactaataagtttagcttttttatttcaatgtaaaagttgctgaaaacactgaattggtaaaggaaatttctggatttacattttaacctgatgttgttcaataaatatttgaatatctaccttatgctaggcacagtaatagtctctgaggaatataacagtaaataagagctgaggctgttaatgggagagaagaacaatgtaaatgatcaaacaaaataccatgtggtaagacctgaaaggtcctacatgagttggtctccggtgtactctctaatctaacctcacctagtcctctttccactctgtctccaccccagtcactctggcctcttgttctttgagtacagacaaccacatttgcaataagacctttgcaccagtttctgttattgccctggaactttttccccacatacctacatgactgtctcctttccttcaggactctacccaagggtcttctcatcagaagctcttcttttgttaccattctaactgaaatagtacccctactgtcactgtttactccttaccctgctttgttcttagcaaattttgttattgtctgtcttctccctttctttgtaagctgtgttcaagcacggagtttgttttcttcgttgctgaatcattattggagtatatgcactccattgtttgttaaacaggtgaacacaagaattgccattatagggcaggtatagagtgctaaaggactgcatagtatggccacctaacccagacatggggtgtcttcaggaaagcctctgcaaaaaaaatgtatacacagagggcttaacggatgaaggagagttggaaaggtggggaaagtacaagttcatccaggggccgagagagggagctgagggcagaaaaggtgtgtgtgtgtgtgtgtgtgtgtgtgtgtgtgtgtgtgtttggtgggaatagaggtgtatatggcaaaagatgaagctggaatggggagggactagatctttggggctttataagctaagcctcattaaggtggttgctttagagaagagatcaaagggtactgggaactggaaatgggattggaaaaaggatgaaaggttttacttttatgtgggatgacatagttacaactctctcccccttcctccccacacaaacacattccatagtgtgtgataaaaagatatcattttaccagaggcagttttctcctggatccttaacacattaggaaatattttggatgagcatactagttgaaaatctgaaatggatataagacttttctgggaacttaaatttatgtaatgatgcttctcattgttaatatctgactttaatttcttttggtttgacttcttgccaacattacaactatgtcctttcttcaaaaaacagggtcttatgcttatgagtgaaactgacaaaacatgtgggtgagcagttctataaaaactctttttttttcagtaacatcttggagggtacaaagggctttcacataatcttatttgacacaacaatcctgtgaaacagatggtattatctctaattttcagatgagggaactgaggttgagagagatgaacctaattgtataatatcacatacaaaattgcatctctccctggtcttttggctctaaacctatttctcatcacatttttctgatctaaggctatgattattatttgaaagtctgctaccccttcttattgagtaaatattgtgttaagttctatgtaagatgccaaaactaagggcctgtctcgttttccaattgctatggtcttattaaagaaatgaggcatttcttattaagaaatgcttacctaaaataactgaagggctgagtcaaatctgtaatgtctagacaacttacagggtgctgcatgaaactcagaatattagagaagcttagtggagaaaagcctctaaagaaggtaataactgtgtccgaagaaacaaatagggataggatgtggaagttgaaatttattccagacagagaatgaaggaaatatgtaaagtgtacagaaaagagatttgtatggaatggagagtgttaaatgagaataactattgatacttcttttgtacttggataaaaattgtgcattgatgaattctgggtgtgtgtgtgtgtgtgtatgtgtgtatgtgtgtatgtgtagggttattcctgatttagctaataaatgtgatctttttggaaataatggtgaaagaaatacctagccgagttgcttggacttacaggttatttcctaatttagctaataaacatggtagttttggaaataatgctgaaagaaatactagcctagttgcttgaaactaggctaagtgctcaagatagtgaacacaggaagagaagtggtctaggaaaaagattaatgagttaactattaacatttatgtttacaattttttttttatcagagaggtctgctgaaatggagatggtgggtggcgaaactccttgtagatgtttttacaaactcacatttgaaatctaaataagttacatatctcttaagaaaatatcattcagtttttgcctgacatgatcaataagatgccacctttttctcagattagctagttttaaaaggtaaagaagcttcaaggcctagcttagagtttgagtccttcagcaatctctctctaattcacttcttcctaagtctgtgctgggaccctctcctgtgtgttctccatcaccgtatgtccctttattatgattatatattcatatatgccttcctttcatctaaaggctgtatctgtctttcccactgctgcatccccagggcccagaaatacgtatttgttgatggagtgatagaatgagtgaataactttgtgctgtcactgtttataactggttgatgatttggttgtctgaaagcatgctcagtgctctctcctttgactagcttttttgttttcatcctgtaatgtagactgtgtggtaaaatattgagtctagtttcactgatgcaggtaatgtagagggcatcttttagtaatctttgcttcaagtgagaataatttgttgtgaaataagcctactaagctgcctacttggctgctgaatgattcttttacccctaaattagaacagtctggtctgcttaccagtaagatctttggcacatgtatttcaataaaatgagcccttgtcttatcttactagtagtgctgtgtgagttgtcctgagtcattcagtggtaattgagtgcctactatctatcagacactgttctcggtactttagatactacagggaacaaaaaataaccctgtcctccacgaacattgtacaagcagataacaataaacaacagtgagcatataaaaaaggaaattacatagtctgttagcagacaataatgctataactaaaaagaaaaggtagaaaggtagaacaggaaaggggaattaggagtacaagggtggggggaagatgaaattttaaatggataggccttattgagatgaattttgagcaaaagtgtgaagaagtagaggaattagacctggggatatctagaggaagagcattccaggcagaagaggaagtcagtgcaaaggtcctgaggcagactgcatgatatattggaactggagcaaggaggccagtgtggagctgagtaagagcaagggacagagacatagactatgaaatcagagacataattaggggcagtgtactggattaggtagggctttatctgccattgaaaggaattttgtgttttactcttagtaaaatagggagccttttgaggaaaggagtgccctgatctgagttttatttctaaagaaacactcttcccctgtgttgagaatagactgtagtaagtcccaaggatcaataggtgagttgcagaagcttgtgcttacaaattgtcaatccctgtgattgttttaagcaccctgtttaaatatggaataaatgggtttttttgttttgttttgttttttgccttttgataattgctttgaataggactgatagtagtaagagacgccagtctatagatatcgaagagttttttctacataggttctttctgattgttctgtgctttaaaaagtgggaggtggggaggaagagggcgggggcagtggtgctggtcttaacaattgggtattatccaagaagtataaatgaagctgtaaaatggggtgctgtctagagtactgaaaagcatttatgacagagttcttccttcttgctgtcacagtacattttactcacaggagtcacattgagaaatgtgatttgtgctctctatactttgattaaatttaaagaagaccaacttcacaagaaaagtgaaaaacaagatttgtatcagtccatgaaattgttttcagcttttagcctaataaagtccaacttaacttaattcctttgtaaagatgtgagaactagatagctttccaaccatactcaagtctaaccttccttaatttactttaatttactttacttaatttactttaggtgttatatacattgacaatattaggcatgtctttactaaaatgtaattgactatgctttccagaaacaaatactatagaaattatgtgactctccattaatgcctcttttggaatgtgcttcttaaaatgtgctcatttatattccttgccccccatcctgttcattatttttagaagttggtgcatcttccataaacaatcagcaactttgcatgatgcttgcttttgtcccctgttgtaagacttattttgaaaatctttctatatgggagttagaatgtaacaattggtggtcatggattggtctttgggcctcctggaaacaagtatagtgattaagttagttcctgcaagatgcttctgccataaataatgcctttcagtttatttcattgtagcttagtagtaatgcttgatagttattactatatagactgattaatcttataaacttacataatgttttggcagtctcaccctcgttctaaattttggtgataaaatggatgtggtctctgagggggaaaggatttgagagaaattacatagtggtaaactgttctaattaaaagctctttccctctctctctctctctctctgttgccatgcagtcagtggtcctctggctgcctaagatttcttaactcactggtaaccatttacacataatagctgtacttgaagttgctatggtttcattagtagttttgcctaacctttgtgaactggctcaggcctattagttaggactagtattatttttatttaaaaataagttatgtttgtctcttctccataaaattatttagaaaagttcaaagaataaccctcttattatccaatgtcaaaaaatataattatgtgcaaagtagtcttatatgaccgaaattagattctgtcttcctcagcttatgcatcaatttagggttaaaaaatacagtaactgtgattaggacagaatactgctatgttcttgccagcctgagaactttgttaagattaactttgatagtaaatacagtattgagaattactaaggaaattattcagacatattgcttccctagttattgtgacgtttaaagagttttaaaaaggtcattcccttgatgtaaattttgtatcagctgaaagaattgttggaagaatatgtgctgtgattaagatcatggtctgtggggtcagttagttttagatccaactcctgacattactactctttttgaccttgagtagatggcttatccttattctgtctctatttccttgtcaatgaaatgggaacgctaatggacattatctcacagagttattgggaagagtacatgagacataatgagtacatggacataataaactgcttgctgcagtgctggacacagaataagtgctagttagtgcctttggttatgttgtgttgagattggaacatttcttaaaacgtttcagtctcatttacttattaattacatttagagtctactctttcctcaaggccgtataaacatgcaagttttaaaaatatgaaatgctaacatcttaaggttgcaactaggttaagtcctgttgatcttcatgaaattgagaactgaccatggcagccctaccaggaaattatgacagagaaaaaaattccattcctcttggaggacagaaagtaataaatatagtgtattagttgtgtgtgtaggtatataaagagaggtcacacacacacacgtttattcttataatatattaataatagatctaaattactgacctgctttcttccctccaaaattcataaaaaaatgaaaatagaaatgaaatcagcattctttatagctcagctgatatatattattacccaatctcaggaataggaatgattcttagacagtaaataaaacttacacttatttttaaaaattcagcctcttagccaggcacggtagctcactcctgtaatcccagcactttgggaggccatggtgggtggatcacttgagatcaggagttcgagaccagcctggccaacatgatgaaaccccgcctctactaaaaatacaaaaattagccaggcatggtggcgagtacctgtaatcccagctactcgggaggctgaggcacgagaatcgcttaatcccaggaggtggaggttgcagtgagccgagcttgtgccactgcactccagcctgggcgacagagcaaggctctgtctcaagaaaaaaaaaaaaaatcagcctttttagaaccgatctactttctatgtttccatagctgtgtaatacagtaatgagtgggttaaggcattgtgtctagaatatgtgtggtgaacctgttggacttgaatgtaatcattccctaatcttaccacataaagatgggattaataaccagcaccacacctgtgaggagaaattctggaatgcctcatcttgcctccagataaaacatgttcctccttcctttaaggtaaatgcaggaatattgtcaatgaacaaaatcctttcactagtcattcctgaaaaagaattacagttggaaaataaaaaaaatactcctattttagaacctgtaatgtggaagacttataatgaggtgaaaatgtagcggtggatttaaaactacaagatacttaattatagccatgcagtaagttatactatatatttgtcatgcaagaataacatttgtaagaaaactgatactgacacatgtatctttctaatccctacctttgctgtttttgttttcttttctcttttattttttgtagagatggggtttccctgtgttacccaggctgatctcacactcctgcctcagcctcccaaagtgctaagattataggtgtgagccacaaagcttggcctggtttcttttttcttgagataacctggaaaaagatatgtcaagtaggaataagtatgtaaatgtttagaacagatggcaggtagttaaagttagaatagtaatgttgggaggctaaattgggaggatcacctgagaccaagagttagagcccagcctgagcaacatagtgagaccccatctctacaggaaaatttaaaaaaattagctgtgcgtggtggtgcacacctttagtcctagctactcggaaggctgaggtaggaggatcacttgagcccaggagtttgaggttgcagtgaattactatgattgctccactgcatgacagagcatgaccctgtctctaaaaaaaagaaaagtaaaagaatagcgatgttgaaaatgaggtaatgaggtgcccttccccccaaaaaatgagtagttgttagcttttagctgtcatcgtggtacagctaccattttaagggaagggtagccttcccttaaaaacttagaagtcgggccaggtgcggtggctcacgcttgtaatcccagcactttgggaggctgaggcggggggatcatgaggtcaggagatcaagaccatcttggccaacacggtgaaacctcgtctccactaaaaatacaaagattagccgggcatggtggtgggcacctggagtcccagcaactcgggaggctgaggcaggagaatggcgtgaacctgggaggcagaggttgtagtgagctgagattgcgccactgcactccagcctggcagtagagcgagactccatttcaaaaacaaaaacaaaaaccaaaaaaaccaaaaaacttataaaagtcttctgaagataagaactttcttaggggttctagattgttatgtaacttttcactaatttctaggtatctggtgacccatctcatgggggcagatctgaacaacattgtgaaatgtcagaagcttacagatgaccatgttcagttccttatctaccaaattctccgaggtctaaaggtacagataatacaagtaataattttttaaaatgaattctccctttctcccctccttttagggcttaaacaaacaagtaaacaacttttctaatggaaaattcaaacacataaaatcacaggtaaaggtcatatagtacagtaaactgccatgttcactcagtgacaacagttaccgacatatggccaatcatgtttcttttgtatttcccaagccctggattattttaaagcaagtctagacattatataataccatccatagatacttcagtttgcatatctgaaagataaggactcttcattcttacatctaaacaataatttattgatgtaatctaatatctggtcagcgtaatgttgagattttcaaaaaatcctcaagaaagactaatttatttgttggaggggcagataaacagtgttttaaaattaaacccatctttgatatttagctgctttgagtccttattgagctccagagtgccaaccagaaaatagattaaaagctcaactgagtggagtcaatggctgtggaaattatagtaatggtaaatgtacacaatactgatagttacttatgctgatttctaatcttactattaacactagcagttcttactgattcatgaaaatgtgcagcaaatatgttatataatatgacaatagaaggttggaggtaactttgacttttttctcttttgcagtatatacattcagctgacataattcacagggtatgtattgtgactttgattacattattttggggaagtggggtgagagtggaagaatggcatttagccaagatcctaatctaaactttagccattgaaatgttgattgattgcaactttactgtaggtttaagctgattaaagaaagaagatgtgtagtttttttctatgtaaggctaacttggactggatattgactgtaggatggagattgtcttttgatagctggatgaagtcttttatgtctggatcctcattattacctgtagggggagaattgatcatgcatcataaagttgatcctgtcttccctgtatttgcttcctaggacctaaaacctagtaatctagctgtgaatgaagactgtgagctgaaggtaaaatgaagagacagtattcattgtttgctttactttgagattatatgtttgactaagcaggcagactttcttagggagtagctttgtgagccatgactatctgaaattcgtattatttttattatcagactttgaaatttaaaccatttctgagtaagctaagtgacattgaaagtggcatcacttgtttttattttaacataaagttaaattataaatttgatatattagtcataataaaggaggataatagtcaaatatcaagtaagtaggcccaaagaggtgataactagattaaatacatttctaagaggagaaatggcagaaacccactcactcaaaataattcaaataaaaaataagtgaattaattgtttctaaatagcaagcagctctagaacttttgttccatttcatttttttaacttgaaaaaatgtctgtacattagaatgcaccatttcatttggcaaaattatatatccacttaactcacatttatgataaagaccatttctttttttttccttttttttgggatgcagtctcactctgttgcccagtctagagtgcagtggtgtgatcttggctcactgcaacctctgcctcccgggttcaagcgattctcctgcctcagcctcccgagtagctgggactacaggtgcacgccatcacacccggctaatttttgtatttttagtagagatgggatttcaccatgttggctaggatggtgtcgatctcctgacctcgtgatccacctgcctcggcctctcaaagtgctgggattgcaggtgtgagccattgctcccagccaagaacatttggattactttaaaaagtttatggccaggcgtggtggctcatgcctgtaatcccagcactttgggaggccaaggcgggtggattatgaggtcaggagatagagaccatcttggccaacacggtgaaacctcatctccactaaaaatacaaaaatttagttgggcatggtggcgggcacctggagtcccagctacttgagaggctgaggcaggagaatggcgtgaacctgggaggcagagcttgcagtgcgccgagatagtgccactgcaccccagcctgggcaacagagcaagactccgtctcaaaaaaaaaaaaaaaaaaaaaaaagtttattgtgtcccttcctagtcaatccctacccctccacccctaactctggctccaggcaactatggatctgcttctaacactatagattaggtttatcttttctggagtttcatgtaaatggaatcatatagtgtgtatttttgtgtgtctggcctttgcttggtgtaatgattcggtattgttgtgtgtgtcagtggtttcttcctttttattggtaatagtattttgttttatgaacataacagaatttttaaatctatccacctgctgatggacatttgcttgagtttgaggctgtgtaaagcaactgtgaatgtttatgtgcaaacctttgtatggacgtaagttctcattgcacttgattaaatacctgggagtgacatttttgttttgctttttgtaatttcattttaagttcttgctgtatatttaccatacattctaagtatggaccaggaaatctctttatgaaagtgctattttgttctcctttttaataaggcaacagaggtttgtttgttgttgttgttttgtttttttttccctgcctgtttctaagtcttagcagtttgtctgttcctcttctgccctttagattctggattttggactggctcggcacacagatgatgaaatgacaggctacgtggccactaggtggtacagggctcctgagatcatgctgaactggatgcattacaaccagacaggtattactcgccttggttatttagggccttatttaattccatgttggatgcatttgggattctcagaaatagagatggtgggagtgggaagaaatgtcttttcttccctcagtgatccttttaaagcctgcaagtaaaaatatttcacttcctcagatggggaagtggggttttatacacagcttttaaaccttgtgatttagcaattgggtttttatttatttagattttgaatatattctctgagtacttatacctaaagacaattagtccataattttaacccctcaatgttacttggaagaatctaccattctactaataagaaacttgcccctttttaaacagcttatttctcttaagtgtgttttgacttaccccacctttgaacagccctttagtcaggtgaagatcttagtaagctatttatttctgtaaaaatgagtatgattgttgagcctcagatgtcttaaatagtaatttgaatatttcacccctagttacggtttcatttgttgccaagaattgtaacagtgacattgcatatacttttacttctttttaattttgccagttgatatttggtcagtgggatgcataatggccgagctgttgactggaagaacattgtttcctggtacagaccgtatcctttaaaaagttttggattcttgtttcttatctgtattccagtgtccatgggtgtatactccttttacttatctctagggaagactctcagtattttgcttttatagtctagataatgcattatgaggtctttcttcaaactgagtagcttgccttgccaagaaagaggcttcagtttacttttgtgagttggaaaaattcctcataagttgaaaaacccatcaagtctgtcttctttttgcaacagtcccttattaatcatcccacagcagttctgagacctgagcatactcatgagaaactccagatcccagtgacagttttagtcttcttgtataaacacttaatgagcacaagatgcccatttataaatgaagggcatcttgctgttatgtttatgtattaaaagggctatgtttggtacctgcagtgatatactgcttacttgttatgtttgttgtttgacaacaaatagtaaaagcaagaagtgaaaagcttaccatgtaatgtacttttgtttttccagcacaactttttcccagattgcagccaaaccctaatttactccaagacttactgtctagtttatggtttattatagcccctttattttagctcctttcctatctgcggtatgcttgtttcatggtttagtattaatgtcatgaaaaatgtggtctgttggaactctcatcagttctacttatggaagatgtttaggtgagaaagattgttaaaatatatgtctagaattagttttggggattttttctttttttaatagaattgagttaactagccttcaggtggttttggttaggcaatattagacatgctacctctgatctattatgcctagagatctaaaagccattttagtcccttacctaaataaactaattgagtttataaaccagaatgtcaattcacttgcttacagtttgggatatacttctgtaatggctatgatgttcatgatatctacccacgtgttctaactatcttctgctagagagaatgtactttcattatgaactgaaaaaacctctatttctcaggtaaagctgtttctttctctctgaatattaggattgataacagagttcagtctccctgtatttagcttaccttattactccctacctctggattttaaattagtttaatacctggtgtttctcctttgtcctttgtttcattcaccttatatctgtttctcagaaatttggtatatatatattacagtccaaggtaagagaattagggaaaattcatacttccccctttcctcaggtacatatctcagagtcccatccttgctttgtcctctagagtagctgctgtcctgatgctattctctgttccctgctccccttcctcttcttgtgtctgtatctccagctaccatttagtcagtcacagacctccatgccggtgtagacacacaaggtggcagagagggaaaggcagtataacatacaggttaagcacatgctctggagccagatttcctggatttagatcttagctcttttatttccagctatgtaactttgagtaagtttcctaacctctatttctctcagtttccttaaccgtaaaatgataataatcatacatactcacaaggttgtcgtaagaattcagccagaaaataactggaaagtactgagacgagcctgccagtaaatgttagccatcatgttcagtaatggccttgcaaaacagattaccccttcaccttctcacttaattgtctacctatgaatcattaatgttttgttttgtttttaattctgtgataggtaggaaaggatggaactccttggcagactagtgttagaaagttttcgaagcagtgtgagtcttgtacctttgtggtcctgtctcacagacacctgtctattccctgacccttttaaatgctaactttctgcctgtaggaaatcttccctttgtgcttaggtctttttcttctgtgagctttagataaacaacctagtgtttaaactttttaataagggattcattttttaatacatgagaattcatttcaaaattttggttttagttatttattttattctacttggctctttttcagacagatgttctctcctggattgtaaaagtcgaattcaaaggatttttatttgtaatatacttaacctttctcttgtaagttgccatctgtgtagatacagctttgattgcctgacaagaggaaaatgtttcccattatcttttcctgcctgaactatacggtcacttgtgttccagcatagtggttcttaaccctcatagtgtgtcagaatcactttgcagagcttttaaaaactctagatgcctggggaccaccccaaagactccattttgttgtcatgggtcaaagcacagtcttctagtttgcagctagtgttgagtacaactagagtttaacccagttgaattttagtttaatcttggctggtcttgaagatgttagtaatctctattcattttttttgaaaagtaccaatgagatcagaaagttaattagaaaacatctagttgaatcccctgtttttaatagatggggaaaccaagacccagagaatataatccaaagctacctgtcacataggccacaatttcttttccaatattctgttcttcgctgttcttctaatttgcagaactcctctttaaaaaacctttggagaatgtattggcctcataccctcttccttcagcctgaaagacatgcacctgtcacttatttatgatatttaaatgcaacctctagaacaggggtgtccaatcttctggcttccctgggccacattggaagaagaaatgtcctgggccacacataaaatacactaatgatagccgatgaacttaaaaaaaattgcaaaaaaaaaatctcgtaatgttttcagaaagtttacaaatttgtgatgggctgcatccaaagccctgggccacgtgcagcccgcaggccctgggttggaaaagcttgctctagaaggtactcattgtttgagtgtccagttttctccctgttttccttatttattgatcattttgcatttggaattggtggtttgggcttgtaagtaagaactgtgtactagaacttttgtggtattgcaaatgttttatatctgtgctatccaatgtggtggttataggcaccagctgcctgtggctaattattaagcaactgaaatgcagctagtggtgagcagtaacgttgtggagaagaaaaaaaagaaatgtagctagtttaacttggaaattgaattgaaaatatttttgtggttaaatgtatttaacataaaatttaccattttaacctttttttttttgagacagtcttgctttgttgcccacgctggagtgcagtggcatgatcttggctcactacaacctccgcctcccgggctcaagcgattctcctgcctcagcctcccaagtagctgggattataggtgtgtaccaccatgtaatttttgtatttttagtagagacagggtttcaccatgttagccaggctggtctcaaactcctggcctcaagtgatccgcccaccttagcctcccaaattgctagattacaggcgcgagccactgcacccggccccattttaaccattttaagtttacaattcagcggcattaattacattcatgatgtacaatcactactactacctatttccagaattttttcatcaccgcagatggaaacactcagcccgtgaaacagtaacttcccattctcccctctggtaacctctgttctttctgtctctgtggatttgcttattctagaaatttcatagaagtagaatcatattatactgtatttgtccttttgtttctggattatttcacttagtataatgttttcatggttcttccatgatgtagcatgtatcagaatactattccattgtaagtatttaatatatcccacattttgttgacctgttcatctgttagtagacagttgagttgtttttacctttggctattgtgaataatgctgcagtgaacattgtcatacaagcatctgtttgagtccctgcttttgattcttttggttatgtacctaggagtggaattgttgcatcatatggtaactctatgtttaactttctgaagagccaccaaactcttttccatagtgtctgcaccattttacatgcccaccagcaatgcatgaggattcctgtatctccaaacttgttctttttttttttttaatagtcacccaagtagttacaaagtggtatctcactgtggttttgatttgcatttctctcatgactaatgattttgagcatcttttcatctgcttattggccatttgtatgtcttctttggagaaatgtctattcaagtcttgcctattcttaattaggttgtttgtgtttttgttgttcagtggtggttctttatatatcttagacccttatcagatacatgatttgcaagtattttcacctattttgtgggttgtcttttcactttcttgataatgtcctttgatacataaaacatttttaattttgattaagttccaatttattttttttctgtccttgctcatgcttttttgatgtcatattttagactgtattgccaaattcaaggtcatgaataatttacccctatgttttctactaagagttttgtaactactaggaatataatagggtttagctcttatacttaggtctttgatccattttgaattaatttttatagatgatgtgaggtaggggcccaacttcattcttttgcatctggaagtccagttattctagcaccataaagagactattacttcccccatcgaatcaacatgataccctaggatttctcctttgttttttgtttctttcaccttttacctgtttcttagaaatttggtatatataattagcaatacacgtgtgggtttaattctggactctcagttctattctattggtttatatatctatccttatggcaataccacactgttttgatcactgtagctttatagtaagctttgaaatcaggaagtgtgagtcttccagctttgttcttctttttcaagattgctttgactattctgggtcccttgtaatttcatatgaatttaacaattggcatttctatttctgcaaaaaaaaggctttagaattttgatagggattgtgtcagatttttagatcactttaagtgatattgacatcttaaccactattaagtcatcctgttcatgaacaaaggatctctttccatttatttaagtctttatttttttttcagcagtgttttatagttttcagttgtaaagtattttaccttggttaaattttttcctatgtattttattatttttgctgcgattatagatggaaattctttggtgtgttcattgttgatatatagaaaccaaattaatttttgattgttgatcttacaccctgcaaatttgctcaatttatttattagctctagcagctttcttctagattctttgtgattttctatgtatagggttatgtcatctgcaaacagagatagttttatttcttcctttccaatttagatgcttttaattctttctcttgtctaatgtaatggctctgtctagaacttctgctacaatgctgaatagcaacagtgaaagtaggcatccttgtcttgttcctgtcttagggggaaagctttcagtctcttcccattgagtatgatgttagctgttggtttttcataaatgccctttatcatgttggggaagttctcttctttggtagtccatttcacattgctatgaaggaatacctgaaactaggtaatttatcaagaaaagaggtttatttggctcacagttgcatagctgtaaaagaagcattgtgccagcatctgtttctggtcaggacctcaggaagctttcacttatggtggtagggggaacaggcatgtcacatgtcaaaggagggagcaagagagatgccagactcttttaaacaaccagcatttgcatgaactgatagagcgagaactcactcattaatgtggggagggaaccaagccattcatgagggatccaagaccctaacaccttcaatcaggccccacctccaacattggggatcacatttcaacatacttggaggggacaaaacatccaaaccctatcaccttctgttcacagttttctgagtattttaatctgaattttaaatgccattaaaattttatttagattacattgaaacttaattacacatggctagtggtattggtttatgcatttttagatcccttcaagttatcttcctgttctacctttttcttgggttttgtaattagtctccttcttgaaagattattttggtactggttgttagtaattcctggatttcctttaaagatataagaaatactggggaggggacaagatggacaactagaaatagctgcaatcagaggcttccaacaagaagaacgaaaacggtgagtgaatcctgcaccggcaactgaggtattcaccttctctcaatgggactgactaggtggttggcatgacccatggagagtgaggaaaagcagggtggagcgacagcccacctgggagctgcaaagggcaaggggagctcccaccccaagccaagggaggtggtgagtgattgttctaccctgtccaggaaatcatgctttttccaaggatctgtgcaacctgtgattcaggagatccccctcatgagcacatgccaccagggccttgggtcccaagcacagagctgtgtaggttcttggtagccctttggctggagactacataagactactgagttccttgggggaggggttgctgtcatcactgcagctccagtctgctgttttcccctgctggtgctggagagactgggcggttgggacccagaaggaattccctacagtgcagaccctacagtggtggtggcacatcatggccagactgactctttaggctgaactctgactcatccccctacacggggcagggcctctctgcgggaatttcagcaactccagccaggggtttacagacagaattccaatctccctgggatggagcccctggtgggaggggtggccacagtctccacagatcagcagagttagtctttccccttgctggctctgaggaatccaggcagtctggatgagtgagatttcccccagtgcagcacaccccctccaccaaggggcagccagagtgcttcgttaggtgggcctgtgcctcttgactggatgagacccctccaacaggggtcgccagacaccttatgcaagagcattcccactggcatcaggttggtgcccctctgggacggagctcccagaggaaggaacaggcagccatctttgctgttctgcagtctccactggtgacacctccaggtacaggagggacccaggcaaagagtctggagtggacccccagcaaactgcagcagccctatggaagaggggcctgactgttaaaagcaaaacaaatggaaagcaacaacaacatcaacaaaaaggtccccaccaaaacccctccaaaggttagcagcctcaaagttcaaagctaggtaaagtcatgaagatgagaaagaatcaatgaaaaaacgctgaaaactcaaaaagccagagtgcttcttttcctccaaatgatcacagcacctctctggcaagggcatagatgtgggctgaggctgagatggatgaattgacagaagtagacttccgaaggtggataataatgaatttcactgagctaaaggagcatgttctaacccaatgcaaagaatctaagaaccatgataaaacattacaggagctgttaaccagaataaccagtttagaaaggaacataaatgatggagctgaaaaacacaacatgagaacttcataatgcaaccacaagtatcaatagccaaatagaccaagtggaggaaagaatttcagagcttgaagactatcttgctgacaagataagagaagaatgaaaggaaatgaacaaaacttttgagaactatgggattatttaaaaagactgaacctgcgaatgataggggtacctaaaagaattggggagaatggaaacaagttggaaaacacacttcaggatatcagccaggagaacttccccaacctagcaagacaggccagcattcaaatcaggaaatccctagagaaccccagtaagctaccccatgagaagatcaaccccaagatacataatcatcagattctccaaggttgaaatgaaggaaaaaatactaagggcagccagagagaaaggctaggtcacctacaaagggaagcccatcaggctaagagtggacctcagcaaaaaccctacaagccagaagagattcggggccaatattcaacattcttaaagaatttccaacccaaagtttcatatctggccaaactaagcttcatagtcaaagaagaaataaaatcctttttagacaagcaaatgctgagggaattcgtcaccaccaggcctgtcttgcaagagctcctgaaggaagcactaaatatggaaaggaaaaacttactggccactacagaaacacactgttttcttttaccagtaacactatgaagcagttacctcaacaagtctgcaaaataaccagctagcatcatgatgataggatcaaattcacacataaaaaatattaaccttaaatgtaagtgggctaaatgccccaattaaaaaacacagaacggcaagctggataaagaatcacgacccatcagtatgctgttgtattcaagagacccatctaacatgcaaagacatacaaaggctcagaataaagggatggaggaaaatttaccaagcaaatggaaagcagaaaaaagcaggggttgcaatcctattttctgacaaaacagactttgaaccagcaaatatcaaaaaagacaagggcattacatagtggtaaagggctcaattcaacaagaaaagctaactatcctaaatatatatgcacctaatacaggagcacccagatttataaaccaagttcttagagacctacacagagacttagactcccatacaataatagtgtgagactttaataccccactgtcaatattagacagatcatcaagcagaaaattaacaaggatattcaggacttgaactcagctctggacctgatagatagctacagaactctctatacagaaacaacagaatatacattcttcttagcagcacatcgcacttaggctaaaattgatcacataattggaagtaaaacactcctcagtaactgcaaaagaactgaaaatataacacacagcctctcacaccacagcacaatcaaattagaactaagattaagaaactcactcaaaaccacacaattacgtggaaattggacaacctgctcctgaatgactcctggataaataatgaaattaaggcggaaatcagaagttctttgaaaccaatgagaacaaagagaacataccagaatctctgggacacagctaaagcagtgttaagagggaagtttatagcactaaatgcccacatcaaaaagctagaaagatctcaaattgacaccctaacatcacaactaaaagaactagggaaccaagaccaaacaaaccctaaagctagcagaggacaagaaataaccaagatcagagtggaactgaaggagatagagacaggaaaaacccttccaaaaatatcagtgactcccaagatctggtattttgaaaaacataaaataaaataaaatagactcctagctagagtaatgaagaaagaagaatcaaatagacacaataaaaatgataaagggggtatcaccactgaccctgcagaaatatgaacaactatcagagaatactataaacacctctatgcaaataaactagaaaatctagaagaaatggatgaattcctggacacatatgacctcccaagactgaaccaggaaaacgttgaatctaccaataacaagttctcaaattgaggcagtaataaatagcctaccaagcaagaaaagcccaggaccagacagattacagccaaattctaccagaggtacaaagaagagctggtaccatttcttctgaaactattccaaacatacaaaaggagggactcccctataactcattttatgaggccagtattatcccaataccaaagcctgccagaaatacaacagaaaaagaaaacttaaggccaatatccctgatgaacatcgatgcaaaaatcctcagtaaaatactggcaaaccaaatccagcagcatgtcaaaagcttatccatccaccacggtcaagtcagcttcatccctgggatgcaaggctgttttaacatatgcaaatcaataaacataattgatcacataaacagaactaaaggcaaaaaccacatgattatctcaatggatgcagaaaaggcctttaataaaattcaacatcccttcatgttaaaaactctcagtaaactaggtgttgatggaacatacctcaaaataagccatgtaagacaaacccacagccagtatcttactgaataggcaaaagctggaagtattccccttcaaaactggcacaaggatgccctctttccctactcctattcaacatagtattggaaattctggccagggcaatcaggcaaaagaaagaaagaaagggtattcaaataggaagagaggaagtaaaactctgtttgcaggtgacatgatcctatatctagaaaaccttgttgtctcagcccaaaagcttcttaagctgataagcaacttcagcaaagtctcgggatacaaaatcaaagtgcaaaaatcacaactattcctatacaccaacagtaggcaagcagagagccaaatcatgaatgaactcttattcacaactgctaaaagagaataaaatacccagaactatagctattaataacaagggaagtgaaggacctcttcaaggagaactacaaaccactgctgaaggaaatcagagaggacacaaacaaatggaaaaacattctgtgctcatggataggaagaatcaatatcatgaaaatggccatattgcccaaagtaatttataaatttaatgctattcccattaaactactgttgacattcttcacagaattagaaaaaaactttaaaattcatatggaaccaaaaaagagtccatatagcccaaacaattctaagcaaaaagaacaaacctggaggcatcacactacctgacttcaaactatactacgaggctacagtaatcaaaacagcatggtactagtacaaaaacagaccaatggaacagaatagagatctcagaaataaaactgcacatctacaaccatctgatcttcaacaaacctgacaaaacgagcaatggggaaaggattccctatttaataaatggtgctgggagaactggctagccatgtgcagaaaattgaaactggaccccttccttacaccttatacaaaaattaactcaagatggattaaagacttaaatgtagaacccaaaacgataaaaaccctagaagaaaatctaggcaatatcattaaggacatagacatgggcaaaaatttcatgatgaaaacatcaaaagcaatggcaacaaaagcagaaactgacaaatgggcttctgcacagcaaaagaaactatcgtcagagtgaacagacaacctacagaatgggagacagtttttgcaatctatccatctgacaaaagtctaatatccagaatctacaaggaatttaaacaaatttacaaggaaaaaacccattaaaaagttggcaaagggccaggcacagtgactcatgcctgtaatcccagcactttgggaggctgaggcaggtggatcacgaggtcaggagatcgagatcatcctgactaatttggcgaaaccccatctctactaaaaatgcaaaaaattagccaggcatggtggtgtgcgcctgtagtcccagctactcaggaggctggggcaggagaatgacgtgaacccaggaggcggagctggcagtgagccgagatcacaccactgcactccagcctgggcgacagagcgagactccgtctcaaaaaaaaaaaaaaaatattggcaaaggacatgaacaaacacttctcaaaagaagacatttatacagccaacaaacatgaaaaaaagctcagtgtcactgaccattagagaaatgcaaatgaaaaccacaatgagatactgtctcatgctagtcagaatggtgattattaaaaagtcaagaaacaacagatgctggtgaggctatggagaaatatgaacacttttacaccgttggtaggaatgtaaattagttcaaccattgtggaagactggtgaaatcctcaaagacctagaaccagaaataacatttgacccagcaatcccattactgggtatatacccaaaggaatataaatcattctgttacaaagatacatgcatgtgtatgttgattgcagcagtattcagaatagcaaagacatggaatcaacccaaatgcccatcagtgatggactggataaaaaaacatggtacatatacaccatggaatactatacacccataaaaatgaatgagattgtgccctttgcggggacactgatggagcttgaagccattttcctcagaaagccaaacaccacatgttctcacaagtgggagctgaacaatgagaacacatggacacatggaggagaacaacacacgctggggcctgttggtggggtgggggtcaggcggagggaacgcatcaggataaatagctaaggcatgcggggcttaacacctaggtgatggattgataggtggagcaaaccacgatggcacatatttacctatgtaacaaacctgcacatcctgcacttgtatctcagaactttaatttaattttaaaaaaatataagaaatactcatttttgtcttaaagccaataatgtgttatcagattagaaattattcttgtttgtgactttgcagaacccttccatctggcctaatgatagcattattattttttaaagaatgaagccctttcttaaaagcctagttgactagggatatcaagtggacacagctgacagaactttgtactagaaaggagggaggatacagaatgtctcttcaggtacagtactaacttatttcaaataccatagatcttgaaatgaataagccactttgaaaattctgttaccaacgcttaacactctgcagcttaaggaagagagaaagttttatagccctgttatgcatcaaataccgtttttctaccagagatcacagccttggcttgctgttgttttccttttctccataatcaagtgaatttccttatgtgtaaaaccttctttaattttaacagaaatggtgctcttaagacataatgggttaatggagctgagttaaaatccacttgccatcagttactgccctggtctatgggagttttcctagtgtattaaatttgcttcttatatatttttttttatttcttcttttgcaaacatgttttgaaatatttcagacatactgctagacaaagaataataaacacctctgttcatactgtcctgcttgtgagttaaaacactggcaatagagctaaagcttctggagacccttctctcacatctgcccatcactttcagtcattggtttcaaatactctttctttttttttttgagatggagtctcactctgttgcctaggctggaatgcagtggcgcaatctcggctcactgcaacctccacctcctgaggctggtctagaactccagacctcaagtgatctgcccgccttggcctaccaaaatgttgggattacaggtgtggccactgcaccctgccaaatattctccctctctctctttttttttttttttggagacagagtctcgctctgtcgcccaggctggagtgcaatggcgcaatctctgctcactgcaacctccacctcccgtgttcaagcgattctccctgcctcagcctcccgagtagctgggattacaggtgcacgtcatcacgcccggctaatttttgtatttttagtagagacaggattttgccatgttggccagcctggatgttctctcatttttaaaaagcagtttcactttagacaccaaaagcaagtgtccaataaatgctgaagaagaaaaatattttattaggttatttgccctttcctctctaacttgaaaatacattttctcaggaaaaggtagaatcctcagatttgtccataaaccaagggtcccttaagaaattttctttgtgttacagtgaaaatgactattttgacaacttggaagataaggagctaggctaagtcttattctagtctatcctgtctgtcaccaggaagatttcctaccttcccaaaggttagtgctccacttcacccctatgtggatttatgtctttgaaaattactgctcatggcaggtaggtcctgcaattggtccttttatttatcttcaactttctggcctgtggaggttttttaggagtgcctggagcacttagaactgactagaatatccctcttttactttccctagaaatatcctgttatgcttagtttttttgtttttttttttctttacctgttcattctgactgacttgcttctgttaaagatgacttcgtctaaagagtaatcttaggcttaagttgttcttttcttcatttgttttagaaagattcaggagatttatgatttaaattttgacgttgtgatcattacaattaaaacacattttaaactaatagtaaaaatattttctacctaagagaaacagggctaaacctattacaaaggatggctcactgtggaaataactgattgtcatgatgtggtgagttttgctttactccgctaatgtggctacgtgacgctccttctggtcttaactgcctggacaaatcatagtggccttatagtagctggtactgttggaagactggcctgtatttcagtggatttgccagcttttgaagaacccatggtgatttcttctgaggtttgcatgttttaacttccttcatgcaaatgcttttagttactaagatttttattttatgttgtgtgtttttccatggagtatggtcattctgtgttttgagggcaaggcagtggggtaaagctgagttgaaaagcataatatggctcatcttttcttttcttttttttttttttttcattttttgctgcttttattttacgaaaaagctaattcaaatctacattaaactaagttgaatacaaagcctttgtgaagaaggcctggtagtctcatttacaaaaatggccagtgtcgtctttggccttaaaatttcaggacgggcacttcagatggcttcacatttgcatgtttcagtgctagagcatgggaatagactttggcatccactgtaagatgtttttcagctacgagagcatcgagtccctgcagcaggtcattcttgggtaacgaaatgacttccacaaattctccatcccctggctttggcttgggccttacattttctgcgtcatctccgttaatgattactgtcacgatgtgtgtggtacagtttgacaaacctgggtccatatagaccactggagaacattcagcagcgtcccctttgtagccagtttcttcctcaagctcccaaagagcagctgctcctggggtttcaccatcttctatgagttccctgcagggaactctatgcagtagccacccattggtggtcaggactgtttcaccagaacgatacactcgtagtgaagcgttctctgcagcacagggatgaccgctacatcatcaccagtctgttctttcctggttgtatgtttcactgagtcccaagttccagttttaccaataggagccatgtatgttgttttttcaagtttgacccattttccttctgaaattaactcctctgaaataatatagtgtttccattctgagacaattcagttggttcttggctctcccttttcaaactagtctttacagccctcaggagagaagttcacctccaaagtgtaggggtgacaaagggaagaggacaaaagaactactggaggcagcagtgtcagcatacgccggtgtcacgactcaagacatcggcacctcccgaggtgatgaaaggatgtgccatggctcatcttttcaagtcaactagtatttatcaagctgctctgtggaaggtgctggggacaggatggtacctgtccttaaaaccagaatgatcagactcagtggaaagagagttacaagagttacttgaacaactgtctctgattataaaataagatggagtgataaatacactagaatagagttatagataagctattgaaaaaaatccaagaagacttcatggcagagttcttgtttgaataggacttcaaagtgtaaataggaatagaaaaggcttggaaggacgggagaagggggaggtattctggtttatgagtacataaataagtacttggaagcttagaagtgcctggaatatctgatgtgagttgaagcattgagtgcattaaagaataataatttgagccagagtcaaactaggcttgattcttcaggcctgatattgtttcatgccagcagaggtgggagagagagggtttctcagctcattgatgtaatgagccactgtgactaatggaaattgcgtattcttcaggtaggttggggtgaagttcaggtagttgagaaattcacagctcagagagcctgtcttccttagagagagtataaaaattgactctcagccaggcacggtggctcacgcctgtaatcccagccctttgggaggccgaggcaggcggatcatgaggacaggagattgagaccattctggctaacatggtgaaaccccgtctctactaaaaatacaaaaaattagccgggtgtggtggcaggcgcctgtagtcccagctactctggaggctgaggcaggagaatggcgtgaacctgggaggtggaacttgcagtgagccgagatcgcgccactgcaccccagcctgggcgacagagcgagagactccgtctcaaaaaaaaaaaaaaaaaaaaaaacaactgactctcattgttaagtagtcagaaagaagtctcttaaacaagagtaccaatatcaaaagcttcattttagagattacttttgatgcatatattgtaaagccacttgtttgagatttgaagtagtcaagatttttcccatatatgatttactttatcttgtggtggctacccagttaaatatattcctgaagagtgttaatgtgaggaaactaaattttttgaattgagtcattttagatgagcaagaattttttttactgatttctattgtaatataattaatctgattattttagagcaagacagtatccatcccacccccattcctactctgtcccatgaacatatgctataagattttttacttgtcaacatcttgaactgagaagccagtattaaaatcttaacctttataacacaatgatttttgccatttgcagatgacaaaattccctgttattcttaatttagaaataatgtgagtggacttgtttctagtttgtttttgcttgctaaagaacacaagttgtttgggtttagggtggggtttggcgcaccttttctgaaagggccaggtagttaatattttaggcttgggaaccatatggtaactgtgcttgttgtaattggaaacacctatagactgtacataaatgaatgggcatggctgtgttctaataaaactttatatataaaacaggcagagcctggggtttggtgactccagcctagaattttcttccatttaagctgatttcatgtctgaaagaaagtaaaagacaggatgtcaaattactgcattaagttattcctataacgtaggcacctgtggcttatagagactgttgtttttaagtgctgctatgttgcctttatatgtataaccataagcaaaaatttctttcatcctgctctaccttttcctcaaatattttgactacctgtcatgtaccagatgttaggctggggataaatggtgaagaggcagagtggcccctgtcctcgtagagctgtagaccagtacagggggcagacagtaagcaaataaagtaattctaggctgtgataagcactatgatgttatcaagcatggtgctgagagagaattggggggtggggtgttatgtatatagagtgttgaggggaggcctcccttaggaggtgaagttgaagctgagacctgaagccaagaggatttagtcatgtgaaaaacctgatgggtcagaagacagtcatcctccccttctccctccctggaatgtcagtcagtataaacgtggataaactgttcacattttcagaggaaatattaaaagctattttataatatttttccccctctttttaacttcctttttaggtaagattaaaagcaatgagaacaaacaaatttttgtcttctggttaacacatgcacatacattctgagtatacattgaagtgttagctaccaggataaaagttatggcattgtggcctattatttagagcctttgggatgtgtgaagtttgttaagcattgttcatttgcattttataaggttgaaaccgcctgtatttgcgttctcatggcgctcctaaaggaacatgcgatgggagagcgccctctgctggcgactctccctcatagtgcctgctatagccagtgtgagaggcgaggcttccctttccagagggtgtgctccagtggtcaggctttggggtctcacaggccttccactgtcatatcacaagctctttaggtcacgcttgggagaatattcataaatagacttgtacatccctagctcctgtcttctgctgcttttttccttatctgtggccctctaattatcagtgcactttgctgaactggttactgacactgtgatggcagatgaagagggcagtgtaaactgagtgaagctcttgtgttttcacctgctgtctttggcagctaagaaccagctaaagttgcctcactttactgatacatgctgttgacagatgcataaaatgaatataaagtggatatgtgtttggtagcattttgaatctttgtacaggaggagcatgccctacgtgaagtgatcatcctgcaggagccttgacctagagggattcaccgtgttggctaggtttggggtgtttcatttttgttctcggtgtgttctgtttgtttgtttttgttttgtttgtcattgtttgtttttcatttttattttgtcccaacattttcctttatggtccaccattagatattgatcagttgaagctcattttaagactcgttggaaccccaggggctgagcttttgaagaaaatctcctcagagtctgtgagttgatgctttgtaattatctgccctgttgggagcctctgccacttgccttctaccaatctgtactttgacctgggtgtgtttgtaagcacacatgccctttgtgtgctgacttcccggatgagtgaggtataagacagtgtgagtgtgtgtgtgcgtgcacgcatgtgtgcctgcttgcatgcacaagtgtgttttattctctatctgggtacacactaagatcacgggagcctccattagacaatagtatcccagtaaagcaatgagatttgagattctaattcattccaagagattaatgtaaactttgtgtctctgtcctcaagacctgactttcttctttctcagaagtttcacgtatgctctagagctcttttcactgtttctagtgtttgttctcagagcatgagcttcaccatgtatttagtttaacttaatcactaaaagaataaaatgtacattgtctgcacactgttgccccttcccagaagttattttttattgttttagaatagatactcacatatcctatgtaaaatgtttgttcccaacagagggacctttctacccagtccctagaccccactcagaagaaacagcttcactcctgatacctcagatacacaggaatgtggttataaattttcctcctattgccttgtaattataagttagataacctgagacagagtttggaactagtgctttcttgcttctaagcagggacttagacagaagccatgggaatgtgagtctggcttacttttgctatgatttcctgctcttggtcattttcttgggccagaggcatgagagaagccatgaaagcccagcttttctttttccctcgatctgctgccaggcagttgaacaaaagaaaaaaagagctatggagccaagctccagttatgccttcctggattctcctcccaacatttatgactgaaggggccctttgcctagttgggaagatggctgggtagcttgaggcaagcataagcaggtgagttggaaccgttcatcatcttcctgacaaaataaagaataccgtcatctggtatgtatccggtacatttcttgaaaggatcccaaagcccagtgtatttctgaacctccactctgaatttgtttcatttacttatttaagataaagaagcaaaagcccagaagggcagtgacttttccatgtcatgcactgaatcacgtggcagagctgagtatagatcccagatgttctgataacatgatccaaactataatcccatgtgattacacactattttgaaagtcattgtcagtgttaccacaatgtcaacctaaagaggtatttttttctcctttatgatatgtagaagctgaattagagtgaatcaaagatatcagatgatgcttagaaagagcagtactttttttttaatgtttttgcttagaaacactgtcttacagtaagaggacctaagggcagagggaggagctcaattaataaatagtgctaatgagaccaagcaaattcatttccttcctgagagtgtctcctagcagccctttcttagtcttctcttccatcccaaccatctgccctatagatacgtgctattagtcatttggaattggattaggaattcaaaccaaagtctaggtaaaatagtcaatagtatttatctgtcattaatccatcacttatttttaagaaagaaacaatgagtgcacagcctaataatggaggtctctctgtgaaatgaggcacattatacatttcaacagctctactgaaattgagtaccagaatacagaacttaactcaaataatattatattgagtataagaataagaaaggtttttttttttggtttgtttcctacataattggggtgagtggataaaagtagtttaaacatcctaaggggtagacaagattaatttgatgttcgtgacacggcccaagtacctgtttatcttaaaagcgcatgatgtatgggaacagaatggaaaaataaggccaggtgagtaaaattgttcagagattttaaaaattaaaaaaagaaaaaagacattagtgaaggagtgcagtaaatagccaacagctgttttcattctcctgaaaagtagtgaagtagtgatggcaataattatgaagaaattgaatgccgagtaagagaatgcagtaatggatttagaacctattagaatgagccataggaaaaggtataaatgggttgtgatggaggccaaggacagagaattcatttggttaatgtcccagtatctataataatcagtgaaagaacaagaaaatcatattaagaaagcaaaagcagactgggcacagtggctcacatttgtcatcacagcactttgggaggctgaggcaggaggatcactcgaggccaggagtttgaggctgcagggagtggtgatcatgcactgcactccagcctgggcaacagagcaagaccttgtctttaaaaataaataaactaattaattaaattagataaaaaagcgaagacctgactcattcacattttcctccagaaatagaatctttctaacttcttgacagaaaggggatataataacctctttgactaaaggagacaaagacagaaaatgtgcaggccaggtatcattcacagaaagaaaggggaagtggaggatttttacattttaagacccaactggtattctgctattgctggtttactttgtggcccctttttgttatttcccttggcatgaaaagtatcatttgttatgtgatttgttaaaggtaactctaaattctgttatctgtactcctaacaaaataaagaattccatcatctggtatggatctgttaacgtttcttaaaaggaccgcaaatcaaagtgtatttcctatccccttttggaatttactggcctctgtctttgggcttagggagcgtaaaaggcagcgtggagcacatggctctagctccctccctgtggccagccttaaacagattactgctaagtcatctgaccactagggagttcagttcagaggacgagctaaagtagaaaaattatttgggaaagccatgaagtaaaattgcttggccatggtgcttattaaagatgacacttcacctgaatgagggaattagtagttaacaagaacaggactagaaaaggggtttattgaattacattgaatatttttaaaatctcatcacttctgctcttagtaggaacatgataaacagttctgacattttagaagagggtgagttgtattaacattgatggaacagttaaaagagagaagttgtagtacagcttacatatgtgcctatacatatagaaaatctcatagttctgcccttatcagatgcttgcagagtattctgcagacttccctccagctgtttgttaaatgaggttagtctgttcgctagttgaagagacttgtggaggaaatcatgtggcatgctttaacactctcagcagcctgtgacttctgttttgcctttgccattagcctctaaccttctcctcttctcctctttcttcatttaccattttgtgtttgtggcaagtattttaaatgtaccactaactaatgtctttgaaatgtggcattgcttattaacccagatgcccacgtgtgtcttaattcggagggatggtgccttggagaacctgtgccgcaaaagtttagtctcttccttgaatggatatgttggatattttattttgttcaaagttgagtcaaaatttttggaatcatctatatttctcccacaaacaggttttggccatcagtacttgaaaacagttctatggctggcatcctggatcaaggggcagtctgtttccagggaacctaaaatatttaacagtaaagatgatgctaaaaccaaagaaaagtaatttttcttatctgcatggccagtcactggctacgtgcctagttactcatgtcattcacagaagtgtactgtagcatgcagctgtgggctctcgggtagggggaatggagggtaggtttttttgtctgtttgggggtggctttttgacctttttaaaaacttgagttgaaaattattttttgcactgtatgtttaacaatgcccttgactaggcatctaagatattaaccagcttcagcagattatgcgtctgacaggaacaccccccgcttatctcattaacaggatgccaagccatgaggtgagaacaaagagactgtacagggatgtcgcactgagaagccacattctcattttattgccaccgtataaccaacagttcttaacatcactggatgcttgcatgtgccttgaggcctgcctatgtgctattgcaagatgttgacttttgggataaaatgtcatccagtcctgtgagattgggaatataattagtaagcttgtaaatggaaaattgttatttttatatttggttgtgtgaatttagtgcttgtgaggcggtttctttctaggtgctctgcctgtagctagggtgtgctactatcgtgacctttatcagaagggtagttaactgaagtccattagcatgctttccaattcatccatttttttaatgaccaaaagaggattctttatttaaaaacaaaactgaaatatccaatactaatatgtactatatttaaaagaaaatacacaaataatatagaataaatacaaacactttggtacagttaggtaccttctttattaattattaactacttagtctaactcttgttttattatcagagatgattggggcacttctttctttgtaagatacccttaatattttggggaaccaggttggcatcacagagggcccttcccagcagctttgtttctacttcagctatattcaggtcgtcttttgatttatctttattaaagggatgactgttctctgaatgagatagttctctcttacctgttttcccttcctctttttatttacatgttcaagtagaaagggattacagccatttatgtattcaattcctaaaactttcttttcaaatcagaaagattctcaattgcttttcaaagcagacctttcctcctgactccacatgcaataattaagaagcggaaggctgggtgtggtggcgtgcacctgcaacctcagcactttggaaggctgagatgggaggatcagttgagcccaggagtttgagaccatcctgggcaacacagcaatactgcagctctacaaaaaaatttaaaaattagggcatgatagcacatgcctgtagtcccagctacttgggaagctgaggcaggagggttgcttgagtcaggagttagaggccatagtgagctgtgattgtgccagtgacctccagcctaggcaacagagcagagactgtgtctctaaaaaaatttttttaataaataaagaaggtgaacttgcccaagcaaccagatttttttttttttaagacaggatcttaactctgtcaccccagctggagtgcagtggcacgatcttagctcactggaacctccacctcctgggctcaagcttcctgggctccatctccctgctcaagcgatcctgttacctcagtctcccaagtagctgggaccacaggcatgcgtcaccacacctggctaattttttgtatttttggagacaagttttcaccatgttacccaggctggtctcaaagtcctgggctcaagcgatctgcccaccttggcctcccaaagtgctgggattacaggcgtgagtcaccgtgcctgggcaaccagaactttttataaacttgtgtgtgtatgtgtaaacataaatatacatacatacttttactgttggactgtattaaaacaggagttttaaagaggtggttaagatagacagcagactttgcttctgaaggtgatagtgggatagcagataatgtttcttgaactgtcacttggaaccaagtactgtgttaagaaagtactaggtttgttatctctaatcttcactccaaccctgtgaggtaggactgttatattaagtttatattaacttttttgttaccaccgttactttgttagcaaggtttaatattgatatcctttgatgtactaagagcacctactgaagtcagcactgtcaaaagactgctggtccaagacttgctttgggaataccaacccctctaccaatttagctgtttgagaaggctgtctcagggctacttcttacatatcttggcctcagtttttaaacttctcatcctgtgatcagaaagctaatgaaagagaatttgattgatgagcattctcgttcacttgaaatgcaactgtgagagatagcaggaataaagaaggtgatgatcataactagggaagttaggatggcagtaagggagaagttctatcaaagacagttagaaacactgaagttagtggactttgtcagttaacactcgttccttagcaggaccaagattctttctttgagagcagtaacattattgaacaaagtcattctgaaaacccttgttttttcaggcaagaaactatattcagtctttgactcagatgccgaagatgaactttgcgaatgtatttattggtgccaatcccctgggtaagttgaccatatatcctcacctcatggatattgaattggttatgatataaattggggatttgaagaagagtttctccttttgaccaaataaagtaccattagttgaatcttggaaggtgataaatacggcttttattatctatttgtgttgtcagatttttttttaatcacatgagatgattgtatgtttaaatgatcacagaacttgggattgggggaatgggcaggtacagtggagaaaggagagaaagtaatgggaatgttgagagaaaagattggtgaggcaggaagaagcagatacagaagaaagctgtaacttgctcacaactgctgtggatttatggtgtctctgagtggaggacagaaaccactgaagtgcaggtgggtgtttagaggagccacccaggagctccctgcagggtgctctgctctaacggtagctgccgttgctacagatcctgtcgtcttccacactcatgaacttttcccctctcctcttctttctctgccctcagaggcataaccgtcctctcctgtttgtggagcttatttgctacctaaacttaaaggaatggcttcctatgccttcaagatccttggcagagggaagtgatggtggcagctgaagatatgtgttgccttggctaaaaaaggagttgctttattattattatttatttatttatttatttatttattttggtagtgtcagggtctcgctcttttacccaggctagagtacagtggcacaatcatagctcactgcaagcttgaactcctgggctccagtgatcctcctgcctcagccttccaaatagctaggactacaggcatgcatccccaagcctggctaattttttaaagaattctttgtagagacagggtctcaccatcttactaatcgtggactcctggactcatgcagtctgcccacttcaacttccaaaagtgctgggattcagacgtgagacactgtgcctggcggactatattctttgaaggggaggagtgatgtgtgcttcagatggcccctgaaagctgctttgcctgaggctcattccctgactcttgaagaggacagtggacagtgctgtttaatggtggacacagaaggatcagaccaggacctccctacaatagggaagggagctatgctatggtaacgagtataatctgccttctcacttttcttaagattgtattgtgtggtgtgttttaaaatctcactgcatttctttgcatctgtttgggtcatctgtcttcttaagggtcttggcagctatgcttcaggtttagttttatctttttgagggctgacagccatgctgacctctttagaagctggggtgaaggctaggtgattttacctttttaagtacttcatccatagtgattatggagaggaattttagtgtcgctgtgataattcttataatagcagagatactcacgctctttgaagttttgggcagttgtggatgagttcgtgtcagccttggagacagagagtatgtcatatctcagctgggtcgctctcctgccctaggatgaatccacagtctcatcaggggtgggtacgattctactgagactggcttaggtttgcatctgccctggcatgctctcattggctttgtgtgatttatttgagctgtattatctagttcaagggtctgtgagaagctctctttgagccttaagtactacaggatgttgggaaaagatgttgtgttctttctttccttttttttttgagacagagtctcgctctgtcgtccaggttggagtgcagtggtgcgatctcggctcattgcaagctccacctcccggctttaagtgattcttctgcctcagcctcctgagtagctgggaatacaagtgtgtgccaccacacctggctaattttttgtatctttagtaaagacggggtttcaccgtgttagccaggatggtctcgatctcctgacctcgtgacctgcccgcctcggcctcccaaagtgctgggattacaggcatgagccactgcacccagcccgtcgtgttctttcttgtcgtcattctgttctgaagttgtttcattttataagccttaagttttgaacagggcagtactcactgacaccctcttaacagactcagaaagatgtgttaattcattttttagggggagaggggagatatttgtgttccagcagcttatttaggtcacatacctcctgataggtcttcccattctttgaaatcatgacattgaaacctccaaaagaactagataccactttgctaatgagttgaaaggaggctttggtccatctggtgctcagcactgtacttctcagcatttaaacgtgccttacagcccattgccaaacagtgatgtcatataatgaggctccccttgctgggcagatggagcacagtgttactatcacaagctcgtgcccagcatattaactgagcaggaacatgccagaaatataaatattaacagctctgttttgtcagccactgactttgtttcactgctattcccaaaacatgaattaaaacttaaattaccccttgatgttagtgtatgtatttatctgtcaagattttttttttttaagagatggcatctcactctgtcacccaggttagagtacagtggcacagtcacggttcatgataacctcgaactcttgtgtttaagtgatccttcctcttccctatcccaagtagctgagacaacaggcacataatgccatgcccagctaataagatctttgaggaatttgttcttgcccctgaccttattggttataagaacatggtcctttttaccctaagggtaacagagacttgtcgtataatctgtgttcaattataaaatcaacagctgataaggtttctttttctaagaagagaagaccatcagaagaatatatatatatataatccaggcattcacctagtactgtaaagtgtaaacttatgaacttgaattgacacatgaatatttactttgtttctgtatccccttgaagcccatatttctccagtggattactctggaattcaagctgtaggacgggtgttttacagcctccaatatacacagcagtagatctctataggaagctgtcctcttcactactcacccccacaccctccacatttaaggagtaatttgcaaagtctcaaaagcctttttcaccacagtgataactggttatatggcagtatttattctcccaagtgccaccatgctgaaacacaaaaatactcatttgaaatatagagttagacaaattaccattttgtaaccccttatgaaataattgcttttgggaaggaaacccagtgaatgcagaaagccataagtgaaaagaatggatatttacttggtaccaaaatatcccgcagattacttgctttggtcaaaggggaaacatcttaacccagtgatcaattttagctcattagtagtgggacagatggccttaatgcactgtcacgtgcacagcatcacctgtatttttgctgaaaatgtttaacctgattcttaccaaaatttttgacctaacttccggtttttgggaagtacaggggatagtggaaagcagggtatagacacatgacagcaaaagaagcaaaatcagacacatcccgagaaacggtcattctcaggacaatcagagggtctctttagatcaaaatcaggaaagaacagggcttagaagtaagaagattattctagactaagagagactaaagaaaaccagtcagttgcagtgcatggcccctaattgaatcctggtttcaacaaactagttctaaaagacaacgttggaataattggagaaatcttaacatgaactggattttagatgatatttagaaattatttgtcagagataataacagtattatgattatataggaagatgtcttcgtgttgaaatatttggggagggtaaagtgtcatgtctataattttattttaaaacagttcagaaaaaaatacatataaatacagaaatataaaaatgttaattgttgaatatgctaggcatatgagtgttcactttatcatagtttttacttttctgtttctgtatatttgaaatttttcatagtgaaatttttaaaaataaaattccctttgattttaataccatgtctcaccctcatcaccatgtaaaacccccagtttattcactgtttgaagatctgttgatgaatatttgatgttagtaaataaacagcttagggggacaaaaaaaaaacagccctgcctacctattgtaggttacttcagctgtaggctttgttttatacagtttgactacactggtagcagtttgacattgacggtccacaaaagcctgttcaaacagaatcccagtcatttaaaaaaattcttctttagtaacatattctttaaaaatacaaaatacaggaggagggtgagggttgagagataacctatcgggtacaatgttcactatttggttaatgggcacgctagaagcccagtccccatcagtccgtggtgagacccatgtaacaaatgtgcacatgtacccccaaatcaaaaataaaataaaaaaattttaaaacatagaaaatacagatacacacacacacacacacacacatacacacataaaggagaagagggctaatatatcctagagtaggtattttggaggagagttctttgtttggatatgaagggtcaaaactatgtttgctcaataaggcatacttttttgtaacatgttaaaaactcttttccttcctgtctatggtactgatagctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagtaagtcctaagggtaggattaacatcttgaaccactaaccaaaagcggtgggaaaaataaaaactgaatggtcataaccaacttgctaaagcttgtagatgaggtctctaatgcagaatgaatatgttctctggtggaaactgttgtagacagtgatactctctggacctttgagatacttatgtctggtctgattttatgcacagcccctcacataggagttttgcatggagagttgaggttttcagagtcattgcatttacaacatctctctgagcttttacagttttacaattagtagaactggggcaaagagaatttatgtcttatcagttaacttagaactagttagggacatagccaggaatggaacccatgtatcctgtgtccagtcccatattctttccacaaaacacaagttcagaactctagttaaatcccaagagccaagaccatctgttgctgtagcttgtgagagtgctctttcattcttgagcacctccgtagagagcttaaaagaagaggcactcagcgatgaaaaacatgagaaaaaaaatggttcttttctatgtcccttgaacttctgtgtgataacgtgttccagtaggctattacatacaagctgtgaggtagcccatcaaaccactacctggacagagaggaaggatcttgagcttagaagtcagagtgcttgccagcaaagagaatagcctaaactctcacatcttacttttccttcccaatttctaggcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgagggccaaatctggcccaccacctgtttggtgtagcctgctaagaatggcttttacatttttaaatggttgggaaagaaaaaaaaagaagtagtagattttgtagcatgtgatgtaagtaatgtaaaacttaaattccagtatccataaataaagttttatgagaacagagccgcactcatctgtttatgtattgtctgtggctgcttttgtgctacagtgacagaggcaaatagttgcagcagagactataggacctccaaaatgtcaaccatttaccatctggccctttagagaagtctgctgacccttggcccagggctacagttttctcatctataaagtgaagttcaggtttttttcatctttgacatttgagactatctataagccatatatttttattataaaactgccagagagaaggtttggtttgtatatataggtgtacattgtttgtaagcttttaggcgaatgtattttatgactctgttttgtcttagctggctacggtccttgaaaatattcttcagaatgactgaattgcatcacgggatgaaagagccacggggtctcacagctgagttctcagggactttgctgatgtgcttcctttcttggtgtccttggaatgacacccagcaggtgtcccagggtggattgtggggctcagcctgtgaggatattgagagctgggtttttgtccaggccctggctggcagctgggaatgaaggcagtgatcgaaggcagaccaagcatagtctcctttccatccccagtgacttcgtaaggaggtgagagaaaagggccccggttgttacatggggtcctttagctcctgttaagaatcagacagttggccgggcgtggtggctcacgcctgtaatctcagcactttgggaggctgaggcgggcagatcacgaggtcaggagatcgagaccatcctggctaacacggtgaaaccccgtctctactaaaaatacaaaaaattagctgggcgtggtggtgcatgcctgtaatcccagctattcaggaggctgaggcgggagaatggtatgaaccagggaggcggaacttgcagtgagccaagatcatgccactgcactccagcctgggtgacagagtgagactccgtctcaaaaaaaaaaaaagaatcagaccgttgtagggagtattttgccttcacataccagacatgagacatgagaacagccttcctcctaggcttctgagaagagggcctgcttagcccaaagagagctgacaccacaaaaagctcccctgaagtgaatccacttaaaacggggaccaaaatttcatatgtggtggacactgggggataggggaaacctgaatggaactttaatcatgaaaatggaacaaaatgacaaaagcatgttcataattttaaagatatattaattctgacaaggaaattaagttgtttttgaagtgaaactgattttgtatcttacaataattttctcatttgatttttgcaacgtgatcatagaaggaagttttgcaaaaatatttgagggcttcatcagttttcagaaggcctcttgatattttgatattcacattcttttttataagtatctatcggtgatcacctcctcaactttccttttattgttaactggtctgagtctgtcacccacacttttcagagcttttgcttaaggtttgagcagttttctagcattatttatcaacttcatcaaatccaccaccatttgcaagatttgtgattattgcaattaagttgcattctatttgtgtcatttgtcatatgcttacagtataaccatagagactaacagaagaccagaatacagtgggcaggataaatacattggcttcaggtacttaagaagcaaagagggactaactttttataaatagctcattagtgaatgttttcacattgggatgactttcacttctctatataatttggtagctgcaaggacttggttaatgaatatgcaaataataaagacccccttttatttataatgcagatatgttttaataatgtacatgccctttgaacttagcatttacacttctcagaagtcttcagcctgagcaacatagctggggactcttgactctacattagccaggtgtggtggtgcatgccttgtagtcccagctgcttgggaggctgaggtgggaggatctcttgagcccaggagttcaaggctgcagtgagtcatggttgtgccactgcattccagcctgggtgacatagtgagaccctgtctcataaaaaaaaaaaaaaaaaaaaaaaaaggtcttaagtgcacaaagtagaatgtttttcagtgtcacattctttgtacagcaaaatactggaagtaacccacatatctatgaataaggacttgattgaataagatggtcatctgtgcagtggaataccatccagctaggcatggatagatgtgcaacatacattgtgaaggagaaaaagtcagtggcaaactgtagtatcctagcccccttttttgttgataggtaatgcctggctaggaaatgaatatacattgaactgttagcaaccatctctaggcagtgggattgtgccctttaatttttatgctatttctgtaatgtgtacctttttttacactgagagttttgttttgtgatcagaagaaaccttttctttctttgttttgttttttaatgagaaaggtgtttaaaagtctatgtgacctggggaaccattctcaaatttcagttttgccagggctagagcccagcctttcaaggcaggagaacagttgctggaaagaaattgcacccagctgttaggcctctggcaagcaaagccgcaccagtactttgtagcggcattctccacccagctgggagggtttggttgtttcttcttcagtagaagggtgtattttaaggatcttaagcaggatttttcaattttggcactattggcatctcagaccagataattatttgttgtggaagctgtcctgtgcagtgtagggtgttaggcagcatccctggcctctacccactaatgccagtagcactcatgctcccttcccccagttgggatagccagagatgtctccagatgttgttgccaaatggcttctggggaacaaaatcatccctggttgaaaaccatgaatctaacacttcatccctcctaatcttgcagaacaccaaagcctcttttcttgaaaaaagagttaacacccactggcctgttgtaacttaaagaagtagtttggtggccgggcacggtggctcatgcctgtaatcccagcactttgggaggccgaggtgggcggatcacctgaggtcaggagttcaaaaccagcctggccaacatggcaaaaccctgtctctactaaaaatacaaaaaattagccgggcttggtggtgggcacctgtaatcccagctacttgggaggctgaggcaggagaatcgcttgaacctgggaggcggaggttgcagtgagccaagatgacaccgcagcactccagcctgggcaacaagagtggaactctgtttaaaaaaaaaaaaaaaaagtagcttggcatcttggaggaaaagtacaaattggaaaggcctttttagactcaaatacatatttttaggggaaatatgtttggtactgaataaaggtcatttcatttcttaaaaaaaaacagtaggttgagtaaattaagttatcctttgttcagaagttctttgccattatccacaggcagaaaatctggtaattaaactgggggtatgactacaagattttcttagaccagtaaggaaataacaaatctcaatgtgcctggtgtgttgtcgacactcaagatactggttagtctgcatctcacgagttgacagggggcatcgaggctgtcttgttagggggagtttgcagccttctgcatctgggaacagtgtgtgtctctaaagccaactggggagagagcttctgaggacaaatggtcctgaggcagtttctggaaaacccattattgaagccataggctgtggtctaagtacgcatagccagtgggataatgttatattgcagagttatttgagtagttcaatttaaggaaggtgctttgtttagaagttattataagttaaataaggaagtaaccttcagtttgcaactaaaaatagaaactgccaccaccatttgagtgtcagttgcagcagaaaagaagaaggtgtaaaaccacagacccagcctagattcttaacaaaaaccagtggttctaaactcttgtcagatctattaccctttgcataactaatattttataatacctcttttataatgctgaggtgaaattcatagataattcacacaatttcaaagaaaatataatgatccaatataaatgacaaaggaaaaatacgaatacatttccatatataagtgctggctgggcatggtggctcgcacctgtaatcccggcactttgggaggctgaggcgggcagaacacttgaggtcaggagtttaggatgagcctggccaacatggagaaacccgtctctacagaaaatttttaaaacgttaactggggcggggcgcagtggcttacacctgtaatcacagcactttgggaggctgaggcaagtggatcactcgccatcctggccaacatggtgaaaccccatctctactaaaaatacgaaattagtacaagatagaaaaattagtcagctgtggtggcacccacctgggtcccagctactcaggaggctgaggcgggaaaattgcttgaacctgggaggtggatcttgcagtaagctgagatcatgccactgcactccagcctgggcaacagagggagactccgtctcaaaaaaaaaaaaaaaaatgaaaaaataaaaagttatctgggcatggtggcacacacctgtagtcccagctactgaggaggctgaggcaggaagattgcttaagccatggaggttgaggctgcagtgagccatgatcattccactgcactccagcctgggtgacagagtgagaccctgtctaaaaaaaaataaaaagtaaattctcaggcatagctacataaaagaaataatgaagtagttagatgcttgtacctatacatagaatcaccttgaatatgacagctccaaatgcgtactgatacagttgtgttgtcttgacaactcagataccatggctgactgctgtcagtcatgatttttctgaaagtggtaagcaactcttggtaaaaatttcaaacaaacaattagaatctttttttttttttggacagggtctcagtctgttgcccagcctggagaacttttttatttactcagttgtgatcctgggaaatgtaagtatattaatatgcagaaaagtatttgtttgatatgtaaaaccaagttacagtctaggctcagataatcataaatagttttttccaccttcatgaatgtccagcaggatgtttgtaatgtgaagcaattcttgttaagaatcccactctgcacagtggcccgtgcatgctcatatcagtaatactcctgatcagtatgataaccaaaaatggccccagagatttcagtgcacccgctgagaactgctgacagatcaaatgactctgggacacctggagtcctaagaagtgaaacctccacaatgcaggacagacctggctccctatggtcttccttccttccttcacctccttccccctactttccttacctccctactaaaaagtagttcttttaatgaactgctactgtatgttaggcaatttacattcttgcatattctatacaagtaatgtctctttctcagtcacgttacaactgaggctagattcaacagactatcctgatatcaacgttgaaagactcctggttccaaagagttttatagcattggtgttagacaatcctcttttggtttttttaaagaaaatttaaaaaaattaattcagcataatttccataaggactccctggctgctgctggccaaattggggaggagtccctggcagccacagccaggcactggtgccttatcttgttcagcacacactgggtctctctccctagttccaggccccttgccctcgcttctctactcatctgggatagaaatgcacctccaggcctctgaagagaaactaccttttccctctttcagccaaaagggctcaagccagcactcgctttgtatgtcctagaagatgagcatgcttccctctggctctctatagcagtgctctaatgggacaaagtcactgtgtgctcttgctttctctcctggtctttgtgcgtgatagtccctctctctagaaccctcttcctcctcctcattcctctgagctaatgtattcgttcttctgttcagccttgacatcactccctcagtaaatttctgaccattcccaagcctggattagctgtgtcttctgcatgcaccctgtaatctggaatgatcattggtggcactgattacactgctttatcattgcttgctgtttgtaccacctgctcaaaaaagaaaaacatataaaggttaaggatacaggctctggaacctttgatgtgattaagtaatttgctcaagattgtaccaataatagagagtggggctgtgaggactaaatgagttaagacatgaaaaaccctgagtatacagtaaatgctaaatactggcttaaggctgcatgtcatcgaagacagatcatgtcttgttcactgtggtgtccctgtcacctagcttggtacctggcacacagtaggcattcagtccttattgaccgagtccataaatgactgtcagcttttaatcccttgcagatcaccttgtcttttgcttcctgtttttacaatcaatagtctttagaagcaaagatcatttaaagaaaaaccaaatatgtaggggttatctgccttgcctaagaaatggtgctgtgtggaatttccttgtttaagaagagatacgtgttagaagaattggcttctgattctctttgctgtgtcttgctgtgtaattcaagttggctgcacagcaatttaatgaattagaacaagaaccaaaagattattgaaagtggctgatggccataatctagataattcctactgtgtccccatccatctgccactttaaaatgaaaatagcaaggcaaaagaaagataattggaaggcattatggtgtcttgcaccctcattcagccattctacaaatatctattaggtaccttccatctgtcaggcactgggaatatgggaaagaataaaagtcaaattcctgtccccatggagttgttcgttgttttcatgggaaaaggcagtggtaaacaatgactgtaccatctcgctggcacccctagaacagaacatctaagcacctgttgctggaggccatttctgggccggtgcacctttgatccacctccctggcactcaactgacagacaacaggatttctcgtggcgtccagggctgcatgtcctcttgggttacctcgacctgatcagctggctccactgtgtgtttccagtgtgaggtgtgaggtcaccatccgctgccattacacaaagacccatttcccctgggccattgctcaagtatgacagagctgattgtcctgtatggaaactcagccactcacagctctgcccagtgagacaggcaatgactatctgatcatggttgctgacacagtgcttgtggtggggagtgtccctatctggaggcaaacagccgagtggctgctgtgccctcaacaagccccaccctgcttcacggtgaggaaacagcccccacccaaccagtcctctccccagcctccagttgagtcaggtgcccccctccaagtgtttatgtaatttgtgctgatcttaccagggtcaaagcacttaccacattactttgtctaactattattctttcatgacacaaaacatatttattgttgaaaatgtttaaatgtagtaggtaacatctattatcccactacctggaaataatagctgttgacagattggcataactccaagaaatttttttaaatctggaaaacatcgcttttaaaactcattattattcagtgatctgtgtcaataaatggcattgaaacagctagatagacactttcctccttcagccacaatcatttccagacaggtcaaagatttaaatggagaaaggctttcaaagcatgtccccaaacctagaaaccatgcaggaaaaggcaaatgaatttgcccgtgcaaaaactgtagagctttcatacattggcgtccatttggcaggattcagtaagggcagaagctgtacatagctgcggttctaggtaattctagaactttctagaagctttctcgtatgtcaacaaggaacagagtacagacttttcactcaacatcatttgtaatagcaggaaaaaatgggaacaaacctcaaacaccatcaataggggaataggaaataaactgcagtatgtattcatgcaatgaaatattaaatggcagtgaagacaaatgaactagaatgattcccccaccaccaccccagacccctgattttgcctctgtcccaggaacaataggcaatgtctggagacctttttagttgtcacacttggaggtgagggtggtgagcatctagtgggtagaggccagggatgctgctgaacattttgcgacgcacaggacggcccccacaacgaggaattacccagcagaaacatgtcagcagtgccgaggctgagaaacagagacgactcaacatcttggcagatctcaccaacaaccttaagtgaaaaaggaggctgcaaaacgatctatctggcatcgtttacagatgcatacgtatatagtaaaactaaaagcagacgagaataataaacaccaacttgtagaggggtcacctctagggagggagagagggcatggaatcagagaggggcatgaaagggcttcagctgccaagagccagacagcttaggttctaatcccggttccaccactgacactgtgtaacctccgcaggttgcttgatcaatcggggcctcagttatcacaactgtaaaatgggatgatattgataatagtgccttcttcacaggattgtggtgagggttaaatacgttaaccaatgtagagcacttagaacagtgtgtggctcatagtaagaactatatgtttttgtcaccgttttcatcatgatgatgagtatctatgatgttctatttttaaaatatcagaagtgaatatggcatgtgtgtgaaacatctcagcgttctgccttgacaaggaccttcactcctcctcccacccccaccagccaagtgaatttcaccctcagcacttagtctatatttgttaaggctggccatccggaacatactctccaaatctgagacaattcatccaagcagtgtgtttccttttcctcttcccccaccaccaccgccaccccccaccatgatgctggaaacttttctttattgatacagatgatgagcaatgcggtgataagtgtgtatcccccggctgttttcgcgttttcactaaattgatggctatgggattaccggattaacaaggtgcacattttgacactttggcagcattgccaaatggttctaaaagcttgccccagttgacactcccacctgccgacgacagtgttgtcactgtttcctgttgccgccctcactagggtaggagcttctcaagcacaggaactgtgacatttgtccgtgtattctcaatgtcttgagaggtgcctggcaaaatttggttgaatggattaaggctttaccttaatcaccaggtaggtaaggaggatagagaaaaataagacactcgtgccctcaagaacttacaatttaggtttgtttgaaagttaactgagaattccaagtctaagggtgctggtgagagtggcctggcaaagccagcccaggaagagctgctgagcaggttgtaaggaacgaggatgccccaccccccctccttggcaaagcagaggatggtattccagacaggtcacaaacagctcaagcaaagacgtggtgacagggatgaggaaggcacgcttgcggatcgctagaatggaggttgcctgggcacagacaccttggaggatccgattagcaagaaaggcagggcctgtccggatgggggcaagccttgcccaacagactaagaagtttaatctttatcctagaggccactgagagctaccgggggtggggcgttatggggaggcagggctgctctgaaacaggaagattaatcacagctgggctgcctgccgctggctgcctgtcacatgggagctgtgctgccctcaagctgcccagctggagcaccctctttccaggtgaccaaagctggatccgggtgccccctggcttaggaagggcagccctgggcaagtgtgagggagtgaagaccaggcctgagaagcagggagaagctgtttgtcagggaagtgtagtcaccaggatcagggtggcttcccctccacagccccttactcatccctgttgccacacctgtgctcgggctgacagtgacagtggtgtcctggagctctctgtgactcttatttttttagagacagggtcttgcaatgttctttctacttaattttatttcttacaaaagattggcctttcacaagcatcatccagcgcagctaagcatagtggttactagcactgaccctgggcaagactacctggtcttcactcccagctctagtgcttactagctgtgtgtccttgggcaagtcacttcacctctctgtgtctcattgttatacataaaatgggggatactgttaacccatctcatagagtcctcaggaggattaagttacatgtatgtaaagctcttataacaacttttgggaagtaattagtgctctttccatgtttattaaatgcatataatagaaaatgaatgtatccagagaggcagtctgacttacctaaggtcacacagcaaattagagacagagctagaatcagagcccaaacctctgccatggcaggtagccctgctagtcttgtttggggttatttgcccctgaccaaggtccatagggcttctggggaggatctatgtgtcctgacattggatagtttacttagaaggggtggagcaaggagaccctgtggcctctgccctggacaggcaggttgtggaggtggcctccagggtgcacagcttctcctgcctgaggcaggctgcacacaggagtccaggcaggacctgactccattactgcggtttgtcaggtcagcacagcagagactgccccaggcacgaaggtgagttgggcctgcatatcagctgcacacagacagagatgcagcgataacaaggctgctggggataaggccctgctacatccctgccattcggccagtcaccggctgccaggcactcttccaggtacgtggaattcagtgatgaacaaaatagacaaagcccctaccctcgccaacctcaagacattctattagaggggggcagacaataaacaggtacacagggcttgaagaacacgaggccaggtaaggcaggtgagcatggcttgtaatgaggtcagggggacctcggaggaggtgacacatgagcagtcctgaaggaccagagggagcaccatgcacaatgcctgcaacctggcatgtgttgcttcagtaaaccctcctggtgtccctggctatgcaagtgacattctcccatcttactgatgaggaagctccacctgtagctacaaatggaggcacgagattcagactcagccctgtctcccagaactcagctacctctctactggctcacaggagtacaagcacgcttcaagaatgtggacgtcacaaagcctgtggagggggaagcgggtggtgtgcagtgggggtcttggggagagggatatgcacagggttagtggggtgagtggatctagagttcactcgggaacacctccttgtagatgtgagtttagagttaggcttggaaagaaggaagggagggagagagggagggagggaaggaaagaggaaggaaggaaaggtggacaattccatagggagaggatctggctcatgcagagcttcagtgggagtggtgaggagggctgtccacagggaggaacctgctttggagtggatggtgcaaattcgtggcaagagaagaggcctcagattcaggttgtacactctggttctttcaccaccatacgaaggtccagcctcatgctaggaccttgggggccccacaaggatgaggcctctaggccttccctcagggagcaagggaagaacagcaaaatcagaaacatcctaggacagattgtatcagactgaacagtgaccacacatcccagatcccaccctgtggtaggctagccaagcatattcccctactattgcttactcggtcccaccatttgggtcttcaagccacatcttcctcctatgggtagtacccagaagagacacaaaactccttggttggttcagtcactaagtctttactgagcagctacaatgggccaggcacagtgccagggggctcagcagtggccagaatactgccctcgcccttacagagtcattgtccagaggtggagagggacatgtcacaggagacaatgcagattaatattatgctgaatgctaccaaggacaaggccgagatcaaacagagcggaggcctgggcaccagaccttaccccagccacatctttgtagggtggagtggagggtgacatgtgggctgggtgcagggaggcaggccttaggggtggagtggaacggggagtgtggaccggatggtgtggggagggaggtgtgaagaggggaagcctgtcatcccgaacccagaaggctggctgagaggtgcccgactcacagagctgtccccacccccgtcttccaccagggggtgctaaagctgaaggaggggagagaggaggaggtggaggaggtgcaggggagtgggggagggtgccttttctttcttgtctctctttctctctctctctctcctccctccctccctccctccctccctccctcccttccttccttccttccttccttcctgccttcctttcgttctttttgaaatgcagtttcactcttgttgcccaggctggggtgcagtggcacgatctcggctcactgcaacctctgcgtcctgggttcaagtgattctcctgcttcagcctcccaagtagctgggattacaagcaagcaccaccatgcccggctaatttttgtatttttagtagagatagggtttcaccttgttggccaggcaggtctcgaactcctgacctcaggtgatctgcctgcctcggcctcccaaagtgttgggattacaagcatgagccaccgcacctggctgatggtgccttatcttttgctgctgggatggatgttctgcttgagccctaagtctgctgaccagcccttgcccctgagaaggggaagaggtaatggggagacaaggttggggagatggccttgcaggaggagcccagcaccccatcaagtttccagaggctggctaggctcggtggctcatgcctgtaatcctagcactttgggaggccgaggcgggcggatcacctgagttcaggagttcgagaccagcctggccaacatggtgaaaccctgtctctactaaaaatacaaaaattagctggccatgcctataatcccagctgctcaggaggctgaggcaggagaattgcttgaacctgggaggcggaggttgcagtgagccgagatcgcgccattgcactccagcctgagtgacagagcaagactgtctcaaaaaaaaaaaaaaaagtttccggaggtcagtaaggtgtcccaggtgctctaagctgttcccctgagggacttaccagaggctgctggagtagggaagtaatgggcacaggaggaatgaggctgggtgcctggtctgcagggtcaagtgtcccctgaggggtttgggaggcaggcacctgctctttccccagatgtccgctgggctcactcccagacccactcaagggttgctcaaatgttgcctccgtagagagaccttccctgatcaaatagtactcactagtcctttagatccttactctgccttattttcttcatagcacttaataccacctgccactacatttagttgaaccatagagaagtattaaataccagcattttaaattacttgtttattgagacaaggtctcgctctgttgcccaggctgaagtgcagctcagtgcagcctcgacctcccaggctcaagtaatcctcccaccccagcctcctgagtagctgggaccacaggcgtgtgccaccatgcttggctaatttttattattattgttagtagaaacagggtttcaccatgttgtccaggctggtctcaaactcctgggttcaagtgatcctcccaccccagcctcccaaagtgctgggatacagccatgagctaccacgcccagccaacaaataaatgttgaatgaatgggtcaatgaatccttgggctgagtatctggcaaaaaacttaatagaggagttggacgtgagttggagccgactctcactgaggggacaccttctggggcagggactggacagccaaagggcaggggctggggttgggcagctggagtacccgggcagagctgacacagtccattggggaaggagcctctggcgagacctactgtgtgccaggcactgaattggacacttttctagtcatctcgtttagtcttcacaacagccctgtaacatgggtcttatcacccactctcgttttacaaatgagaaaacaggcttagaggagccaactaacttgtctaagatcacacagcttaccacgccacagagcagcccacatctgcagtctttcttctgcatctccctgcctccttgtaattttgcttgtttcatggagtcttgaaagccccagaagagcatgggactctctagagctggggccagagctctagggctccctggcctgtcccaccctcacaggaccccagatgtgtcatgctttctcatttctgtggaggtctcatggtgaggatgttcctgctggcccatcctcattatggtgaggaggttcatgctggtcctgccatatgggacagacagggtggctgctgtgctcgtggggcaagatagggtctgggtggccaggataggggacatgacagtctcatagttatgtggggcttttgtctcgatctctaagaaaccagtcaccaattcccacaccatgtctctgcctccagaggctcacaggctagctaggaagacaatgcaacaacagcagccacttctcaggcacttgctgggcaccaggaattctagttgacagttaaatgtgcagacttaggagccagatgccaggtatgaagatcatgttcaccactttcttagttatgtgcgaccttgggcaaattacataacctctccgggcctcagtctctccatctgtaccaggggaataattatattggaatagactagaccaaagcagccctgacatctgggagctgcctggtcctatcagccaggacttggttgctcagagctgtccagcctggtgcaattcggtcttgctgtgctgaacatagacgatttcacagacatcagcatagaacaaggccatccgcgaccagggcagactaagacaaaaatgaaactactccttaatcatatctgaacacagacaaaacatgaatattgtcaaatcacagaaatgacccaaatccccctgtagagctaagctgagtggaggctgctggtttaccagctgtagcttcagccttgctctagtctgctttccttctaggcaagatgtattaagactcccaatcatagtgttagctccacttcctgacagcatcaacccagaacaaagcctcacttccttaacctctccccaatcacctaacacaactccaaacattagactaagtcctttctaacgcccccttcctgggacgccccatgatccccatggtgcatgctctcccttgttgcaacgagtcatcagctcagcttgttcacccacacgtgtgtttctggtgatctctggttggaggcattgaaagttcctacctcattgggttgtcgtgaggaatatgtacttgaaatgatacaatcctaaggctctttcaatatgcttgtcatactttattattatccccatttcacaaggaggacactgaagctcagagagagggccagactttgcccaaggtcacacagctggtaatgacagagaaaggatgtaaattcaggcctcattccaaagctagtttcctgaatccctgcctccatgctccatgctcatagggcagaaaccaacaagacaacttgggttggtgtttggagaggagaagagcaaagggcccttggaactcaaaagagagcctcaggctggagaagcagggtatccaggatgacctgagtgaccctctcctcctcccctccctttcatgactccccaactggatcctccaagggctccctcccagactgcctggctgctgagtaatgcagagccagtcaggcccagagtaggggtcagtgtcagcagagtcggaggcctgagtcacttcctgacccttgctcaagagcatccggagctacagccagagtggccactcgtgctctcagaagatcgcacccacttgggcgatgagcatgtccttggtatccccaccttcctgggctcacctctgccccactcaggtgtttaagacgtgcagcagagaggcgccatcctgacctggtgccacatcctagcccctttccttactggatcctcaaaccagaagaaaacctgaatctctgaggtcagttactctcttttgcctgcgtctagcctaaaatctggcttccaggaccccaccccaacttcagaatcaaggtaccttgcactggtgccactgatcccaaaggtccaaaactcctgcagcactcacaggcaagcgaccccgttccttaggctctcatggggtctcagggccagagtagggggtgggggagggaaaaggctggggaaaatatcagataccccagggcaggatggactgagggagacatggttggatcagtagacatgtccttatgatgtgggcaaggccatttcctttgaggagcaattctgtcaactctaggccaccgcatagcctcgcagccaagagcagggactctagaatcaggctgtacttgctttcacccagctctgcccttaccagctgtgttaccttgggcaaattacttagcctctctgtacctcgggttcctcatctctaaaatgaggataatcatattactgactcacaggcctcttaccaggattaagtgagttatataaaacacttaatgacgggcacatggcaaacacaagtgtgtattaaatgactcttttacatctaatgggctgactcctccattcattctccacacatttgctgttatattgccatgtgccagaaatgaaaaagacagattgcctgactgaaataatggcaggtgttgttgtgtgatgatggcaccccaccctcatctcagaatgatcttccaggctgtgcctgaggctgcaggactgcccgggagggcttggggcacagagtttgggggctgcagactccctagtgtgggcccccggcttgctgtaagcccctagcaaatttctttccttgttcaatagaccttctttttgacaaagtgaagcaggtggtccccgccccttccacagccccatgcctgggcaagagaggggttggacaagtcaggctgggcatccagagcccttgcagccatctcctccccccacctgcccaccttgctcctcagaggcctttgtggtttgagcaaagaatctccatcaggctgcacaggccaccagacaggtggcaagggccccaattagtcattgtcctcatagagccttaggaagtccacagaaactgtgttcaaaactgcacatttgggccaggtgcggtggctcacttctgtaatccaaacactttgggaggctgaggtgggcggaccacctgaggtcaggagttgaagaccagcctggccaacatggtgaaaccccgtctctactaaaaatacaaaaattagctaggagtggtggtgtgcacctgtagtcccagctactcaggaggctgaggcaagagaattgcttgaacctgggaggcggaggttgcagtgagctgagatggcgccactgcactccagcctaggcaatagagtgagactccatgtcaaaaacaaacaaaaatcctgcacatttgaacctgcgtggatatttggtattatagaattagtgctattaattttaggtttaagaatgtattgtgggccaggcgcggtggctcacgcctgtaatcccaacactttcggaggccgaggcgggtggttcacgaggtcaggagttcaagaccagcctggccaagatggtgaaaccccatctctattaaaaatacaaaaattagccgggtttggtggcaggcacctacaatcctagctaatcgggaggcggaggcagagaattgcttgaacccgggaggcggaggttgcagtgagccgagatggcaactgcactccgacagagtctcaaaaaatatatatatatagtattgtggatacgtacttttaaaaatccttacgttttagagatacaaaaatatttatgaataaaatgatatgacgcctgggttttgcttcaaaacgatggtgggagaggaatgtggatgaaataaaattgattatgagttgtggttgctggggaattggggtcacgggggttcattagaacctcctatcagatgtggttcagaagcctcagacctgggagctggctagaaatgcagaatctcggctccaccccaaacctactgagtcaggatctgtattttaatcaaataaaatgcccaggggattcctgagcacactgaagtgtgagaagcgctggcttactctgttcaattctttcctgcatgtttgacattttccataatgaagaggttgtggggttttgttctgctttcctgtgtgttcacagtcacagggagctcttcctacggagaccggggctggagggaactgggaagcactgcctccccgctcctgcttggacccaccagccccgccgctggcccgcgctcggctgggaggcaccggggtcccgctgggcagccccgaccccgtgcctgggccgcacctgccgcagtggctccgtcgggccgggcggaagcgcgggagcgcagggctggacaggcccgggcgtggcggccccggcgcacctgggcgagccggcaggtgggagcgtagcagcccggggcccccgccctcgcgcgggggaggagcgggcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtggtgagacccctgggccgctggggggcggggggcgggcgccaggctctcccctttccgcccagcccgccctgggctggcccctcgccagcgccaccttgaccgcggacctcaaggcccagcgccctccccggggccacccagcggccatctcccttttctcaccgagtggctgagtgaggtctctgggggttgagttgggactgggcctggttctccaggactgtacacttgcaagaccccagagttcatcgggcagatcctcactgttacagacgagtacaccgaggccccaagagggggaggtggctcgccaagttgcagacagagtgagactcccgccctgccgtggatcccgtcgcaatgagacgttgctgcccctggcgctgtgcccctctctcagctcctgcctggcttcctactccctgccctgcgtcccgcggctcccccatattctaggtggtgggcctagtcccctctcagcccagctgcccagtgggaggggtcagggcggtctgggagatacggcccaggaggagagcctcgcctgctgaccggcctgtgcccgacagctcggccatcgacaagcggtcaggggagaaggtggccatcaagaagctgagccgaccctttcagtccgagatcttcgccaagcgcgcctaccgggagctgctgctgctgaagcacatgcagcatgagaacgtaggtggtggctgccccggggagggggtgggggctgccctggggagtcaggggcaggcgcaggcggggcctcccggtatggagagctcgggacagtctcctccctgctcccctgacggtgcctctcgcctcactattgaaaggagggggtgccgagaccttccctgcccactttccaggaagaggtcaaagggtatttttggcagaatgcactttgtgaggtacagactgtgttatcctacagaggaaattggcacaggggaactttgtaattggttccatgtctgagagcttgtggccagctgggactagaatcctagttagcgttgtgtccacgtgaccctgataacaatagcaatatacacatattgagcacttcctatgttctaagagctctgcatacactaacttgtctagtcctcatgatatatgagtactactgcccccatgtcacagacaggaaactaaagcacagcaaggctcacagattagatggttagtcagtagcagagctggggtttcaatctcggcagcgaggctcccggtctgagcacatgaccatcagattgtcttgtctgatagaagcagctgggaaaaccaggggcccagctcagggcctggcagccaggctttgctgcaggatacctagattggagggcagacatttcaaagaatgatttcaaaatgttatgtacattttaagcccatccttctccagcaaacccctcccctatggcctccagccagggtgatcttgcccttggctctgaaccagccctgtggcaggcaaggatggatgtggctggagacccaaggtcaggggcagggagtttgctggctgaaaagctccttctctgttccctcctttttcccttccaccctccccttatgctttcctgctgcctaggtgagttgagagtgggtttgtgttgcttgccctgacaccagacttgacagcaatgagcacacatcattctccccaccttcccttctccccagcctgactctctgtcatgatttattgcaaactccctccaaatccaggggattcctctaggcctctgccctttttactgcttccaagaaggttggagacatgcctcctgctggaggtggtgtattaggaaagggtggatggccctgtgcatggccagggcccaggaggaggtgggaggagaaggtagcgtctgtctagccctcacaggtgacttcttccccaggtcattgggctcctggatgtcttcaccccagcctcctccctgcgcaacttctatgacttgtgagttgggctgcactgggttctggggcatttgcaggccttacatgccgctggggagcaaggtgggggagggtctagggtttctattccgggtgtggcggggagagcctccttccctggcagtcctgtgcctttgcctgtcaagtgtgattctctctggaaagatgcttttagccaaaggcaggcaggaagaggcaggaaggactttgtggggtgcttgcctggcagggggcagtctgcacagctgctttgctttttacccagctttaacaccatgaagacacatctgccagtcctcacagggttagcaccaactcacctttcctggggacacagatgtgagtctggaccttggagctctttctagcatgaagcaaggattaagaagccttggctgcctctggctgatgggggtgtttgacagaatggcagaaaaccagaatatttagctgcaaaatgtatagctttgcctgtgcagtgtctgaatgagactggactatttggacaagatggagaagtcagtgtggcacgtggaggccagcagctggcttggtcaagctgaatctggactgaccctacaggcagcctcaagacctggggactttgagccgggaggtgatatgttcagatgggatttgggggatgcacactggcagcagcaagaaaggagtaggaagcagctcggaggcagagggggagagcctggaggtcagtgttagtgatctaaagtagggatctaaagcagaggtgatgggatgccaagagcagacttgaggccccatttgggaggcagggccgacacaatgttccatctgttggggtgcagtagctgagtgaggtggcagaggtggaggaatgggcaggttcctgcttgaaatacacggtagaggaagaacagatcttgggggaaagataacgaactccattttggacactttacttttaaagaaactgtgaacattccaatgtttaatcacagttgcaaataaatatgaacctcaggagacgaaggtctgggctagggatgtggatttgtgctggaataatcaccgatgggttatagctgacacccgggaacagataattgtagaatgtggtaagatagtattgattcagatatcaacatgaaagagaagatccaagaggatgagcagatggaagaagctgagagggcctgataggaggcagaggagagtcagcaaagaattgagagggagtttcagacttggtgaaaggttagatcagaagaaaagggagtcatggtgtgtttgtcgggtgttcactggtgaccttgagctgagcagtctggcagtaggagggaagcagaaaccaggttaactcaggactgggaggtaaggcagtgggatccaggagtgtggaccgccctttctagaagtttggtggtgagagagggagaaggggtggtcagttgaagaagcaaagtcaagggaatgtggttctagcacagagaggcttcaggaagcatgttgccaagatgaaagaaccagtgcccgagtggaggggaaagacacaggaggggactgggcatggagaggcccccaagggaggtgtgtggtccggcaggagagggctgccaaaatccagagtctcctggagatgcctccagcatgtcctttcaaaaacaacaacaacaacaacaacaaaaaacacaacctattacataattgtttaaggtaacattcattttaaaaaagttttaaatttattatattctagagatagggctgggttgcccagactggagtgcagtggcacaaacacagttcactgcagcctccaactcctaggctcaagccatcctcccgcctcagccccccaagtaggtgggactacagatgcatgccaccatgtccagctttttgttttgttttaatttttatagatatggggtctcactatgttactcatcctgatctcgaattcccggcctcaagtgatcctcccacctcagcctcttgagtagctaagactaaaggtgcatgccaccacacctggctaatttttttttttttttctgaaaggtggggtccaggccgggcatggtggctcacgcctgtaatcccagcactttgggaagccgaggcaggcagatcacctgaggtcaggagttcgagaccagcctggccaacatggcaaaaccccgtctctactaagaatacaaaaattagctgggcgttctggcgtgcacctgtagttgtagctactcagggaagctgaggcaggaaaatcgcttgaacctgggaggtggaggttgcagtgagccaagatcacgccactgcactctagcctgggcgacagagcaagactccatctcaaagaaaaaaagaaaggaagaaagaaagatgggtccctatgttgctcaggctggtcttaaactcttcgcctcaagcgatcgtccagcctccatctcccaaagcactgggattggaggtatgcccctggcctattttataatttttattattttttgtctttgtcctggtctttgcttttactgtaacagttacattttgctggccttatcctgttgtgcaatcccctaagaggctgcaggagcctccccatctccctcttccaccctcctggaaactgttgtattgtttccttcttggaaaggtagacatattgtttgtttgtggagccatctcagctgggcatgaccctctgagggatcaaatatttggacagaagccgaaggaaatactggcagatgtttctaactcctagctgtggctttccctggggtgtggaggagggcaaggagagagtacctttgaagagcgggaacacagttccatgtggctttcctgagcgcgctccaactgcagcgcttactccgagctctgccagctgggcggcccgccacagggagactgggagccaggagcccagaggcccgtgtggtgatctggctggctgaggtggagttgagtttttgcacactggagggtgtctctatgacccctgttctgccctgaggtccctcctctgagctctgacctggggctgggtgggacccggcactgttccaagaacccctcatgccttccagctacctggtgatgcccttcatgcagacggatctgcagaagatcatggggatggagttcagtgaggagaagatccagtacctggtgtatcagatgctcaaaggccttaaggtgggtggggacttggaggctggcagaggggacgccttgctgtctagacctgaggtttggggaggctggagggagcgcactgttacaggtcggccagcctgaagtgcctggtgtggaagctgggccatggactcacccttctctctctcccacatagtacatccactctgctggggtcgtgcacagggtgagtgctttctctgccatggtcctcagaggcccctgtcccatccctgggtatggggttctctggcaatcaaggagtgggaaagttggagggaggggacactgcccaggagcacagaatgtggagttttcacacccagccacggcccaggaaggcctgctcaaaagagtcactgtgtcccaggggacttcatggggaattgctgcagacaaagtgagccctgagctgagtgtttcaggcttcaagaatcaggaacattttagagctgggtgggccctgagagaacacctagtccaaccctcattttacacatgaagaaactgaggcccagaaggggaaggggcctggctgaggtcacacccctgggtggtggtggagctaggacaagctccatctctgcctcagcctagcatgcattctctgtcctccccccaggacctgaagccaggcaacctggctgtgaatgaggactgtgaactgaaggtgagtgggctgcaggctcagcccagaggcgggataggccctcccccagggaagcccctggaagccgctcccagagcctcctcccctcagcaagttccttttctatttatcccctgtgccatagattctggattttgggctggcgcgacatgcagacgccgagatgactggctacgtggtgacccgctggtaccgagcccccgaggtgatcctcagctggatgcactacaaccagacaggtcagtggtcaatgcctgagagggcggtcctggggccatctggtcactcggtgctgactgactgctgggccccagacagtccaggtgacactctccctccctctgcagtggacatctggtctgtgggctgtatcatggcagagatgctgacagggaaaactctgttcaaggggaaagattgtatcctttgctggaaaagccaaactccatctagggattccttccttcaacagacactttatttaaataactgtcttttttttcttaatgtgagagtgatacatactccctgtagaataatttgtaaatgcagataaggctggacgcagtggttcatgcctgtaatcccagcactttgggaggctgaggtggaaggatcctttgagcccaggagtttgagaccagatgtggcaacatagggagaccccatctctaaaaaagttttttaaattagccagacatgggcctggcgcagtggctcatgtctgtaatcccagcactctgggaggctgaggcgggcagatcatgaggtcaggagatcgagaccatcctggctaacaaggggaaaccccgtatctactaaaaatacaaaaaattagccaggcgtggtggcaggcgcctgtagtcccagctactcaggaggctgaggcaggagaatggcgtgaacccaggaggtggagcttgcagtgagctgagatcgcgccactgcactccagcctgggtgacagagcaagactctgtctcaaaaaaaagaaaaagaaaaatcccagctacttgagaggctgaggtgggagggttgagcctgggaggttgaggctgcagtgagctatgattgtgccactgtactccagcctgggtgacagagggagaccctaactcaaaaaaaaaaaaaaaaaaaacaaaatgttgggtgggcatggtggctcacacctataatcccagcactttgggaggccatggcaggcggatcacctgagattaggagttcgagaccagcctggccaacgtggtcaaaccccatctctaccaaaaaatacaaaaattagccgggtgtggttcacgcctgtaatcccagctactcgggaggctgaggcaggaaaatcgcttgaacccaggaggtggaggttgcagtgagccaagactgtgccactgcactccagcctgagtgacagagtgagaccctgtctcaaaaaaaaaaaaaaaaaaaaaatgtagataagcaaaatgatgaaaaattctaccactacgtggaaaatacattttggcacggcacacattaactgagtacctgtgtgtgcagggcaggcctttggtgagaagacgaggaaacagaaaagagtcactgggatgaaggctgagaagtccacatccatttgttgggtagggacccccctcagcctggcacgttggaaagctctccagagccctgagccctgaagaataagcctcctcctgagagcaggaggtggttaggcagggctggagcctggatgatcagttgccatggtgcccgggtgaagtgatggtggggtcgcaggaagggcagtctcagacccaccaggagagcaaggctaagccttaacctgccaccaagacctggaccagctgacccagatcctgaaagtgaccggggtgcctggcacggagtttgtgcagaagctgaacgacaaagcggtgggtggtaaatgggacctaggctggcctgggctgtgtgcttgcctgacgtgggcccagtgggctgcaggcctttgtggaagaaggctcaccagcaccttcccacagcatcctcctaccctggcaggcactcttgtcttaatctcaccgtggaccctgacctgaactttcagccctgctctgaggcttttctgaaatccctgctctacacgctgaggccagagccctaaggggtttgatgcttttctgtcttccaggccaaatcctacatccagtccctgccacagacccccaggaaggatttcactcagctgttcccacgggccagcccccagggtgagtctcagagcccgctccccaggggcctctcagcgtatcccagagggcgggctctcccagcccctggtgtgaggctcttggctctgcccctgcagctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcgtaagagctggggcctcgggcttcctcgcctccgcctgcagcctctcttccttgcttcctccatctttgtgcctggcctctgccagccctacctgccacctccttcttggtgggcattgtctcctgggtgcttctttctccttgagctgacttcgctctccatgctgtctctgaaggggggtggactttctcgccacagcacctctttacgcaccttaaaccatgctgcctttctcagagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatga

SEQ ID NO: 37365 - DNA, 452163 bp, Homo sapiens
ccgcagtgtatcacagtcccgaggccacagtgtatcacagtcccgaggccgcagtgtatcacagtcccgaggccgcagtgtttcacagtcccgaggccgcagtgtatcacagtcccgaggccgcagtgtatcacagtcccgaggccgcagtgtttcacagtcccgaggccgcagtgtatcacagtcccgaggccgcagtgtttcacagtcccgaggccgcagtgtttcacagtcccgaggccgcagtgtatcgcagtcccgaggccgcagtgtttcgcagtcccgaggccgcagtgtatcgcagtcccgaggccgcagtgtttcgcagtcccgaggccgcagtgtatcgcagtcccgaggccgcagtgtttcgcagtcccgaggccgcagtgtatcgcagtcccgaggccgcagtgtatcgcagtcccgaggccgcagtgtttcacagtcccgaggccgcagtgtttcactgtcccgaggccgcagtgtatcgcagtcccgaggccgcagtgtatcgcagtcccgaggccgcagtgtttcactgtcccgaggccgcagtgtatcacagtcccgaggccgcagtgtatcacagtcccgaggcctcggtgtttcacagtcccggggccgcggtgtttcacagtcccggggccgcggtgtatcacagtcccggggccgcggtgtatcacagtcccggggccgcggtgtatcacagtcccggggccgcggtgtttcacagtcccggggccgcggtgtttcacagtcccggggccgcggtgtttcacagtcccggggccgcggtgtttcacagtcccggggccgcggtgtatcacagtcccggggccgcggtgtatcacagtcccggggccgcggtgtttcgcagtcccggggccgcggtgtttcgcagtcccggggccgcggtgtatcgcagtcccgaggccgcggtgtttcgcagtcccgaggccgcagtgtatcgcagtcccgaggccgcagtgtatcgcagtcccgaggccgcagtgtttcactgtcccgaggccgcagtgtatcacagtcccgaggccgcagtgtatcacagtcccgaggcctcggtgtttcacagtcccggggccgcggtgtttcacagtcccggggccgcggtgtatcacagtcccggggccgcggtgtttcacagtcccggggccgcggtgtatcacagtcccggggccgcggtgtatcacagtcccggggccgcggtgtttcacagtcccggggccgcggtgtatcacagtcccggggccgcggtgtttcacagtcccggggccgcggtgtatcacagtcccggggccgcggtgtttcacagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtatcgcagtcccggggccgcggtgtatcgcagtcccggggccgcggtgtttcgcagtcccggggccgcggtgtatcgcagtcccggggccgcggtgtatcgcagtcccggggccgcggtgtatcgcagtcccggggccgcggtgtatcgcagtcgcggggccgcggtgtatcgcagtcgcggggccgcggtgtatcgcagtcgcggggccgcggtgtatcgcagtcccggggccgcggtgtatcgcagtcgcgaggccgcggtgtttcgcagtcccgaggccgcggtgtatcgcagtcccgaggccgcggtgtatcgcagtcccgaggccgcggtgtttcactgtcccgaggccgcggtgtatcacagtcccgaggccgcggtgtatcacagtcccgaggcctcggtgtttcacagtcccgaggccgcggtgtatcacagtcccgaggccgcggtgtttcacagtcccggggccgcggtgtttcacagtcccggggccgcggtgtttcacagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtttcgcagtcccggggccgcggtgtttcgcagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtttcgcagtcccggggccgcggtgtttcgctgtccggaggccgcggtgtatcacagtcccgaggccacagtgtatcccgcagtgggcatttccagggttcctccaccagccagcagcatctcatctgcttggggttctttagccagcaggctgacttatgctttcgctccccaggggcatgaacccgagattaccctgccctttatatgtttatgttcatgttgctatagctttctattagcctctactgttgggtagaaatactaaaacgcacctcagaaaatcccctgggctcccacatacactgagcctcagtgtagagccatgactcactttctacttggcattaggcatcaatcatcccagctggtaaagtcacgtgcttcttggttttgttttgtttttgagacagggtcttgctttgatgcccaggctggagtacagtggttcaatcatgactcactgcagcttccacctcctgggttcagacgatcctcctgcctcagcctccctagtagctgggactgcaggcatgcgccaccatgcccagctaattttgtatttaattttgtttttgtagatacagggtttttccatgttgcccaggctggtctcgaactccttgactcaagcaatcttcctgccttggcctcccaaagtgttgggattataggcgtgagccaccgtgcctggccctgcttctcggtgttttgatgcagtggaatgaggacaccaaattgccaagtggtagtctcattttccaaatcagaggaaccatcattgaattccttggtcgaaacattccttgcttgagaaccaagacttctgagccatcagagcccgccactgtgggtgggcaggctgccaagttaaaggcttatcagaagtaccagtcacaggagccactgcccttctgagccctggttcctggacacatgtcgtccagctgctgggaagacagcgtgatctgtttgtctctggttcaaagcatacactttaatctgcagatgaggccctcgaacttccatgatggcgtttttccagaggtgccgtcactgtcctcacttggtaacagcacgctaaccacgtggcctgtccattccttttatcaggcggcacttcgggaaaggggcctgtagtcagtccggtaacttcttttgctcaggagtgagtttcttgcttggaagccatgttgtgcgggacaccatggcagctggcaaagcatcttggcatggatgacagggctggcagaaggactgtgtgcaggaaaagcaaccgtgtctattccaatgaggccgagcccccttctcctccatggggaacgaagtccaatggcatcaacctgctgccacttggctggctgcttccccaggtgatggtgtcctactgggagctcagggccaggttctttttttttttttttaatcagcaggtcaggtgcccagcagtggcagtgcacaggtcagctctggagggggaggtccatgctgccgtccatgcccagcctccacccttcccccactccacacttggagcccatcaaacatgcacgggagagctgggaaaagaggctgatgatgcctgcagagggggcagctgtggagatctgagcaccgagagcccctctgaagcgaacagacctcagagacacccgcccggcacagctatccccacagctgtccatctggtacttggtcccagaactcccagacaccttgctcccaatccattcatttccaagtccttaaccatcctaaccatccagccagacattcacaactgctcaggagtcagtgtggatgcatgtatgcaatactatccagggattaggaagaagtgaagggctggaacatggcggtaaacctgagaacagtgtacacaaagtacacggattatatgactccctttctgtgaactgtctggagcaggcacattcggagagacagccagtggatttgcggttgccagaggctggggttgggtggggtgggctggagagtcatggctaataggaacggggtttcttttagagagatgaaaattttctaaacttcagttgggtgatggttgcacaggtctgtgaatatactaggaagctttgaattatacactttaaataaaggaatcttatggtatgtgaattatatctcaataacgcagtttttggggttttttttttttgttttgagtttcgcctttgttgcccaggttggagtgcaatggtgcaatatcagctcactgcagccttcacctcccaggttcaagcaattcccctgcctcagcctcctgagtagctgggattacaggtgtgtgccagcacgcccagcaaatttttgtatttttagtagagattgggtttcaccatgttggccaggctggtcttgaactcctgacctcccgtgacccacccacctcggcctcccaaagtgctgggattacaggcatgagccactgcgcgcccagccaataaagcagtttttaaaaagttaatcctgacttgctcaaggatatcagcaaaaattgtggagcaaggaactcccaattctgccccttcataaaggcaaatgaaaaaatctgcaaaaatcatcacagtaaaattgttttgcagctcaggaaattcacaggcagcttgcagccaccgaaggaagagtgattcaaagagaacggctgatgttcattaggaacggtgaacttggtggctttttcatttatcccagtcacataccccacttcctacaaagattttaagagaattggactaggatcaacacagctagcttggccccgatgggacagagaaggtacagaatgaaaagagaccttttgcccccaagcttctaaggcaggaatgaagttaggctcaacaacaaacacaacacagccctccaataccatttgacacccaacacagacgccatgttgtgcgggacaccatgtcgcagttacaggaaggaaaaagaatttgtgccaagaaccatgaggaatcattcctgggggctccacgaaggaagtggcaaagtgccccactggctttgagaaatgatggacttggggctgctatgtgctccccaaagactgtgttgccgctcttcgaactggagggtctacagcagcttgtcctgtgtccactgggtgtgcagtcattgggtgtggggcagacaatcggcctcttagtcttccgtccacattggagaggaactgtaacaggtaagctgcacctgaggcctctcatttgcacctggacctaattatatcacaagagcaggaggccaggacagacgtggctttgcagggaggggtgggtgtattctgcatgtgcaaggaatataagtaattcatggctagaggatggactgctttggatttaaacatgtcaaatgccttgacacttctctcatcaaaattgcagcataagccaagggcagtattgcacacctgtagtcctggctactcaagaggctgaggcaggaggaccacctggagggcaaggcctggggggtcaaggcttcagggagctatgatgacaccaccgtactccagcctgggggacagagtgagaccttatctcaaaacaaacaaacaaacaaaaaacaggctgggtgcggtggcttgggaggtcaaggcgggtggatcactgaggtcaggagtttgagaccagcctggtcaacacggtgaaaccccgcctctactaaaattacaaaaattagccggatgtggtggcgaacgcctgtagtcccagctactcaggaggctgaggcaggagaattgcttgaacccgggaggcagaggttgcagtgagccaagattgcgccactacactccagcctgggcgacagagcgagacactgtctaaataaataaataaataaataaataaataaaattgcagcctaagccttctccccttgaatgtgtgctattctgagtgactcttttctttttttcttttcttttttaggggacagggtctcgttctgtcacccagactggagtgcagtggtgcgatcacagctcactgcagcctcaacctcctgggctcgagtgagcctcctgcttcagcctcccaaagtgcttgggtaacaggtgtgcacccctgcacctggccccttagtgagtcctttctaaggagtagtatgtggcaacagcaacaccgcgtggctggatggtggcctccatctggctgtcttggccttgggacgcttgcaggggcttctcctggactagcttgtgttccttgttgctctctgcactgcacggctcctgcccatttccaagcctgggcttgtgagcttcctagagatactgtgagctactgatattctttcctgatccgttcgtggggtgttggattctctgacttacaggtgagagctccgtattggcttcctggggctactgtaacaaatttcacaaacttggtgacttccaatgacatatttattctctcgttctggcagtcagaagtctggaactaagaggtcggcagggctcccccactccagaggctctgggggcattttgttccgtgcctctctcctggctttgggaggctgccagcaatgtttggccttccttggcatcactccagtctctgcctctgtggtcactgagcatccccctcttccgtctgtctctcctctgtttatctccaacaaggccacatcattgcatttagggactgctcagataatctgggatgatatccgtagttaattacatctgcaaggaccctttttccaaacaaggtcacacgaacaggtgtcagggatgtgatgtggatgtatcttttgggagcccaccattcaacccagtgtaaaccctaatgcagaaattggtgcagaaaaaaatggggagaatctgggattggctatctggccaggctgtggcaaaaagcaatgaagatactgcttgtcttagggaacgggacaaagggttgtcccctgggcgtccctgggaggaggagcccagtgaaagtctctggggtttcggggtggtgcccccaaaagaattcaatggctatgtctatggtgtgggatacgtttaaaatagctcttcaagaatgagaataaggccaggtgccgtggctcatgcctgtaatcccagcattttgggaagctacggtgagcatatggcttgagcccagaacttcaagaccagcctgggaacatggcaaaaccctatctttacaaaaaccaaaaaccaaaactgaaaacaaaaccgaaaaaaatagctgtgtgtgccggtagtcccagctactagggaggctgaggtaggaggatcacttgagcccaggaggtcaaggctgcagtgagttgtgatcatgccactgcactccagcctgagcaacagagtgagtgcctgtcttaaaaaaaaaaaaaaaaaaaaaaaaaagaggccgggcgtggtggctcatgcctgtaatcccagcactttgggaggccgaggtgcacggatcacaaggtcgggagatcgaggccagcctggccaacatggtgaaaccccatctatactaaaaatacaaaaattagccaggtgtggtgatgggtgcctgtaatcccagctactcgggaggctgaggcaggagaatcgcttgaacccgggaggcggaggttgcaatgagccgagatcatgctactgcactccagcttgggcaacagagcgagactccgtctcaaaaaaaaaaaaaaaaagaaaagaaaaagaaaagctaagattcctaaattttagttcaaagaacagaccaatagcccaaggtgccgtctgactgaagctgacctgtggcagcgcatccaggaaggggcccataccagcctctaacaggcccagaggtttcttttttcttttcttttttttgagacagagtctcactctgttgcctaagctagagtgcagtggtgcgatcttggctcatgcagcttctgcctccaggttccagtgattctcctgcctcagcttcccaagtagctgggattacagcctgactatttttttgcatttttagtagagacggggtttcaccatgttggccaggctggtctcgaactcctgacctcaggtgatccgcctgtcttggctctctaaagtgctgggattacaggcatgagccactacaccgggccaggcccagaggtttcagaggggtcacaaggagtatgactttcgggtgtgttgccctaggtgtccccgacctgagtctgtggccacactgggtcccagtcagggtcctgctgttgaccaaaaatacttgctaagcttgtgaatctgcccttctctggagctcctcagcttgggctgggccagatctcagctttttctccccgacagccaccagagctgaaagcctctttagagaagctgccaaagaggtcctctggctttcctgcctcactggaaagggtgatcaatggccctcagctgctcgctggctttcctcagcgcattcaggcctccctgcaacagccatccatggccacccatctaacgatgagcccccagccgctcaaaagtctgaggcatcgcacccaccagtatgttccctcccatgggcgtctcatcccagctcaccactgggggaggttttagcgattgctcccttgtgctagggactctccgtgcccacctgccctcagcaatggggttccttaaggtgagccagcccataatagcatgcaggggttagcgtccttgggctcctccaggcaccaagtggtgggagcggaggggaggggagggggcaggacgccactggctactggggcatagcagggtccatttcacctggagaagaggcggcagggccaggaagccagcaggtccctcctggggcacggctggcagcactgcttgaccctttcgggccgtggtagcaggagggctggggacacagctgggcatgggtatgtggggatggcggccattgacaaaggcctgttgcaaacgcaatgagaacatcagtgatcagcacctgggcgcagagctggccgggttcatgacaccccgggctgccaaggcagacagatcatgaggaccgtgatctgcgatttggccctggagggacagagaagggaagccgtgggctgggggaggagaaataataacgcagtgcctggtgcagctcaagttaaatgttccacaggaggacacacctgtgctggtgcacgtgcctgtcaccgtgggatggccccatgtccgggtggcagtggcgagggtgtgagcaggggcctcagagtggccacctccaggctcacatctgaggcagccagggcctgggaggagccaggccagctgggccacactctgggccaaaggttcccggtgacagacacagaggggagctgtccaggctgcacgtgacctgcgggggctgagcatccacttccccactgcctgccctttttgtcgtggggcgctgggaccctgggtggccccactggtgtttgagagaagcgggtccaccctctgccgagtaagcccatgggagcttggaccattcagggaagtgaagatggctatgggagggacttcctagcgtcacggcaggcgagcatggagctctgagctaggaccctggaggagactgcatgggccctgagccaggggagggtcagctgtcctcagcgctgggcatgcggccatctcagcgccctgggtacctgctgtgcccatttcacacagaggccagaggccagagttttgactcgcctgcccagggcctcagagtgactgggtggagcccctacttggggaagcccctggctctcctacagacagccccgagcatgtgtgagaggctggggaggccagaccttggggttcttctcaaggggttcccagtctcaggaggccattcctaccggcctctcccatcctggatgtgccacagtcaccactggggtctgagatcaacatctccagcctgagcccacccgtgggccccacagaagctgcaatcagaccttcacattctcccacgggatggagccaagaaattcaccatggccctagcagcaaaacccacttctttggagccaggatgagcctggtgaccctgggagaacacttgccttggagacctctgataggttcagcacagttgccacacagcatcaacatgaagcttggggtgtgtggtgggatgggagggggctcagggcatctgcaggtgtctaactctgctcagaaacaacacagcaccctctaggacccctgggacctccctagcagacaagaggccagggcagcagcctctgtttctcagacacatctgacacctccctcctgacactgtgacaatcctagactggctctgcatctccccaggccttgcacagggtggatggatggatggattgatggatggatggataaatgtacagatggatggatggatggatggatggatggatggataaatgtacggatggatggatggatggatggctggatacatgtacagatgaatggtggatggatggttgggtaggtggatagacacatgggtggatgggtagatgggtggataaatgggtggatgaatgatggatggatggatgagtggatgggtagagggtggatggatagatggagggctgagtggatggatgggtgggaggatggaatggtggatgggtggatgggtggatgggtggatggatggatggatggagggatgggtggatgggtggatgggtggatgggtgcgttggtgggtggatgggtggatggatgggtggatgggtgggtggatgggtgggtggatggatgggtggatggatgggagaatgaactcatgctggtgtctaactctcatcagttgtgctcagaaacaacacagcaccctctgggacccctgagacctccccaggaggcaaggggccacggtggcagcctctgttgcccagagacatgctagaccctgttctgggtgctgggaggacaaaaaggaggtaagcccacaggccaagcccccaggccaagcccccaggccaagcccccaggagcccaccccacacccaggcagacattgcaggacctctaagcaaggtacagagggcactggggaggccaggagatggtccctgagggaagcgatggctgagctgggttttaggagacatacacatttcctgggggaccaacctcccatgggcccactgctggacaaagccagacacagcttggtgtggagagaatttcaagagcatgagtattgtaggatttggggtgggtctggagagtggcataaattagactgagagggctgtgaggggtgcagagggccttgagaatcatgcttaggaggctggatgtgctcagagggtgggggacccaagactgttgttttgttttgaaatataacaaacagctttattgaaatagaagttgcatgctgtacaatccacccacaattcagtgcacaattcagcggttcttggtatattcacagagttgtgcagccatcgccaccatcaattttataacattttcatccctccccaaacccctgtacccatgagcagtcactccccctccccacctcctggcacctcgcaatctactttctgtttctctggatttgcctgttctggacatttcatagaaatggaatcatacaacgtgtagcctgtagcctttgtgtctggcttctttcactgaacataaaatttcgagctgcatccatgttgtagcatggatcagaaaacttcattcctttttaaggctgagtaatattccaccatatgtttatctgtgttttttgtttttgttttcatttcgctcttgttgcccaggctggagtgcaatggcacgatctcggctcactgcaacctccgcctcccaggttcaagcaattcttctgccttagcctcccaagtagctaggattacaggtgcctgccaccacacctggctagttatcattgggttttttttgtgtgtatttttagtagagatggggttttaccatgctggccaggctggtctcgaactcctgacctcaggtggtccacctgcttcagcctcccaaagtgttggaattacaggtgagagccactgcatccagccccgtgttttgttttgttggacttttgggttgtttcagcattttggctgttttgaacaatgccgctataaatataggtgtgtagggttttatgtagacacaaaggtgggctttgagcaacagggggcacaatcagatttaaaggggtcattcttcctgcaggtggggatgggggtcagatggagaaaagagcccagaaaggcttggccaacccttggggaagtatcacccacactctctccccagttcccagcatatgcacatgcacacgtacacgtatgtgtgtacatctgagcagtctccaaggcctgctattgttgagtgtcccagggacaggcaaagctggcccagttctgagctgatggaggagaagagtctctttagtagcaatccttgcattcttgtattgatatgggggggtcagcctcagcgcggaactctttacatccccgctctcccagaacccctatggccacgggtggggcagatcgcaatatggccactcatgagagaggagacagaagctcatgctggtggggcagaaccaggcttcaggcaggtggacccaagtccaagttcaagatatcagtggccaccaggcatgtgtggcttctgagctcttgaaatgaggcttgtctgactgaggaactgaatctttatctaatttgttttttgttttttgagacagggccttgctctgtctcccaggtgaaagtgcagtggtgcaaacattgcttgctgcagcctcgacctcccgggctcaagcgatcctcccacctcagcctcctgagtagctggtaccacaggtgtgtgccaccatgcttggctaattaaaaaaaaaaattgtagagatggggtctcactgtgttgcccatgccggtctcaaactcctggcctcaagcaatcctcctgcctcggcctcccgaagtgctgagattacaggtgcgagccactatgcccggcctctaattttaattaatttaaaaattgatactcaatttcatttttggcaaacttctaagtttacgggaaacaatttgggtatgcaaatctactttttcaactgtgaattctgtgaaacctaaacacatatcaaatgcgtctgatgaaaatttagggttcaaactgaagtccgctatcagtgcaaaccacatgctggattttgaaacttggcgagaaaaaagaatgtcaaatgtctctctaatagatttgtacattgattacatattgaaatgataatatttcaaatatactggatcaagtacagtgtattactaaagttgattccacttactattaattatttgtcagccataaaaaggaatgaagcccttcctggtgcacgttcatggtgaatggaacttggcatcatgctggagggaagaagtcaggcacaaaaggccacacgttggctgatttcatttagatgaagtgtccggaacaggcaaatccatagagacaggaagcagcttagtggttgccatggctgaggatgggcagggttgaggagggcagctaagggatacggggtctcctttgggggtggcagaaatgtcccagagttggagtacgtgagctgtggtctggcaggggtgctgtctagcagggtaggggtgggtatgtctccttggcagtgcccttactgcgcctcaggaggtgctgtggctagaggacagctggaggggcccaggacagggtggcattgaatgccattaagggcatggacaggcttagagcccagtgtcccttggccgtgtcttcctagcaccagggtgtgctgcctccctttcagtaagagccaaagtttccagagttcggcaggctgagtctgccaaggaccacattcaggaggctccccagcctcccccttgtatcgcataactcataacccattcccataactcacagctggccatgtgggtcttggctcatcctcctagctggtctgggcctcgcctccctctcctgctttgggttggcctgctgggctgtgatgagagggctcctgcagagatcccaagtccacctccacacgctgcccagcctctggcctacacttgcatgaagtccgttcacattcacggagggaagactgtttcccccttccttaaagccttgattaggtgaccctgaactcatgagctcaaagactccaggcagtgctcacagaaaactgccccggtctcctaaatagtcactggaaggtgtccaaacaatggccacttggcagtgagatttcagagatttcagtttagggtacgatccatggattatggcatttgatttaattttgaaagttgaacaagaagtaaaaaatctatattttgccctttcaaacaaaatgtaaaagcccccacccaataattcagtcaggcatactctgactgcatggtgggccagatggtctttttctacacctataatttcccaggaaattgtgacagctgaatttgcatgatgtagctacaaatggaatttgcacaatgtgtgtgttcatgtggtttggacatgagaataattcctttatcccatcatgttgggaagagtcaaaacattcacttgcccttcctcatgaacaaagccagtgctcagtcagtattttctatgtggaggatggaggatgggtggagggatgtgagggatacacagagggatgaatacagggatgaatggagggatgggtgggggaggggtggagagatgaatttaatggatggagagatgaatagagagatggatgggtggatggatggagggatgggtggatggatggagggataggtggatggatggagagatgggtggaggaatggatgggcggaagaatgggtggagggatagatggagggagggatgaatgtgggggtgggttgagggatggatgggggagtaatgggtgaagggatgggttgagggatgggagaaggagggagggacataggaggggtgagtggaagaatgaatggaaggatgggtggagggatgggtggacggagggatagatggagggaacagtggaggaatggattggtggaaggatggagggataggtggaaggatgggtggagggatgggtggacggagggatagatggagggaacagtggaggaatggattggtggaaggatggagggataggtggaaggatgggtggagggatgggtggacggagggatagatggagggaacagtggaggaatggattggtggaaggatggagggataggtggaaggatgggtggagggatgggtggacggagggatagatggagggaacagtggaggaatggattggtggaaggatggagggataggtggaaggatgggtggagggatgggtggacggagggatagatggagggaacagtggaggaatggattggtggaaggatggagggataggtggaaggatgggtagagggatggatggagggagggatgggtggaagaatggatggaaggatgggttgagggatagatggggaaggatggaaggatgtaggagggatgggtggaagagtggattccaggatgggtggagggatggatagagggagggatgggtggaggaatgtgggagggatggatggaggggtgaatggagggaaggacggcgggatgggtggagcgatgagtggagggataggtggagggatgggtggagggatgggtggagggatgtgggatgggtggagggatgtgggatgggtagagggagggatgagtggagggatggctggagggatgtgggatggttggaaggagggatgggtggagggatgtgggatggatggagggagagatggatggatggagggatggatggaaggagggatgggtggagggatgggtggagggatgggtggagggatgggtggagggatgtgggatggatggagggagagatggatggagggagggatggatggagggatggagggagggatggatggagggagggatgggtggagggatgtgggatggatggagggagggatgggtggagggatgtgggatgggtggaggaatgtgagagggatggatggagggatgggtggaggaatgtgggagggatggatggaaggagggatggatggagggatgagtggaggaatgtggcatggatggaaggatgggttgagagacggatggatggaagagtgggtagcaagatataggagggatggatggaggggcaggtggagggatgatggacagactccagccttgggcggagctcctttgaagaagcttcagtctatccctgggatgctggctgtggaatgagggtcccctgagccttggaccttttgatgaaaagtactgagaccttgcagcaggtcttggtgttttttgggggaatactggactgagacagtgcccactctggctgtatggaggttctctgggagggcctgtatggaaagaaacagtcttgagtgagaggtaaactctcaagcccttccactgtggcatgtaacgcgctaagggacacatgtattcctgttcagaaaccagaccctggggctgcccagagaatgaggacaccaatttgatgagggcagctctgcagaaacccaggggaggggcgctgggccggtcgtggactcagattgtcctgtgccactgcccttgaaatcattatttatcagtagaaaacaaaagcaaacctctcagctggaggcataggagaaggtggacctgagttcgaatctgaactctgccagttgcataaccttggccaagtcactcaagctatgtgagccgacctcatctgtagcacagtacgatgacagtcctcgcctcctagggtgtgggtggtcctggctcagggcctgggtgcaggaaggacgtgctgagttgtaggtggagcatcactcgtggtgtgagtgactgggcagagaagccagaggggaagcccagccatgctgcccacataagggcagccacctgtctacccactccttcctccaaaggtctcctctctgggaccccgaggatccaagagtcaccaggtttccaggacctccaggatgcgtggatatacttccagctgcccttccctcctttaagtcagtgtcggacccttcggctcccgtttcttagccttgctactcctgcctgtactaagggctcatttcggtaccacagtggcggggcgggggggtgtgcctgtgggctccaggcactgcgctctgttgctgactccgtatccacgtgttctagacatcagatcattttccctccctcgtcacctccccacccacatcagtgcattaagggaaagcagaaagttctaggcgtggaaagccctttcagcagcagcctctatttaggggtgcacacaggtgtcaataaggcctggcgtttggacttggctttttcctgtgttgctgggtgaccttgggcagctcaccaatgtgcttggtgagctggtttttatgttggaccactcagtacaataacagtgactagaagtgatggagtggcttgtggtttaaaggaggtgaccatcacctaggccggccactcagactcaagacacaggattggttactgcaactatgaatgctgttaaaatataacggcttgaaagtgacaatgtgcgacgtaactgcaatcttacgtagtgtaacgttaattcacatagcgatagtgttaaaatatgccacaagtcaataaataagattatattgccttttattttttattttttttgagatggggtctcactttgtcacccaggctggagtgcagtggtacgatctcgactcgatgcaacctctgcctcctgggctcaagtgatcctcccacctcagcctcccaagtagctgggactataggcgtgcaccaccatgccaggctaatttttgtattttggtggagacagcgtttcaccttgttgcctaggctggtcttgaactcctggactcaagggatccacccgcctcagcctcccaaagtgctgggattacaggcatgagccaccacgtccagcctccgattacattgccttttataagctgtctttggatcagtttaacgcatctgtggcttccatgaaagaatatattggatttaaaaattacaattacagtgatttgctagattttacctccagtgaggcgggagccccgaggtgcccatccgcgcagaagagagacagggtgtcactgagggccgactgggtccttgctggctgcggaggacaggtggaagggtggaagcgggtccaaggagagggggcctggggcttggtgggggtgggccaggagggggcagatgctggacagaacaggaaggtggactgctgggactcgctgcccacatggctgccggggagaatgagacaggagctcaggaggacactgcggtttattgttcaatgcctgagatcatggcaacactgaattcctttgtggtttaaaaatcaactcctgtccaagctctccatcctccatgtcaccctctcctagtcactgcaaccatgatcaatctctggttgtcaactcaaacctcagtttctcctggaagccttgctgctccctccccgggtgtgccctgcctggtgccctcctccgccacctgtgaccctcccccatacttggggtatgtggcccatgctggcacttcttgctccctggtttaatctgctcggctggactggcagctgctcactggcagtctgtgtaagcagctccccctggagcccatctccaaggtgtgatgggactctcgccccctggaggtgtgcagcaggcagtcctggcagacagccctgagtccaagtggacatggatggtggtaggattttcccaaacagcgtcctctctattagtcttcctggcatgtgccttgagtccacagtctcaacctgttcatcattacactcacactaaaggttacaaagggagctcctgccccattttctttaccttttattttatttttgagacagggacccactgtgttgcccaggctggtcttgaactcctggactcaagccatctgcctgcctgagcctcccaaagtgctgggactacaggcttgagctgctgtacctggccccaccaaacttttgttctttgattcacatccatcctgccctcagagcctccaaggattctgggaggtgcacagggccggtgaatgtcctatgccgatcaggacctgggaaccagggaggcctgagtggctcagggccactgtggtgaagtctgtgtctcctgagttgggtcttctcaacggtcaaccccagattttctgtgcagcccctcctgggtgcagccaggtgccccgtggtgacagcaccaccagggggcagcaggtacccatggcattgttggcgggcggctgcctgggtcccagacctggctggtcctcttggccagagcaggcaggcccaggaccgtgaggacagaggcccccttcttgctgagggagccacctggggaaagagacatttagtgcatcaatgcgccggcggtccaggcgaggggttgggagagtgggtagctcttcttcctctctgagccctttctgtcccagcacagtgggaagcctctgggtaatttatccgtccattcttcacaagcaagtccagtgggagccgggtctccccgctctagagaggaggggatgaggctttgcaggaggagggatcagtgtaggctctcagatggggctggagggccccgctcaggtttcactcctggctttctgatttcttagggagatgctgatgggtccacctgctgccccatcttgcttcggtgaggaaagctctcccccttgccctaaaggtgcccactgctgcttcctcggggaagggcaagagacctgagcccccgcctcaccagccacctggcctgagtttactgctgcaggggccagctccttcctgacctctctctacgggccagaccctaagctgggaccccctgcttccacctcagtggagaaggggtgagtctgactctgcagagaccaatttccaggacaggacccccatcggaggccctgggcccaggggaccctctctgcgctcgcatccccgttccggcccctgcgcagggaagccacggggtaaggggtccgggggctgcagtgcagccccagctcatacaggcccaggattccaccggagtccagggtgggagccctcagacaccgcaccccagcctccgggctgagccagtctcagagaagggcttggacttgcctggtgtcccccagtgaatcagcagtgaaaacccgcggttcccggcagctgagccaggatccatataatttcagttgcagaatctgtttgtccttgaagcccctcctaccgtcacacgttgccagctggacagaccgcgcccccaccacccagggtgtggcctagaagggagatcagggcggatcagcaccggggccggctgcgaccctgggccggagagcaccttcctgccctcactcatgtcacgcattccgccctggacgccaggaactgcccgctgggcagctgcgagtggccaggactttggccaaaagctggggaatcctggcctttatgcagggtcgggggtcttcctatgggcccccggccagggcggaggacaggaagagggctctgggagtcctgggcccgtgtgccttcagcctcagcctcgggtatcccgccggggcggcttgatgggccaagggggctcagtaagcttcggcccagcccggtgccctctcccgagtctgtcgttaccgaacggccatgcgagggcgcccagcgcgacagggaccacctcctgacctccacggaggaccaaaggcacccggggggacgcccggccatcactccacgggcgaggtcgctcccccagggagaagggctccccaaagtccgagcgcccttggagaaagtcggccggacctgggcctgcgccgcaacccccgcccaccgcaactttcgcgggcggtagcggggcaggaagtgggggggcgggggcggcgcttgggacacggggaggtgccaggcgagtgctccggccccgcccctgccccgcccggccgtggccgcgccccctgcgcccccagcgccccggagccgtggagccgccgagccgccgagtcgtcgagtcgcagcgccgggcgtggggactgcgggtggggcgaacaaagcggcggcgacgcgggcggcccaggcccgggacgcgcggagcgagcgaccccgccgggcctttgtctcgggcggggcaggagccgcggcggccgcggggcgccccgagcgcagaatgcggcgcccggcggcgcggattggggagcgctgcggcgactggctgcgtggagcccggcccggggcccgcaggcacttgcgtgtgtgaagcggggagatccggcgcgctgcccgttgcccgccccgcggccgcacgtgggcgggagcggcggcccgagaggagcccgaggagtaggaggaggaagaggaggggacgcacggcggcgcagcgggggacctggggcagcccgcgcgaagccccgccccggccctgagccccgcgcgcgcgcgggcgggatgccccgcggccgctgcactttggctcgagcactgccctgagccggtcgggcccgcgggcgccatggagcagtggcggcagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccaggtgagcgcccggcgggcgggagggccccggggaggcggcgttcgcgctgcccgacgcgcggactgaacgcggaggtcgcagcggcggcggcccaggcgccctggctggggcggccgggctccgggacgcgggcgggcggctggagggtgcgccccgggcctccgagacgcgacctcaggaggcgcgaagttggccaaagtcccctcagcctgggtcgcgccgccgccgcccgcgggcactgctctggtgcgccggttccgcggtctgcgcggcctgggatgggggaggctccggcgctgcgctcgctctgcggggccctgcgagtggcccctcatttcccagggagcctgccgagccgggtgtgcgcgtcgtgggtcgcatccttgggcctcgcgcctcctggccggacgccggtggaagagcgggcgcggtcgctgcgccggcccggggcgcggctggagggcccgggaggggcgcggggcgggagccctcggggccggagggagctgggttggccccgggcaccgccccctcgccggcctccgcctcttcccggacccggacccgggccacttggcgccagtcctggctcccgggtcgagccgcctcgaggatccccagggccacttggccccagtcctggcccccatcgctttcccaacacccccacccctccttcgggcgctgagtgtggcctttgtcgcggcggaggcacgcgtgcggccgcagggccaggcaggaaaatgcctgcccagccgaacgaagctgcttttcttggcctcttaagagggaacttggctaagacttgagagaatcgaggcttccgtcctgttctccgggggtcgcggaatccttaccgggagcagcttagaagaggtcgggggaggcagagcgggtggcagccgggtccacccagcgccgaggaggtgcggtcttccagccagctcagcagcccctcaccgcgcgcagtggcaactccatgtggagagggaccattcaccagtgggacttaggacgtggttcctgggaaggagggagagtgagtcaccagcgattccaggctgggcagcgaggcctctgccctttggcggtgactgcgtttcctaggagaccgggcctttctctgccgggttggggggcgctgacaaaggcaagcccagaggggaaggggccgccttcccactgggtaatgattacccagcactgcctggaccggcttagcaggagccctcagaggcctccctgggagccagcgcctcttcccgcaggatgtcagtggtcaggtgcaggtggcgggggtggcggtcactgctgcagagggcttccccggatctgttctcagagccccacggggactgggaagtctggactccattttatggctggagaaactgaggagaagggtagctgttggggagcagggctgggcctcgaaccaaggtggctgcctttgatatgagttccaggggctgcccaggctgacttgctcgggcaggattccctgctgcttgcaggctggggctcagggcagaggcagggcagctgggtccgcacagaggaggcttgggaggagcccagccttgcctggtggactcgctgggtccgggggctgcccctccccagctgtggtttgggaagatgggaagaggagggggccgtggctgtggcaggtggcttggctcagctcctgcactggaagttcaagccagagacttcctggggtctctggagccattggccaggcagcaatacgaaccctgacagaggccccttgagccctgctgctggggggtggacgggtgtctaggggtcccgctgctgggccggtagaggggtgtttaggggccctgctgccggactcgtggagggcgtgtaggggcctggatggtaggaggaccagatgggtgtgtgtctgtgtggctctccgctctgattgaatcctggcactgtcccctcccaggtaggcaacgacctccagagcctcagtttccccatctctgtcatgagaacagtcatagcagtcccctcgtagccatgctgtgaggatttgctaagggcaggcacagaaggcacacccttcgcacagtgcccaggaaatgaccgtcacctggactgtggcacgtagtgccctgtgtcgctgaggctgatcttgccatccactcctctgtcccgtggagggtgggccacctttgtacggctgttgcctgcacggggacggctgcagatgctcccttaaccctcacattggctgtgacagccccgcctgttcattcaacgtggagaaaccactttactgcatctggctgcacacaggggttgggagaaagacttcgtttctctgtgtggctggtgtttgttttctgggaaactcacttttttttttctttttggagatggagtcttgctctgtcgcccaggctggagtgcggtggcgcaatctcagctcactgcaacctccacctcctgggttcaggcgattctgctgcctcagcctcctgagtagctgggactaccggcacgctccaccacgcccagctttttttttttttttttttgagatagagtctcgctctattgcccaggctggagtgcggtggcacggtcccggctcactgcaacctccacttcctgggttcaagcaattctcctgcctcatcctcccgagtagctgggattacaggcgcctgccaccatgcccggctaattttttgtattttttgtttttttttttttttgagatggagttttgctcttgttgcccaggctggagtgcaatggcgctatctcagctcaccacaacatccacctcccgggttcaagcgattctcctgcgtcagcctcccaagtcggctgggatgacaggcatgcgccaccatgcccagctaattttgtatttttagtagagacggggtttctctatgttggtcaggctggtcttgaactcctgacctcaggtgatccacccacctcggcctcccaaagtgttgggattgcaggcgtgagccactgcacccagcctatatttttagtagagacggggttttaccgtgttggccaggctgggctcgaactcctgtccttgtgatccacccgcctaggcctccctaagtgttgggattacaggcttgagccaccgtgcctggcccacgcccagctattttttgtatttttagtagaggcggcgtttcactatgttggccaggctgatctcaaactcctgaccttgtgatctgcccgcctcggcctcccaaagtggtgggattacaggcgtgagccacagtgccccacccacacccagctcttttttgtatttttagtagagacggggtttcactatgttggccagggtggtctcgaactcctgacctcatgatctgctcgcctcagcctcccaaagtgctgggattacagacgtgagcccccgcgtccggctgaaactcacgtttcttaaggggtggggatgggagagggaagaagtcatctccacccttggtggttgggtcatagaaaaatcacatctgccctttcttacctgccctgctgtggcctaagcacaagcctaggtgggggttgctgcctgtgtttaataggtgaggccgtcaaggttccggagagcttgagtgactccccatcaccccaccactcctgcccagaggagtaagtggcaaaaccaacatagggattgcagtctccctcccaggactgtttaaataaatgatgactgcaggccttcctaagctggcttactctcttgtggactttctgagggatgtccctggcctcattcttgggttttgggttgtcacggtgtgtgtctcttttcatggggtggcaggggtggggggtgggtgcctgtgatccctggctggtgagttgcagggcccctcgagcgcacacggcggggagttgcccacctccctgccagtcatggcatatgaggccgtctagcccggaggcctctatgatgttccctccttccagaatttcccctggcttctcatggtgacatcctattttcagaggacttggagcgcccctcccactttgagtttaatctgggctgggttatttgccctaatggagcatcatagcaacgtgcatttatgcagcacctgctgtgtgcagagccgggtgctaggaggtggtcacagagatcccagttgcccacctggtcatttcttctgaagctggcaggatctactttattttattttgttttttatctgaagtgcctggaagccccgtgggtttaattaaactaattgggtatggccacaatctgctgaccctaacgagaaatcgggtgtgtctggagcagcttcggttgggaggtcccgaggttgcctgtgccagcatcagcagtttgcacccttaaggtaccacccgccgcccagcctctgacttgcccacatcgtcctggtggcctcctcctcgtaaaacacatcaggcagccattgctggacaccacgcaaaggcttggccctgggcctgccagagtctgtcccccacctccacctcaactccctgtgctccctgcctcttcccggacacgccagcctggcgatggttttggcatccccccctccgggcctttttgatgtgtgccatcgtgagctgtgccattgctggaagaccttctctccttctagcctggttcttcctgtaggagctggtataggggctccctccccttggcagcctccttgggtttcaccctctccccaccctgtcctccacgcgctttgaacctcgatctcactcctccactgttccaggtttctctctggcctcgtgtaatgaaactctttgtttcatcacacgatacccttgctgctccttctgcaaaactcagcagctggacagctggagagtgtgaaggatgatcctaatgacagacccagtgtgtctggagcacctttgtgtggctgccccccttccaggtctgagcccctccaaggcagggccacggctgggcttcctcctctctgggtccctcagaaccttgtgccttcattcgagaaataataaataaataaatatataataaataaataataataaaataaataaatataataataataaaaccctgctgtgtgccacgcaggctttgtgcctccaaggggagggaggagaacaggccggggctgtccctgctctcatgaggcttctggtcacgcaaggaccccagtggatgttgatgaggtgcttggtgactgaaaagcgacatggaagtgcccgaagggcccctggtgccagcagaaggggctgggctggtgtagccgaggtccacaacacagggctgccgggagcagaggagggaatgctggttgcaaagaagacaagggcgtcttttctttttttgggggggatagattttattgtctaaaaaaatttgaaaatatctcagtcattggaaaagttatgagtacaacacaggtaactttttcttgaaccatttgagggtaagtatggggcatcagtgcgtttactgcaaacaagggcattctcctctgtaaccacagcactgctgtctccatccagccaacagcatcaatccgtctccatccagccaacagcagcaatccgtgacccgtccacttctccacaattgtcccagcaaatgcccttcatagcatagagcagcctcaggaccctgggctgcctgtggctgtgtccccctctgtcaacctggggctgctcctcagcctttctttgatgttcatgaccttgactctttggaaggttacagcctcctttggttacagaatgctcccccatcagcagcgtcaggtcacgcaactgtaggggtctagctccgcctccacgctgcatccttcttgcctcctagcaggtggtccagggcttggctgtgccccattgctggtgatgttctgtttagttacttggtgaaggtggagtttgcttgatttcactgtaaagttacttggtttccgtttgctgttaacacgtacttaaagaagatactttgagtcaatataaatatcttgatatttgcttctccttttctccctcctttccttcctctcttgtccttctctgctcatctctctcagtcttttcttccttttcttctcatccatctctgcttttcttttccctctctccctccctcattctgtcccttgctgccatgtctccagtttggattatggtttcctattttattccatgcatataacctgttaccatcattatttatattgatgctcacatagtctcaggtttgaccagtgggaactgtgttacaccggcttgcttccctgtgtcttttgattcgtcctcatcattcttcgagctgcagaggacatgtgaataccgtgcctgactttctggctggtaacccaggctggtcaacaagatgttccaggcttaccttgcatttccattgtcccagcttaagaaccagctgtttgtccaaggagctctggttccttggtagtggagaggggtatttagaaggcaagatcagggccgggcgcgatggctcatgcctgcagtcccagcactttgggaggcctaggtgggcagatcatttgaggtcaggagtttgagaccagtctggccaatatggcgaaacctcgtctctactaaaaatgcaaaaattagccgggggtggtggcacacgcctgtagttccagctactcgggaggctgaggtaggagaatcgcttgaacccggaaggcggaggttgcagtgagcggagattgtgccactgcactccagcctgggtgacagagtgagactccatctcagaaaaaacaaaaacaaaaacaaaacacacacacacacacacacacacacacacacacacacacacacacacaataaggcaagataggatgaggtgtgctcagtgctgctggggtgttcctgcttccaggcactctcagtgttcacacctggggaattggtgtatgtgtgtgtatgtatttatttatgtatgtgtctctgtatccatatgtgtctatacatgttgacatgggtatttgttttctgtctatatcagtgctgccagatagaaatataatgtaagccacatctgtattttcagaattttggtggctgcaataaaaaagcaaaaagaaataggtagcactgattataataatatattttacttaacctatgcttttttttttttttgagatagggcctccctctgtccttcaggctggaatgcagtggcacaatcttggctcactacaacctttgcctgcccggttcaagtaattatcgcatctcagcctcctgagtagctgggactataggcttttgccaccacgcttggctaatgtttgtatttttaggagagataaggcttcgacacgttggccatgctggtagcctatgcattttcaacaggggcattactgctcttgagggggcaaaaatcaaatctttggggatgaagaaatattcttattatgaattatttttagagacagggtctcactctgttgcccagactgaagagcagtggtgtgatcatggctcactgcagccttaaactcctgggctcaagggatcctttcactacagcctcccaagtagctgggactacaggtgtgtgccaccgcgcccagctaatgttttaatttcttgtacagatgagagcttgcatgttgcccaggctggtcttgaactcctgggctcacgtgatcctcatgtcttggcttcccaaagtgttgggattacaggcatgagccactgcagtcagaagaaatcttattttcacaaataaactacagatgtgcatgccacacaaaacacagagacagactaggtacagtggctcacgcctgtaatcccagcactttgggatgctgaggcaggcagatcacctgaggtcaggattttgagaccagcttggccaacatggtgaaacccccgtatctgctaaaaatacaaaaaattagctgggtgtggtggtgcacacttgtaattccagctacttgggaggctgaggcaggagaatggcttgaacccagaaggcagaggttgcagtgagctgagatcacgccattgcactccagcctgggtggcagagtgagactccatctcaaaagaaaaaacaaaaaactcacagaaacagtgcacctgcagtatgaaaatttcatgcagggagggagattaggaaaaatatctgaaaagcctccttggagggacagtaacgaaaatgagggtgagaaacactcatcttgcgagcactggcgttcctgctgggcaggagccggggagcgtggggtggggtggggtggggtgggagccctggctgttagtgacagggactgaccgggagtgggacttgagggctgtgttgagtgggattccaggctcaggcctggggtcagtaggaaggacccggggctgcaaggacagcatagcctggcgttggcgaagagagagagttctctgccgagcgttgtgattgcaaaaatcctggcgttggtgtggggcaggatgagaccgggaggaatgctgggtgtgaggtgtgggggccgccgtgagagtgacccgtgtctgcctgcggtttgggacttggagatgggtcggggccctggcctcagggcggtggactcatggaggcaggaccttggtgggggcctggcgtgggtgagcatccgccccaccccctgtgcctctgttgagccctttcttgctatggggcgcaggtcatgaggatgtctcctcctggaggaaatcttccttgtcttcctggaaggacgctgggctctggcctgggtggtgggcagcgtgatgccctcttttgaggagacttgtagggacacatgtttgtccctgtgtccaggccatgtctgtgggctgtggcttcccagtttgaggggtgggactcccaggacagggacagcgttggcaacctggtggggccagtgtggaagaccctggctttatgcagatgcccagacccgagcccctagctgaggccccagcaggtctccctcctgactgcccctgaagtcacttccttctctgccggtgtcccagcccggccactgccgtctctctcctagagcaggtggcggcagatgttccagcgcaggcctggatggtaaatattttaggtttcttgagccagacggtctctgtcacgactacgcaactctccccttgcagcacgacagcagccctgggtggtctgtaaacggaggagcgtggcaatgctcccatgaaatttatttttgtagaatgaaatttgaaatgtgttatcattttcacatatcatgaaatattactcttacgcttcccccaccaccctgctcaaccatttaaaaacgtaaaaacctttcttagcttgcaggatgtacaaaaccaggcggcgggccctatgaaaccaggcagtggggcctccaaaaccaggcggcgcgccctgcaaaaccaggtggtgggccctgcaaagcacagcggccagccctccaaaaccaggcggcagccggagtctgccgcgccctcctgccccgccagccagagactcctgcgccctgtcctaggtcccctcttgtggcctcctgcccctccagccagtctgccgcgccccatcctaggccccctcttggggcctcctgccctgccagccagagtctgccatgccccgtcctaggtcccctcttgtggcctcctgccctgccagcctggttggccgtgccccgtcccaggtgcccctcttgcggcctcctgccccacaagcctagtctgcggccacgtgtgctgcagccatgcacagtttggtgctcctgccctggaggcaccctcctgccggccggccgtcgcccctgccgagtctccctggccttcggtgccccagcctcaggcacactggccaccttcctgtgcctcccagttcagggcctttcccctgcagttccctggaggggaaccttcttgcctggctcactgctgccatctgcttagaggcctgtcctgggaagcctttcctgcccccaggcctgctcgagtcccctgacaagggctcttggtcccccgggctttccccttccgggtcgcacagtttgttgcatttactgttccatttgtatctaaagcctttggcaggggctggtccaacagcaagtgctcagtaagagcaaagctttctcccaggccctcttcgtgccaggaagcgggctgagcgcctccatgacccccacccccgcccttggggcagtctagagggggctttgctctcagccccattttcctgacagaggccgggctcctcgtgtctggaatgacactgccagaaagagatccttggaaatgcttggaaacacgatgagtggcccgcaggggcggcagtggggaccacactcgcttggccacacatagcatcttcttggtggccgtgtccctcgagctcaacctccttgtctgaaatgggatgacggtggccaccttgcagactcttggaaagatttggtgcaaaaagtgtgtgtctggcgcccagcgcagtttctaccccacagcagggcccactgagcctcaggactcggcaccctcaccccgagcccggcggctcactcccagtgaagggcaccggccctcacccgccgcctgccctccctcagcatcagagcagagtgcagcgggcggcctgagggagtggctctcttcctgagactgccgcctcactacccacctctcttcccctcccctctcgccgccaagtggaaggtgaagccctgggcgcgctgctgggcgcacctggacactgcacgggtatagtggggggtgtggtcgtggtcactagtgcctgtctgcagaaggaggcattctggggcaagcagaatcaggtgagccagatggtcctacaacacctaagtctgagatggggaagggagctgttaatactcacatgaggaccatgagtgaggaaaacctgctggcaacacgggacgctgaagaaggggcctcaccccgtctcctgcttctccccagggcctcctgggtttgactgggcgaagatggggcacgtgcaggctttgctgttggcagggtcaacagcaagctgtgctagtcctcagcaaatgaggtatttagatccctgggggcagggtgatggcggagagcttcccggaggaggtggtacttgagatgccctgaaaagtagatggcttttggtagctaagggttggagacaggtggttgttctacagagagggctctgtgtggccacagactggaggcgctgccacagtgcttcatcctggatcattgctggaaggggtgttgcagtttttgaaatctgcgttccagcagcagttggggcagaggaagctgcatgccaccagctctgatgagtagagacataaggcagcggctgccgctcactgcagagctcgacctggctggcactgggccacctgcttggtgttcttccctctgccttgcaggggatggtgtttccctgcagcagatgatgagtctgagacccagggagatgcgtgatagaaggttccagagaggtggccatgccccatggctggtcgggcagctgggtgatgatcagcctctgcggtgtcagggtcgggggcagcaccccagtgccctggggaaagatcttgttgccagggcccctctgccctgacacatgccctttctctattctgggtgggtttgtttcaggaccgcccagcactggcacctcccctggtccttggaagactctgggcagcaccaggtgggggcggctctgccctggttaatggatgaaggagggacaggtgacgggccagtctgaggtcatgcagctgtgtgggggttgaggcctcgtgccagcccgtgcaggtctcttgcctctggagcgccattcacttcccccctccaccggcaaaatggccccttgggttggtgggaggttgggagacagagaaccaggtgcctgagtccagagatggccccagggctgaccagctctgccctctggccacatggcttccggtcctgggcctcctgctcccgggtggctggtggcccagcctgttctccaccctactctgtgtgtcgcgcactggctcgtggcattgagccgcagaggcagaaaccctgtgcttggtgttgctggctttctggagggggcacagaataaggatgaatggagagaggaagatggcactttcagatgagagagagaaggcaggcagaaggcagggctgccttcaggtgacgccggcaggctccctgatgaggtgacagggcggtggggtgcgcagctggcgccgccttcccctcaccactagcacctgtgctccccgaatgccgtttcagctgagtgagttcagctggggcctgttggggagctcggggccctggcaaagtcagcaggctgacagcaggaggtcctcgtgggccagaggtcagtggtggggctctgggacatggccggaggcggggccgggcccggattagtgcctggctgcctgtcctgccggcggccgtggctccgggctctgtgtctctgctgcaggaagtcttcatttgcttgtcctccctccctgtcaacatcctctgtccgagttccggacggctgcggcgtccgctccttcctgctgccctgggagccgagccgtcctcatgcagcccctgcctggggacccatctcctctgggcctggcttcgtgtgtggttgggcactgagcggccgacacattcctagggtggagaccgcacacacagcgttgagcctctgacagccgcgttcagatcctggctcagcacctcgtggcagacccgtggcgcctctctggaccctgcattctccgctgtcaaagggggtattttaggagcccctcccaagggttggccgaggacccggctgtcagcccggtgcctggcaagtgggaagtgctcggcggacatgtctcccagcccctgcagggtggagccatgagctcgcctctccgacaccaccacccctggcacgaaagctcttccgaagcctcagtgcccctccccatgtgcccacttgacgcggctggggtgggcgctccgggacctgcagacctgctctcacactggggtcaggagctggctggaggagaccctaaacccagcgaactcccctgccctgaccccctcagctctgatgagcccccttcttcaccggggccagccccaggctcaggtgcccggtttttggtcccctgaagcttcgtgttctgaaggactctttgcctggagctggggacgctgtttggcttctgaatccaaaagataaacaagaatgacaaatacaggaccgtggaggggacaggactgggcagtgggagcttgaactttgggccagactgagcggctgcgcccctgagttaggtctcctgctgcctggcagctgcaggttttgcaatcctgatgctgctggaaacagtgtttctgttttgtggggttcatctgtcagtctttacagagtttgtgtaaggatgaagacaaatcattctcacagacctactccttgtcccctaggccagcttggccctgaagtcatcagtatttctgttggtttgttttgtacttttgggttcaaaggcagcgcgaacacgcggtatctttccgtgacccgccaggtgcttgcgggctgtggccttcccaggattggggagcccgtctccaagtttcctcaaggcctcccagccctgtgttctttgaaatctgcataggggtggggagggggtgcctgcctgtcttctgttgttaaggactttaaaaaatgctgtgttggctgcctccagggtcatccttccacagggggatcctttctgcagtggctggagtaggagagggtcccccagcctgcaatggaggaggtggcagtgagatcctcctagtggaccctgggaccagcatcctctggccggcgggccagggagggcagtttccccagccctgcccagccctgcctgtcctggcctcaccctcgaacaccgtgtgcctccccgctcctggtcttgaatgtgtgtccagttttcagccacatttctgggatcatcacatttgtctcatacacgtaggacatctccagaggcagggggcgtgggagctgcgtgccctagggcaggtggacgcatacacgtaggacatctccagaggcagggggcgtgggagctgcgtgccccagggcaggtggacgccccatcccctttgccagctgaggggcagaggcctgaggtactgagccacctggacttggcgtggccttcctgactcaggtgctgcccccttgacctcggctgctcccccgagttttgaggcctatgttttggtttttctgccttgttctgttctctggcgtgtctgtggttggcgtccggcaggggctgcaggctgcgtgttgaggggcaggctctggacacttgcctgcagctccaatgtcccacctctgactgttgtcaggaaccagaggtgccaggtgagtgacagctgtcgtggatggggatggaccgcctgtcatgtcatttgcctgggtaagtgacagctgtcatgcgtggagggtgactggccccagggccattgccacgtgtccccggtgcacaaggtgcctagacaatccttgtctggcaacattctgtgtcccaggccccctggggtggcggaaggttctagtccttcatgctcatgagcgccgcatcctgagaccctcctgccctctgtgactgggccatctgtgcctccctcccctaggccccagctcatctttctgctgggacgggagagagaaatgatcccgcagtcattttggtgaaagccaagacccccttcagatctgagctgttccatctacagctgctgggctgctcctcaaatggacaccaggcacccattggatgccggaggtcctcgtgggatgctgggggggcctcactctgcctgaagtccctcttggttttatttgttttcattccagagctggaaggaggcaggcttggggcagggcggctgggcgtggcctgggcctggagctgggctccgcaactcccagcacctcagcctcgctgcgtggtcgctcccctctggccgcagtccctggctgtaggagaggcacccccttcagccttggggtgtccaggcacagggcagtgtggttaggacctaggctggagtcctggagctgctcacactgtgtgcttttgagcttgaccttcctggagcctcagtttccttctctgtaggatggggataaaaggagtggcttcctcagtggatgaatgggggatccacacagagtccgtccatgcagtagaatatctgtggatgaacctggaaaatggaatgctaaggcggggaagccaggcctgaaagacaagtcccacgtgattctcttaaaacgtccagaatagcagctccgtcgcaggacagaaagccagatgcgtagctgccgggagaaggcgctggggagagagttctcaggggcttgggggtctgtttgccaggcatgaaaaagttccacaactccatagtgcggaaggtttgtggcattgtgtgtactttaccacaattaaaataaatagcctctcccttgtggggaatgaaggcctcgtttcatcaactgcaaccccgaggcagagcccatcttcttactagggctccaatctagggtctcactgtctcctcctccatcgagggtgaggccaggagaggcagggctgggcggggctggggggactgcccccctggactgctggccagaggatgctggtcccagagtccactcaggatctcactgtcgcctcctccatcaggggttgagggaccccatcctaacctagctgctgcagaaaggatccccttgtgggaggatgaccctagaggcggccaacatagcattttttttttttgaaatggaatctcgctctgtcacccagtctggagtgcagtggtgcgatctccgctcactgcaacctccgcctcctgggttcaagcaattctctgcctctgcctcccgagtagctgggattacaggtgcccaccaccacgcctggctaatttttgtattttctttttttttttagtagagatggggttttaccatcttgtccaggctggtcttgaactactgacctcgtgatccacccgcctcagcctcccaaagtgctgggattacaggtgtgagccatggcgcctggccaacatagcatttttaaaagtcccctgacaagagaagaagtgtgggagggttggaggagacccgtctgccttcctgggtccctctctcctgacaaatattgaaagttctattctgtgactgcataggtataaaggtgaacatacaggtatgagatatttaaatattctcttagagctcaacactctcttggacccagggcactgtgcctctgtgttcttgggtgagcagccccgtgtgggcttcccttggccatgccaggcaggctgggggctcagagactttggagggagctagactttgtgtcctttgtcatttctcagttgtgtgattttggccacatcacttctgagcctcagtttccttatctgtaaactggggctgttgctgctgctaatactttccgcaatacatgtcgtgttttgaaaattgaggggtttgtgtgagtgacagtctctgcccagggctggcaagttttatttaatcctgttttgtaaggctctgaggctgggccccccagaaacagaccccaagatgggaggtaagccaagtgtgggaggccaggtagggagggagagaggcagataacattgacccagcaagttcctgctgtgggtgacaggcttggcccactgagcactgagcgaggatatgggtttgtgtccagccctcctagctcctggtgggggaggccatggacatggcgggggtgccggggcaggctggggtgcctgcctttcctagtaaggggatgggttctgcctcggggtaggagttgatgaaatgaggccttcattcccttcattctgtgaaacggcctgttggtgctttcacctgccttggttggcgtcagcaggaaaaggccgtaaaaagggccttgagatggaccacactcgctctgggccatgacgcacgctgggttctgccaggggcatgaatcacgtggaaggccctgcaggagggtgggtgaggcccgctccccacggtaccacaaggtacagaccttgagggaaactgttggcctgagagattggaggttcttggaagacttcgggggccagtcagaaaagtgagtgtcctgtctggaagtcctggaagcagaagccttgtgtgctgacctgtctgtccatggtgcagtgctgggtgcagggcgtgacctatctgtccgcggcgcactgctgggtgcagggcgcagggagtgtgtggattttctgagtgggtgaatggcacagtgaggaagaggaccacgttaagggagctgtttccaagtccagcttggaaactgtagcttgctcatgcctttgggcaacttgctccacctttctgagcctcagtttacccatttccacagtaggaaggtggtgcactccccgtcccccgggtggatgtggagtggtcacacctgacacagggtgcaggtgtgtgtttggcccagcgcaaaagcaggtagcaaacggagaccactgctgatgtgactgtgctgctttgtgccctggtcacctcacctgacgtccactcccacccggcgagtggctgcctcaaggggaggctggaggttggaggggcactgtgggccgttctgggaccacctccctgtctaggcccttgtgcaagggagctggagttgtggtgggcctgggtattcactcacccagcaagcgttactgaccgctaccccgtgcctggctccgggcagacaggcagccctgcttgcggcccaggaggacacaggcagataccacacaggcagtgtggagggagtgtgaggagacgctgggccctgccaggaatgtggcagcgggtgggtggggcagggtctggggcttcctggaggaagtgaccttttagctgagccctgcgtgacagtgcgccaggtgagcgtgaagggagcgttctggaacaggttcacaacaccccagcccccaccttcctggcctggtaatctggggtcaggactctgacctgctggatcctgcttccacgtcctcattttcctcctgaattgccatgttgtttttctgccccgaggttctttcccagcagtcagctgagtgggaatttgatgcttatcccaaggcctgggggggccctgcattttgtcttcctctttagggacacgcaggtgtcctttctcatgatgggggtgttgatgggtgggtaggcgtgggtagccacacactggcaatgtcccagggacaaagggcgagggcgtcacccttgtgcggggtatctagggttcctcacctgccaccttgatcactggaattgggagggagagtgtcgtgttattttgaagtcatcttccttctctgtagggcgtgcgtgggttgggcactgtcagctcgtctgcgccagcttctttgggtctccttcctctctgggagtggttttctgcaccgctgccctttgcagatggccttccggggagagcccacctccagggtcaggaccagaggccagcggcatagggatgccggggtgacaggataactctccagtcctgcccgggggtcatgggagggaggctgatgttaccatacaccagaagaagcctgttctttcctggttgtgggactttggcacgtttctgaactccgagtttcgcggtacagcgccagtttttcctgtgcagagtgggtgtgaggatgcagggggttgacgctctgggcgggctgagcgctgggccaggcgggccagatgccagacagatggtggcattgaggtctcttcaactgtgtgcagacaggggggcttgcagatcccctgtgcccatggaccttccttgggccctccgtggcactgggtcttcactgcccgctgccttggtaccaaggcagggctccctggggattccttaccgttcccatctctctccaggagggaggctggttggtgttccaggcaacggcttccccagtgccctcctcctccgcctcccacccttcccttagcatcttcaaagtggtgatggggagcttctccatggacttgtgagacacccctcatcatgggagtagccagtgcctaactcaggttaagtgatgaaggaagatgggtccagtgggcacgtgagatctcgggccacctgcatcatgcctgggccttggttgcctcatctgtaaagtggggccatcatttctgcctgacgcctccaggagtgggtgggaggagggcttgggcgggtgtctgcagtcaggttcccctcgctggagtgagtggcaagagcctccgctgccttcggatctgctttgtgaggactcttgcgggaggccctgccgatgactctgactgtctgtgctccatgctctgggtgacaagttccctcttctgtttcttaaggagatgtttctcaggggggctcaggcttgcaggaggcgggccgcccctcggctacatgtgtctgcgggagccagcggcaaagagtgtttgcctttaataatgacatgggctctccgctgctttctttgggtgaatctccatttttctgcattagctaatgacgcagtgtgttcctggagcctcccccacccctgccctgccccagcatcgcagcgcctgggctgcaagcctggagatgttcttagagaagggtcggacggacgggtgcccagcaattcctgactgtttagttagcgggagctgaggggcgtgcccgctgaggacaggtgccttatctgggagtgaaaaaccacgtcaataaatccaggccataaacctcacctttcgaagcagtcatgtgtgtgttttatgggttggctgatctgtgcggcccgaattcttggcagcatgaattcttgggactttggggtgtgtgtgggtgtgtgtggctatggatgaatcagaatggcctttggggacaggaattggggcttggtctgcatccgcgctgtgtgacctggggcagaagacttcccttctgtgcctatctgcatctctggtgaatccgggccatgccgtccacttccttgaggttgttttctgccctttgaagtgaccaagggctcggggatctgcagccccaggggccttttttgcctgcagaggtctgtgcactctacggggatgctgttggaccaggagttgccctttctgttgggggaagccctggccgcctccccattgtgattcaggacccgggtggtgcaggtggccccaggctgtgggttttgttgacagctggggacccgtgactggctcagcccacaccctggaccagctcctggggcccctgtcctgccctgctccttcccacgctggccttgacccttcatgtcagcagcctccacatgctggccatggttgtcctttgcagtatgaaatgggtggcctgggcaggaggccagtgtcacagtcacgactcacctccccagtggagcagctcaggccccccagcctttctctggtgttgccgtctggtggcctgggaggggtgggctggctcctgggctgcccctctgtgtgtgtgtgggccgtgggcctggccaggacagtttctaggctagagagtcattggcgtagaacatgtggccccctcctgggttcctggggcacagtggagtcaccggtcccacggtgcctgcttgcggctgcccctgggctgccgtggcgacccagatggtgacgatcaggatcagttaaacaccgaggggccaagtgggtctgacccccagagggctttccctgcccccgacaggcctcacagcagcagttacgactgttccatctgcaagctttggagactgagggtcagagggcacacggactctgcctgacttcgttgggggaagcgatggtgggagtggaacccggggcttcccggtccagaccttggtgtccccactccccgcaggaggcaccgcgggctcctgagatactgtgacttgcacctgtaatatatatatattttttatttcaaaaaggaaaagatagaattttcacacaccattcccttctcatgcaaatgaaccttgggagaaattggcctgtcatctctttgggtgtattttgtggtaatttagctgcttaaacgaaacatctgttaaccagggagagccaggctgtagattaaagcaagagtacagaagccgtttgcatttactgtgattgaggagtggcctgctagttcagggctgccctgcagatggacagacgagaccatttgacacgagaggctgtggggcaggtgacaggcccgaggctttctgctgcctgcccctggggcctgaggagaggcagctttcttgttggtagctaggccagaggctggggctgggcttcgaagttggaggtgctgggccagcaaggctgggcccagggaaggagccacctccatctctgcagccccacatgtgtctgtcaaagggaccaggtacaccaaccacagggctgtgggtgccgtggacagcctcgtgatcgccactgccacgcctctgtgggctcctctgtagaacgggctgtgggggtggtcaggtgaggtctggtgaggtcccgtgagcctcggtggcctcgtgtgggccaaggtccctggctcccagcaagcaccgaacgtggtgccatcccccagcctccgcttgggaaactgcctttttacgagacttgtattttcaagacatggcgggcgggggttttcctcacatcgcttgctgtgtggggtcatcgggtggggcccttccccaggccttcctgtgcccagggagctgaggacctggcacttgtgagtgattggcccttggggcaagggagagatggttgagactcggtctctccttcaaggagtcctgcagagtctgaggggagcgggaggagtgtggccattgtgggagctgttgagtgggcagggagggtggaggaccaggatggcaggagcagcgggtgctgaggccagggggtgcagaccaccctgcacgtctggggggtggcaggaactctgagtcactgccttgaaggctgcagggaggcagggccggcttcatcctgggtgtgccagggaaccctgggcagggttggtgcagatgtggcgtgctcagatttggctttggaaagctccactgtgtctgcactacagggacacctggagagggaggcctggagccccagaggctggggcagaggcagatgggggtgtccaggctggggggtggggagagaagtgggaatggagagagatggacggccccgctggagcgcaggaggagtgggtgggcttggggtggattggacttgggtgatgaagagggtgctctggggtcaggcttgagcagtgcgatggacagtggggctcatctggagttggccctaggggttcaagtcccccactggccaaggttgcagggatgtctgggttctcccagcagccttcctggaatccgctctggtcagggttggggtgtttcagctccacccctgaggttccctggttggcctcaggcttcttgtctcagtggtgctgatgctggttggtgtccaggtttgctggacttgaaggtgggaggtcagtggtcttggtgggtctggccccagcctgggagtgaccaaacttagcagcctctggcactgtcagatccctggagagagacgtctgattggcacagactgaattccagatcctccctccttccctgttcgttgtattctctaccatgccagcagcgcagccgtgagaagccgcagttcatccggcaggagggaagcaggtgcagaggctcgtcctcgcaggcccggcgggcacggtggaatccagctctcgtcctcgcaggcccggcgggcacggtggaatccagctctcgggggaagtgtgaatcccggcatgtgggattcatctcaggcaactagacggctttcaccgacacccggccaaactgcctcaaaacccaaaacagttgtctcttatttttaagtggtttttgcctgtggaaagagtggtttttcttagaaaagggcactgccttagattgatttttgggggactcacttattgctattgatctgttaaagctttaatcgggaaatagcctcgtggtggttctcagtgaggcacatttgctgcaaccgagggtggctgtgctgtcgcgagccgctgagccagccagccgggggtctcgagacaccctccagatctgagctggggacagggccctaccccggcaggtcccaggagtgagcccagggctgacagaggacagtgccatggtctgaagctgcacgagaggcagaggccgatggtggctctctctcccggctacaaggctctgtgatgggtcagtgtgtggctggaggatgtccccaggcagccccagagcccgggtcgtgtaggctctagaggaccggcagctctgtccaggcccccggggatggccccatgggtagggaccctggggaccatgggactggccccgagcgcgtttctcttcctcttcatgttgcctggtgcatgggtggtaccagagctttgacaactgcatctctgagcctctcttgccttttggtggtgtttttcccccccacaaccttttcaaatgtattatttatttatttaattggtacataataattgtacgttgtttatggggtatgtgtgacactttgatacacatatgccattgtttatggggtatgtgtgacactttaatacacatataccgtgtgtaatgatgaaatgagggtcattaggatgcccatgatcccaaacatgtggcatttctttgtgttgggaacatttcacgtcctctcttctagttattttgaaatatgcaagaagttatcgttaactgtaatcctcctgccgtgcttctgagcactaggactcgttcctgtctaattgcatgtttgcccccattaaccaatctctcttcactttcctgtcgccccacccagtctctgatgtccatcattccactctgtccctccatgaggtcaacttttttagctttaacatatgagagagacatcatatgatatttaggttttttttttttttttttttttttggttatagagtcttcctctgttgcccaggctggagtgcagtggtgtgatcttggctcactgcgacctccacctcgtgggttcaagccattctcctgcctcagcctcctgagtagctggtactacaggtgcacaccaccacatccggctaatttttgtatttttagtaggagatggggtttcaccacgttgggcgggctggtctcaaactcctggcctcaagtgatccaccagcctaggcctcctaaagtgctgggattataggtgtgagccactgcacccggcccatatgatatttagctttctgtgtctggcttttttcacttaacaatgacctctagttccatccacattgctgcaatgacaggattttattctttttcatggctgaatagtattctattgtgtatatatgtcacattttctttatccattcattcactgatatttaggttgattgtgaatagtgctacggtaaaggtgggagtgcagatatatctcaaacactgatttcctttcttttgtttacatgcctggtggtaggattgctggatcaggcagatctctttttagttttttgaggaccctctgtactgtttcctatagtggctgtattagtctacgttctgaccagcagtgtactagtgttcccctttctccacatccttgccagcatctgttgatttcttgttgataatagctattataactggggtgagatggtatctcgttgtggttttggcttgcattcctgtgatgattagtgatgttgagcattttttcacatgcccgttggccatttgtatgtcttttgagaaatgtcttaataacagattatttacccgtttaaaaatcagattattattattatcattactatttgctttttttttttttttttgagacaaagtcttgctcagtcacctaggctggagtgcagtggtgcaatcttggcttactgccacctctgcctcctgggttcaagcaattctcctgcctcagcctcccaagtagctgggattgcaggcgcccgccaccaagcccaactgattttttgtatttttagtagagacagggtttacggtgttggccaggctggtctcaaactcttgacctcaagtgatctgcccgccacggcctcccagagtgctgggattacaggcatgagccatcgtgctcggccctgctattaagttgactttttttttttaaagttttaaattttttatgttttttgagtcaggatcttgctctgtcacctggctggagtgcagtggtgtgatcacagctcactgcagcctctacctcctaggctcaagtgattcacctcagcccccaagtagctgggacaataggtgcgtgccaccacgcctggctaatttttgtatgttttgtagagacggggtctcgccatattgcacaggccagtctcgaactcctggcctcaagccatcttcccgcctcggcctctcaaagtgttgggattataggcatgagccacctcgctggaccgagttctttatgtattctggttattaaaaatcccttgtcggatgaatagtttgcagatttgttcccctatcctgtaggttttctcttcactctgttgattgtttgctttgctgtgtggaggcgtttagcttgatgtaatcccatttgtctatttttcgttttgttctgtccgcttttgaggttttacccaaaaaatctttgcccagaccaatgtccggaagcatttccccaatgttttctttcagtagttttatggttttgggtcttatgggtaagtctttaatcccatttgatttgattcttgcatatggggagacatggaagtctagtttcatttttctgcatatggatatgcagtttacctatcaccatttattagagattgttctttccccactgaatgttcttggtgcctttgttgaaaatgagttgactgtaaatgtgtggattcatttctgggttgttttattccattggtctaggtatgtgttttgtttttatgccagtatcatgctgcttttgttgctgtagctttgtagtgtgttttgaagtcaggtagtgtgatgcctccagctttgttgtttttgttcaggattgctttggcacttcagggtcttctgtgttttcaatatgtattttgggattgttttttctatttctttgaagaatgtcattggtattttgataggaattgcatttaatctatagatattttggtagtgtggtcattttcaaattattaattcttcgaatgcatgaacatgggatgtcttccatttttggtgactgcttgaatttttttaatcagtgttttacagtttctcttgtagggatctttcacctccttggttaaatttattcctagaaattttaattattttgtagctgttataaatggtattgctttcttgacttttttttttttttttgacagtctcgctctgtcatccaggctggagtgcagtggcatgatcttggctcattgcaaccttcatctcgtgggttcaaatgattctcctgtctcagcctccctagtagctgggactataggttcccatcatcatgcctgcctaacttttgttattattattttttttttttagagatggggtttcaccatgttggccaggctggtctcaaacttctgacctcaggtgatctgcccaccttggcctcccaatgtgcggtgattagaggcatgagccactgtgcctggcctttcttgattttttttttattctgctagtccattgttggtgtatggaaatgctactgttttctatatgttaattttgtatcctgcaatgttactgaatttgttatcagttctaggtttttttggtggagcttttagggttttctatatctaagatcatgtctgcaaacagggacagtttgacttcctgctttccaatttggaggccctctatttctttcctgtgtttaattggtctggctagcacttctagtactacgttgaataagagtggtgaaagtgggcacccttattttgttccagttcttagagaaaaagctttcaggttctccccattcagtataatgttagctatgggtttctcatgtatgacctttattgtgtagaggagtgctccttctgtacctagatttttgagggtttttatcccaaaatgatattgaattttatcaaatgctttttctgcatctgttgagatgatcatatggtttttgttcttccttctgttgatgtgatatatcatgtttattgatttctgtatgttgagccatccttgcattcctgggataaatcccatttgatcatggtaaggggtctttatattgtgttgttggatttggtttgctaggattttgtggatgatttttgcatctatgttcgttagggtattggcctataatttttatgttgtgctaaaatgtatttttcattatacatatatgacatccattataaaaagcatacgcatgcaaaattatatatgttatatacataaatatgtgtattatatatatttatgcaaatgtaaatacatatatttgtgtgtatatatttgtacaaatgtaaatacatgtatttgtgtgtgtgtgtatatacatatgtgtatatatatatatatcagggctcactgcagccttgaactcccaggctcaagccattttcctgcctcagcctccttagtagctgggactacaggcgtgtgccactgcgcctggccaatttttgtatgttttgtagagacagggttttgccatgttgctcagactggtcttgaactcctgggctcacataatctgcaccttggactcccaaagtgctgggactacaggcatgagccaacatacctggcctattcatttatatatatgtatatatatgtatatatatatatatatatatatatatgaatgaataattttttttaaagtttactagtcttcttatcacctagaggagagctatttacatttaattgtggtcactcctgtttgatttacagaactgggctgtgctatactttccatttaggactcagcttttctcatatccttgcctatcctaaatggttttccatgtactttatttcattgattccaagatgacatagttttccttgcatgttctgacatctctgaagccagagtgggtcatggaagccttgtaatcagaggcataattagagtttcacaggcattttttcccctggcgatacataaaatcatgccatgtttcacgtgtgacagtccttggatgtgatacaacgtggcgttttatattcttgtttcaatggctttctggtgcttggaagttctggagttgaccagaccaagcccttttgattggatgcccacagccctgctgtgtagaaagcctaccttggttacccccaacacagggatagccaccctgagagctgcctgtcggcacgactggaccctgctggccgacttggagtgtggagctcacgtgcaggctctctgttgacacacacccttagcgagccagcttatgaggacaggctgcaccgtctctgcccaccctgggtgcccccagccctccctgcttgatggcctccgtgccctctctcccttggttctggtcagtggcgtttcctgggtcttcctgaccgtgctagtaatcctgggctgctgactctgctgagggctccgatccctgattgactgatcattaattgatacttactagaggaatactgtcttcacagagcctcctggtgctgggtcctggggaagctcttgtagcttcgaccccgagttctgccgggcaccatcccagtttccgtgcaaagggcctttgctccaagacataatgaccacctttaattaagttctaagatgcttattggtagaaataatcagtccaaaataaaagtgactgttaataaagctgtacccaatcacattattgactaaagtggatgaaaagtcaaacctcttggcgaaattgagatttgcaaaatttgctctggaaaaagaagacttttagcagccatgaaagaacctcaggagggaggaaggtcagaggtctggggaaaacctaggaatggagccaagcgctcaatgtggttttgaagcagaaaagatactcttaataacataaaagggaaagttgaaacctgcaaaatcaaacaatgatatctcgaaaaccattcaaggaattaatgcactcggtagagctcaaatcaaatggtgctttcaatttccttaatgttgatgaaattatcactaaaatgttggtgttcacagccccccgagtcccagcaccgggagctttgtggggggtggggcggggaggggcttctgctaactgtgcttggagagctggagccaggcctgggtgggcgtcccagggtaccctgatctgcaggacccccgcagcagcccaggtgccctgggctgggggatgagcagcccctcaagacccaggggagtagggaggacccagctcctcccaccagctcctctctgcagggacacccgcacccctctgcctctggatagaaagcctaccttggttaccccagctgacaggggactgccactttgagagctgcttgtgggcatggctggactctgctggccaacttgagtgtggagctcaagtccaggccctcctagaagatggggcttccctgcatctccctcctgccttcagaagacactggtcattgaatctggggtccaccctgatcctgggtggcctcatcttgagatccttacctgttaccccttcatccccctctgtgcccaggagggtcccatagaggagctggtgggcagggtggggttggaactcctgtggggttctgtctgctcattccctccacccccagtgctgagccagctggctttgctatgtcagtgctaagcctctggcttccatgaggccatcaaggtggggatggtggtggctgaggaccattcaggaagagggtccccagcacccggcatgggggatgatgctgggttctggcaggggccaccgtggggtgaggagtcagggtgggggcaccctctgggtggatgaggctcacggtgagggtctccctgttcccagcctaggcctgcgtggccaccagaacgaggggccactctgctcctgtgggctccctggtgtacatcatgcaagcccgggtcttctccctgagccactgggccgtggttgtgtcctgtgtcttttctgcagctggcttgggagttcgcaggcaaaccggctaggggtttgcaatgggaagtaaaactggctgaggcttatgcgtgctctggggactggagcacctgggctgggcctcccaaaccagccccgtgggtctttgtgaggtcagagggcattatagaccccagagaggtgaagcagctgtgttcctgttgagcggggggtgggaaagggctccctccatgcctctgaccttgggtcactgaaacccgactgggttggagaaggggattccagggccctctggtctgcagccccagatgctggtgttcccaacctccgttcccatcagaagcctgaccagtttctgggtgcaaaactgcacgttgctcattccactgcccatggtgtcttggccacaggccgaagcttcagccctcattggccggcttgagtcctggccgggggtccctgggaggtctgctctgagagtgaggaaccctactcttaatggacactcctctgagatcaaaaggttgactattctgttggactgcagtgattgtttcttggggaccgcttggtgaatgaagccgaggtggccttggtccgtgttgggctaactaaaagcgctcagcagctcccacctggagagcttggggccgcccgtgatgtgtgccgggtgtgggccagtggaggcccctgctccctcacctgcgctcccaggcaggcgtcgcattgcaaggcggcagacctgtggtcaccattcctctccaagcacgccctcctgcctctgtgctcaccatcctcctgggcttctccaaggccggctcgagcacccttcccatgacggcctcctgccccgttggctctgtccccggggagcctggcaccagccagtgtggagtaggtggtccctgagctttacttatgagagttcttcttccctcagggaggctgcagctcctctctgggttcgggactcctgcgttccacaaagggtattacagagtcaggcagacaaagcgccacatgccggggctgggggaggaaagagcctggcctggatactgggcacctcccttttctgtgccagtcagcagggcgttcactgactcctagtgaacaggaaaagaatgcactttacttcccgttttctccgcagataagtccttgatcccctggcttgggaaataattggcggccgctattaagcggagacatgatttgggggagaggctttgaggagccactttcatgactcctcccatgcatgtgggagtcagaggctcccgtggccggcactcagggtcagcctgcagggagtgaggctccagtggggtcccccagctcccctgggcctctgtccagtgtggagaccttgccagagaccaaggagcaggtggccagtgcaggcaggaagattgagaatttaaactgagagatgatgaaaacccccacagataagaactttctggcccagcttggtcccggagggcgccctgacctcacagtgcacctgcagcgatgcctttgggaacgcgttgtcttgctgggatccgctggactgtcggccccagcttggttcatttgctgctttttcacagttctttctcctgatagagagtggaacaatgagcggtagccccggggcaggggcgatggcaaagaggatgcctcagagacgagggcctggcggttgtaaggtttgggggcacccgtgttcccggctctcactgtgtgctttgtggctgccacagcaaatgaccacaaactcaggagctttggacaacaaacgtgcattctcctccagttccggaggccagaggtccgaattctcagggacatcagggctgcagcccctccctccagaggcactaggggagggtccccctgcctcccccacctcctgcggctctgggccctccttggctggccagcctctgccttcatcttctcagggcctcatccctgtgcctctctcctcttctgtctcttaagaggatgctggtcattggattcggggcccaccctaacctgggatggcctcttcttgaggtccttacctcagttacatctgcaaagaccgttttcctaaatcaggtcacgtttggaggttctgggagtcaggacaagataggggacgtggtgcacagtccagcctctgcactgcttactctttcttccgtccagacggtcacggggtgcttggtgcctctgtgccctgggctccctggtagggaggggcaggggtcagagcctgccctgaaagctcaggcctgcagcagaatggggtgtgaaaggggtggtgagaggaacagcttgagaggtggtcaccctgggaaggagcagtctggcgcagagggtgggcaggagcttggggaggtcaccgttggggaagcccggagcggaggcctgagtgaggtgggtcggggtgcagggcctgggtctgtgcctcccagctgtgcctctcttgtggcttccgtgcagcagctgccccaggtgacagccaggggcttggcccagcaggttctgagcatctctcctgcagcctggggttgaggactgttggtggcagtgggaccatctctagtgcctatggatttgccattttcagtagctgtcagcatggaggagagctcagtcaggaaccccatcatctggggctgtctctgctgcaagccctgcctgggcctgggcccctggggctgtggccggtgcagtggcctgtgctgtttctcggcacctctcacttccctgggaggcccccaccgcctcctccaaaaataacacctggggcggggcagggagcacctcgcaggcctggcctgggaacctcgggttgtgactgtctcttcctgtgggcagggcccagggctttcttcctggtgcctggagcctggcacaaagtaggaccagacacaagattgaggaatgaatgaatgaaggatgaatggatgaatgcaggtggtgatggagctgtgctctgcagcatccttgttggctccactgaaggggtgggttgcccctccacacctgtgggtgtttctcgtaaggtggaacgagagacttggaaaagaaaaagacacagatacaaagtatagagaaagaaataagggggcccggggaaccagcgttcagcatatggaggatcccgccagcctctgagttccctttagtatttattggtcattcgtgggtgtttctccgagagggggatgtgtcagggtcacaagacaatagtggggagagggtcagcagacaaacacgtgaacaaagatctttgcatcatagacaaggtaaaggattaagtgctgtgcttttagatatgcatacacataaacatctcaatgctttacaaagcagtattgctgcccgcaggtcccacctccagccctaaggcggtttttccctatctcagtagatggaacgtacaatccggttttataccgagacattccattgcccagggacaggcaggagacagatgccttcctcttgtctcaactgcaagaggcatgccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtttaacaaagcacatcctgcaccgcccttaatccatttaaccctgagtttgacacagcacatgtttcagagagcacggggttgggggtaaggtcacagaatctcaaggcagaagaatttttcttagtacataacaaaatggagtcttccatgtctacttctttctacacagatacagtgacactctgatctctcttgcttttccccacactccaccatttttacttggtggagctcatcttggccataggctctcgggttgtgacagtcacttggagtggcccaggcagggtgtcccggctgaggtggggccagctgtgacggtgacagcgggtgcagggaactcaacattcctccatttcctgctctgcccacggggatgacgtccctcttgccctggaaggtaccaggcccgcatgtccctggcctcccctcctcgccctgccctgcagccggggaggcagggagctgggacacctgtgctgtcagcgaaggggcaccaggacgcaatatgccatattattcccagtagtcaaatatgtagaaaacaccacacacacataaaaaacccctaaaaacccagagtcaagagacgacagaaaaacgccctcagtggttagtggtgttttaggatgggagttcttgtcggtttcatgttattctacttccctgccctcatccaggcagggttatttctatactgggagaaaaaaacaaacccgtttcatcccagggagcagcgtcctgggcacacatccttccctggtgaaatgagaccggacctgcagcagctggtacaggggaggcccgtaactgccaggccgagcctcagtttccccacctggtaaagcagggacgatcatcctaaccgggagagcaccagagggtaggcttgcacagagtgaggaaccagagagacactggtggcgttggagagagtcctgggtaccccgggcaggtggggagctgggtggggagctgggcaggtgggtgggtgctgcagtctgccctttttgtgactgcaaacaggtgcgcccaggactggagttcagctccctgctgaagtaccagctctggcccagctttcctgcttgaggacggccgggtttcctgcctggcctgtcccccacagagggctctgtcccaggccctggcaggggcagcctccctcccactgggctcccgcctgggtgggggcggaaggcgaggctgcagctgcagcattcctgaccttggctggcccagctgttggcctggcagcagggaatccccctcccgctccctcgccccctggtgctctgcccaccagccgaggggcctggtgctggttcgcctggaatttccagaaagtacagcttctcagttgatcttcgcattttctgacttctcaggaactaactggctgcgtgctttttatacattcccaggactccctcctccctaacccaacccaaagctgagataactttttaagaaattctaaaagtaatgtctactcgttggaaaaaaaacaaaacgaaacaaaacaaagcaaaagaagaaacaactcagaaaggtagaaagacagagtaccctagacaccctttccccaccaggcccccagacccgctgggcccaaccccacagctgagaaccagagaccctccccaggggcttgggctgagggtcacagggtagggaggggctgcagggcccaggggaggctgggtagacgaggggatcatggcacctctggagatcatcgagttcctgacttgcagacctgtttttaattgtcagaacccccttccctccctctctccctgtgaaccagtgaggaagctccctccttctcaggaatccagggaattcattcagagccactgggttggggaaactgaggctccaggagggtcagcgacttgtccagcgtcacctgggaagctgtgctttgtgcctcctggccccgtgggctccaggtcttgactctgcgagtaagcagggaaggagcagatgggcagtgaggtgctggctgcccgtctgagagctccccggagcgggggcctccagcaggggccgtgcctttgtgctgagcggaagcggcaggaactgagcttcacggagcagcctgagctggagggtttagagggctcccctcgggctgggggaggccagagctgtggggaggagtggggaggagtaggagtgggagtggagtgcaagtgggggggtggggaggaacgtggggggggcgttggggggagtgggaagcagcgtggggggagtgggaagcagcgtggggggagtgtgggggagtggggaggagctttggggggaatggggagcagcatggggtgagtggggatagttggaggagcgtggtggggaggggggaggagtgggggtgtggggaggatcatggggggagtggggagaaaggaggtggggaggaccgtggggagtggggaggagcatgtggggaatggggaggagcttggggggcattggagggactgaggagcatggggagagttggggcagcatggcagggggagtggggagtatggggagagtggggagaagcaggggggtggggaggagtgtggggagtggggaggagcgtgggcggggagtaaggaggagtgtggggaccgtgcttccgactcagcttccgcagccaggagcctcgccttggcatcgggtatggggccacactccctggctgggcttgtggagggtggcatgactatgttgctccctgtggggtccccagaatctgggtgattgaaggtttaggacctgaaggggcaggagctccccacaggaagcagagtctggctggaaatggcctggtcaggttctgcccttcctgtacccttggccgagcctggaggcgacctcaccgctgcctcccatctgcaggggtgccctagtttctcatggtgtgggtgtctgtggggtagccggaggaaggagtgtctgccttcctttttcctcacctcagtgcacttgcattcattgcacgcaaacagcagtataatgaaaacgaagtacatttaaacaacaggaaaaatctgtttacatcttaccctccacctgtttggagttcagaatgatttatctcggtccttgccctcctgcagatgtatttttgcttagctttatttatcgtaatgcagacacacactgcacatacatacactggtacatacatcatgagcatgcacacatacatgtgcacacacatgaacacatgcacgcctgtacacccctaagcacctgcgcacccccacatgtatgtgcatgggcaccccacacgcatacacatgaggacacacacatcacagaccttgccctgctcgagcatcagcagcatcccccgcccgccccacaggtgtgtggcacatgtaagtgcttggctgcagtgccacagctcccgctccccccagcctcccatggctggacctgcgatgccttctccggaagccttcaggcgtgcgtggatttcactcagattcactgcgcacttgcgatgtgctgctgcggcactgagtactttgggtcctttccagcaccaggcgagaaagctccttgaagtgcaggcatctctcctgttgggcgtctcacgcgcacttgctcctccttgtgccttgccgccccatggtgacagaactgatttggcagcctgggccatgcatgcagggccgcaggccctcagcaggtgctggtgggcggatggacagatgggcagatggacagagggacaccaggcacatgccgcttctcagaaatccctggaaatgactgggatggtaacagaacatcacaattgactctttcttctcgaaatgatgggtgctaaccacggagtgattccccagcagcagacaggcgcagtgctttcggtgacggtttcggccgtgtttgttgcacgttgagaagggtgttttacatcccatggcgtgtatagtgctgggatcttaagaatgtcacacatgtgcagtgggttgtcccacatgtggagccacctgcctgtgcaaggggtggtgggaggcgctgcctgtcaggtgctggctgtagcctctggcaagcagtgggtttttctgcagagggaggacacctagggatggaggcccacaggtcttggttttggggtactcgggccaggtgccttctttggagacagggaggcagctgttggacatgcaggcctgggagccggggtcatgggagctgggtttcccagggtgggtgtgggggaccttcaggatttgaacctgcatctccctgccggaaaggtgccccaccctgtgcctgagccccctgtccccactcaagggtgtctgaagctgggccccatggtggtcagagggaactgggtctgaggttccacacaagtgcttcctgacttcccaccctgccagggtccctctggggactttgcttcccaaagagccctgaattgagcctgggggtcaaaaccacattttcagagggccccagtgtgccaggcccagggtccagggtctcccagctccgagccggggtgcagggcattgcaaaacccatgctggcatgaacgggaacaaagggtggaagaaaccaggagaactcttgcctcagtttctcatccaagccctattcattccattgtgtgcccattcatcccaaagccattccaagtgcctgttgtggtgggcttggggggcacagcgccaagggcacaggactgcctgccaccagctggccaccggagttgcccaacaaagaaccacaggccagcgccttccagcagcagccctggaggccgcgagcctgaaaccaaggtgtcagcagggctgtgctccctctggaagctctaggtgttggcagggctgtgctgcctctggaggttctagatgttggcaggctgtgctccctccaggttctaggtgtcagtggggccgtgctccctccaggttctaggtgtcccgggggccatgctccctccaggttctaggtgtcccgggggccatgctccctccaggttctaggtgtcccgggggccatgctccctccaggttctaggtgtcccgggggccatgctccctccaggttctaggtgtcagtggggccatgctccctccaggttctaggtgtcccgggggccatgctccctccaggttctaggtgtcagtggggctgtgcaacctctgcaggctctaggagaggctccatcctgccttttcaagattctggtggccccaggcactccttggcttgtggctgcatcatgccaatctgtgcctctgtcgtcacacggcctcttgtcttctgtcttctcttctagggacacttggatttagggcctactgggtaatctgggattatcttatctcgagagcctcaggtttgttttttttttccccgagacagagtcttgctcttttgcccaggctggagtgcaatggtgcgatctcggctccctgcaacctccgcctcctgggttcaagtaattctcctgcctcagcctcccgagtagctgggattacaggtgcgtgccaccatgcctggctaattttttgtatctttagtagagatggggtttcaccacgttggccaggctgttctcgaactcctgacctcatgatctgcttgcctcggcctcccaaagtgctgggactatagacgtgagccaccgcacccggccttgagagcatcaatttaattttacctgcaaacactgtttttccaagtaaggtcacaaataggcttctcagggtctggatgcagacctgtctccttggggcccacccattcaacccattacacttgctgttatggactgaatgtttgtgtctccccaaaattcctatgttgaaaccctaccccaaaatgtgacgttattaggagctggggccttttgaggtaattgggtttagatgaggtcgtaagagcggacccttcatgaataggatggtcccttttaagagtaccaaaagggactgcttctctctactctctgtggatgtaagggtacatctctgctgtgtaatggtacaaggagaagccactggaacctgaccacgctggcactgggcttccaggctctggagctacaagaaagaagcccctgggtttacaagcttcccgggctgtgggattttgctgtagcatcctgagcagctgcctaagactccaagcagataactacgcttcctgaagcctcactctgcccatctgtaaaatggggaaaccgcctctgctttgaggatcctattcctgcagcagagccgagcagcctaaaagccctgtccccagcacaaggtgagtgacccacccgtggtctggtgtcagctgctgtgggtatgactgccacccctgcttgacaggtgaggaaactgaggctctgagaggtgaagggcaggtcccgggggtccaggctgagaggggttctagtctagcgctcccagctcccacatatgggcctcacgaagcacagggactgctgaggaggaggtgccacattgggtccagctggggttgcctggcgggtgacggccactcaccagtgggtggggctttgtaggcacctgcaggagaggctccagcaggagctccaaatggggacatggcgggcatgagggacacttttcaggctgaaagccccacagtccctgttctactcctgctctgaccctgctgggtgccagctcttgttctccagcccccgtagttgcccgtttggcaattgactaagaagagtttttgacactttgctgtcgcatggctggcttgtggccttctgcaggggaagaggccgcctcccaccttgctgcctccatagccaagggctgtgcctgcctttggtttctgatcatagaaggaggctcagttttacccccctgcttgggaagctctctagtgctgcggttgcatttttccttcaatatttttagcccagcaggaagggataatagcgagaatcgttccttcagactggagagcgatcatccggtgtctgctggctgtgaagggatccatttggctttcattttagtgggtggtgggggaacgggaagaatcgcgccctctgcttgggtccgtctggagttggattgtccaattgcgctggagatagggcgctccagagagcgtgcgaatgccctcatgttgacctcggaggccgctttccggaagggggaagaaatggagaaaatgaggtggcagagacaagagcccgtttcacagatggcttgtgggctgcagcagagaggaggggctgaggtcctatgagagcaacccggagggccgaggcgcaggcgtgcgtctgggctaattgctcagagccaggtggccagagagtaggatttgaaccctccggcactcggaagccggctcagggaagatggttataaagagaaatactagaaaagcaatttactgctagctttatagaaaacctttggtttgaccctgaccttgaagtcccgattgtgtgggccactctttataccccccgccttggcttaaacccaccgtcggcagcagaggtgggtccttggagggcttcaggggagcaggcgtggaaagctgagacctctctcagctgctggctctgaacacgcacggctgggcggcggcctagcatgcagtaggtgcctcttattcggtgtctgactgtggactggaggcgggtgcagagttgaataggagcctcccagctgcccacctgctccactcagacttccaaatgaggcttctccagaattgatttttcttgctgggtttcctctcgagtgctgctgaggaaggacttgaccgtcaggatggagaggggcaatgctgcagcttggcctggccctgcctgcctgtgccaggggttgctgggcagccagagtgtctctcttttcttgagatcttgacttttcagcctttgagaacccactcctcatggctcaggggctgtggacagacagaccctggcagcgggtgggagccccagcactggggttcctggacttcacggctgctggtccttgctggttctcaccggctgggcgcttgaagtttgcagcagagctcgtttggaaatcaggctgcacaggagcagactgtgagaaaagctgagcgtgaaacccctaaacagcaggagacgcccgggtcgggggcaggtgttctgcctctctgggacctcctggccttgagccacaaagcaaccttgccccatccctttttggggaagatcctgggattctggacccagggctgcctgcgtgctgcaggttggagtttggggtctgagctctggtagcagacattttgaatccatgcctccggggccctgttttggagacagctggctgggccctctgagtcttctggcatcttctctgggaagcctgtttcccatctcgcagcagcattgcctggagtgtggtgagcaggtgacccgccattcgagggggcaggtacagaggaggagaaaggccatttcttcctttcatgagctgggcttgggttgaaagagacaaggtcaggaagtggggatagggaacagtgttcaggccactggaacagcacagtcaaaggctcagagccctagcgggtgccacgtgtcagccacgtgtctccagcatccagggcccccagcccaccttgaatgaaccaaagctggaaagctgggggtgggagtggccaggagaccttgtggaaagtgttggaaggcaccggaattgggtcagggcgtcctcggggaaggaggggaagtgtgcagagacaggggtccggaagcttgctaagggcagggacttgcctctgtgggtctgacttggagggcttcctctaccagtgccgaggtggtgtagtgcgttgtgagtcgcgttttggtagtcatcctgggaggtgccctgggaagcaggagggcccagcgtaagggaggagcatgtttctccccaggagtgctggtgtcagagggatggagaggcacccaccgacagagcctgtgtgcagctagctctgccttcacgcaagccagccgggaccctccctcctcccaggttgtccgcagattaggctgcctcttgcctatgccgtggggctcccatggggacaggaccagaccacctggattagacctgggtcttcccctcactaccctgatgagcagggtggtccctgagccgtttctccacctgtagaccagggatacgtgacagctcgttagcaggatgaagcagagaggaacgtcaagggcttcgtgctgcgccaggcacggactcagcgggcgctgtttgttatgggagaaagtggaagagccaccggacgttgttttagcacatcgagtgttagtgagactgagaatgctggaaacctttacagaatagtgaaacgagacacgctgttgttgcagccctttctgtcattcctgtggacaaatgtagcagccatggctcaagctgcttgctcttggtggggggagctccactcctgagggcacgcgggccgcctgccctgctgatctggcctgcccctctctctgccagtcgcctgcccctgacctgggggcaaggctggcccccgaagaccttgatatgcacgaagaaaacaccaccccactcctccagatcacagcaggtagagcagctccgcaccccagctgggcgaagggggacactcatgcgaggccatgcgcaaaggcgggtcaggttcattactcagcctgctggcctgacgccttggtcctggtgcgtgcggagctgaggaaatgggcccgagcgaaggaagttcaattgtccagacaaaatcaactcgtgacactcctcaatcaatccctggctgagctgtgctttccctgcctggagcagtgaatgagctggagtggcctcggacatctgccttgggagccccgcactgcagcctctctttaagggctcagtgcggtctgagcatagtggctcacacctgtaatcccagcactttgggaggccgaggcaggtggatcacttgaggccaggagtttgagacgagcctggccaacgtggggaaagcctgtctctactaaaaatacaaaaattagctcgtcattggtggcacaggcctgtagtcccagctgctcgggaggctgaggcgggagaatcgcttgaacctgggaggtgaaggttgcagtgagccgagatcacgccactgcactccagcctcgttgatgcagtgagactctgtctcacacacacactcacaaaggccatagcgcgggggccctggtgatggcctgggaagcctctcagtgttcatgatgactgtcaagttagaccagtttgtttttttttttttgagacggagttttgctcttgttgcccaggctggagtgcaatggcatgatctcggctcactgcaacctccacctcccgagttcaatcgattcttctgcctcagcctcctgagtagctgggattacaggcatgcgccaccacgcctggctaattttgtatttttagtagagacgaggtttcaccatgttggtcaggatagtctcaaactcctgacctcaggtgatccacccgccttggcctcccaaagggccaggattataggcgtcagccaccgcgcccaacgacagaccagttttaaagcagatacgggcctccctgagtctcggtctcctcatctgtaaaatgggtgataagggaccacccccgccccctgctagagtggttattggatctgaccagctaatgggtccctggtggggtggtgtgtagagttgtgcaggtgacattgatgtgtgcaggaataaggggtcgaggccagaccctacctttcacctgcttgcttgttttcggaagagatgcttctggaagcgaggttgccacctaagcagcagtggctgtccttgggggcccctgacgtcttggaaggcatcgtggactctctgctgcttgaggagaaagcagggccctttgagaggtgtcagcagtcagaggacacctaagagtgcttcctagacattcattcatttgttcattcattaattcattggttcatttgttcgtctaccagatactgagcccgtgtgatgggctaggcattgtccagggcatttgggacccagagggagcaaacggcgtcagctcctgtctccgtgagcacctggccagcctgtcacccagggtcacctgtttatctacctgatgggccccaaatttgatccattccatcaagctgcatctgttgaatagtaatcaagctattttaagtggtttttggaatgagcatggcataaataaaacaggaaattaatttgttttcccatttttttattgatcaaagacatcctcagctgccagtcagagcttctgatcagcacgacgcagcattgtggccccagggagtcagcaccactccagctggaagcagagcagccaggcgtgcaatcggtctctgctaagcgcagtgttagtgacacttgttgaagtatttcaagaaaacgcactatgtctatctatgtctgtgggtacttcctggagcctttgccgcagggcgtggaggctgcacatggagacccccagcttgctcagaaagacccagaggcttgaaaagagagtgcctgttctcctgaggcccagaagctgtggtgccctgttgctttcagggctgtggtgcccaggttcccttttgcagcaaggagcacatggggtgggggtcttcacctcccagttgctgggctgctctggccatgagcagagagcctgaggccaggccccagaagtcccttgtcggcctgtgtccctcccccagtccctggcagctgccttgaggagctctgctgcgaactaaaggccagcggggtggcgggctaacagctccagggtgggaccatggtgatgaagggcccaggttctcgtgcactgtggctgctcctcagctccagctaactgtggcaccccaacccccctgccagctctcccagtgaccaatgtctcaggggacttctggacttccccagtgagatggcctcagtacagtctctttgagtgagagtcccagcatcgtgggagtcagagggcagggttctccttgcccattttacagattgagaaactgaggtacagagaagctgtgtggctgttgagtgggagcaggcctgggttgtccccacctggagcacctgctgtggggtctgcactggaatgtggttgtgtgcaagaggccagggggaggtaggactgtgcaggacaggagtcggtggttcagggatgccagccagagacctgggaggagccctgcctgttggtgacgatctacatggatggggaaggttgggccaggcgatctggagaccccagcttggggctttccctgcaggaccccacccccagctgagtgccactcctgggactgaggacacccgggcccctgaccttcctggtggggcagccaaagggactttcccgggcatgggcctgccagaggctgggggcatcctgagaggaaccgggcctgggttcagatcgcgggtcacctgccttctggggcctccatttccacatctgacggagcaaatgtggatgtgaaagtgctagtgggctgtgaaatggcgcatgcgtgctagttagttattatgtgccgatcaatcaggtcagccccctcctctctggccccattcctaagccttggtttctgtgggtggggcctgcccctcaagcccaaaggccgggctcctacactcagtgcctccccatctcctctgaacagactgagtttttgtcaaagtactgttgtcattttaaaaaagaaaaaataatgggatttccctgcccagaaacccatagacaggatagcttagaggccagcagtctggccttgggggtcaaaccatcccagatccattgttagctcagttacatccttgctagtgaccttgggcaggccagctgacctcctgaaacctcagtttcctcatctgtaaattaggaattgctgcagtgactcaagggagctcttagcccagtgcctggccttctggaaaacctggcggccgtggagcgcctataatcactgtgagtcagcgcaccgagacgcgtagccagtcttggccggaagggcctggagctctgtgccagagcctcactgtgcacatgaggagacttgcccgagctctcctgggaggagggagcagcgagggtcacctcccataaaggtcagcccggccccacgctcctcctgcatggtccagctggggcccaggagtcagcccctgagacagtgtggcacctgccttgacgacgcaggccttgtgctgccgtccttggcgagacaggactttcttgcatccccttaggcgggggcctgctgcccttttgcatcccggccactccatttgcccctgaatcctgggcctacccatgagctcactgcttggagcttggttgtctgtctgtgcagtgggccagtgcacacctcacaggctctgcaggtggtgagtgagttggctgttgtgcacgtcagcatcctccctgcctgtggtcattgtcaggctctgctattactccatcaccattgcccaggggtcgatggccaagccacctgtgttcaaactgcagctccccagctgaggcctgctggctatgtgactcaggcaagtggatttgcctcccccggcttagtttccccttttgtacccctctcaggtcatgccggctagatgccagctctggagggcgaggcaggcctgtcctgtttcccactccagcactgccggtgacccgttgccagtaaggggcagtggaagggcccacataggctgaagggcgcccctgctctcggtgggctgccgtgggttctgcagggcagagaggcctgtccctgccattgtgtccccatcacaatagattgtttcagagaccctaaagagacgtgactgtcctgtgagcatgtgagcttggccggtgaagcttgccatccaggatgccctcgggcctcacctgtggctcagacctgggctcctggctctggggtcttggctctccggccctgcgccgcctctcctgtctgtgacaccccgccctggcgccttgcaagagctgaaggacagtgcagctgaacctggggaggtgggcgactgggcatggagcctgtgtcaccacactaatccgatttcagcctgattagatctgcggctgccgatgaatgggccggagagaaaggggctgacgtttccagggcacactacacgctgcctctcattgcagcgccagagcctggacaagggattcttggggcccaggggcgggagccctccctgcagtctggggctgtggggagcaggaggtggggtagcccatgccccctcagagtgccctaaacaaacacagtggggaccccatagccgccagcctgggggagagggcactcagccctgggacccttgtcacagggcttgttttctggggacagacccttgctgtggccactcagctggacttaaagtccaggatgctgggggaagcagtggctgcctttgtggggggtcccgaaggccaggttggatcaatgagagagaagaatgccgcttgctcctgcagccacaggtgacagctgaagccagccttcatagcttgggcgtggacaggggacttttcacctggcgctgaccaccatctgggcctccctttgccactgtccctcggcctgtgtcctcagtgggcccctgtggccatgatgcacctgcagcaacctcagccttgggtccggtccctgccaaccgtcagggtctctgtctagaacctggaccttgaggctctgattggctccagagcgaccacagaccttgcaaaccaggccactgaggaaaggggtacagggatggcaggagggacctggtgcctgcccacacgcccgtcctctcagagggcctttgccctggccgatgtcgacatggcttcattcttggcgctgccgccctctggtcaggtgcccacgtccttaactctctgtgcctcagtttccctttgtggaaaatgggatgaactgtagaaagcacaggaaatgctccctgaagggaggccgggccgtgtgtggcctccctcgaggtggagcctgacgtggcccccaggctttgtcccggtctctgccatccccgtccgtgcagtccctgtccctgccatctgcatcagcctgtgtggctcagttttgcagagaccaccctgggttgggcccagagctgcaccaggaggacttcttaaaggttagggtggccagagtggccacgggtggggccgggccaggcacagcagttgctgggcccatgggaaaggggtgcgctgggcccatcctgtgcccgaaaggaagcctgggcctggccggctgtgattatggttgggatctgtgtaattaactctaaacttgggaggctgaggaagaatgaaaataaatgcttagtggaaattacagacaagccatattcaaaaaatagtcacgccaggctggaagctgcagcacatgcagccgcgcagatgagcgagagggcgtagcccctgccccggctcaggcctgctcccagctccagtgtctggggctgtcctaaccaagcaccatcgaccgtggtggctttaagcagcagaaccttattgttcccagggctgcaggccagcagcctgaatcaattgtgtgtggcagcaacagctccttcgtggggccacggaggagagcccgtcccacgccctctcccgcttctggcaacggtggccacccttggagtggctggcccacagctgtgtcactcccagttgctaaggaaaggggcccatctcacatgcactcctcgtgggtctgtgtctccatgtctctctgtgtctcttctaattaatctttgtattgtggtaaaatacacataacgtaaaactcagtgtcttctccggttttcctctagagcaccgtccagtagggtcaagcacattcactttgttggcaagcaccatcaccaccatccacagaactctctggtcttcccaagcaagagctctgttccccacgaaaccaccccatcgctcagcccttcgagggcgcccactattctcctttctctctgtggatctgacgactccaggggcctcatgaaagtggaatcacggcctggcgtggtggctcacgcctgtaatcccagcactttgggaggctgaggcaggcagatcacctgaggtcaagagttggagaccagcctgaccaacgtggagaaaccccgtctctactaaaaatacaaaaattagctgggcatggtggtgcgtgcctgtaatcccagctactcgggaggctcaggcaggagaattcgcttgaacctgggaggcagaggttgtggtgagccgagatcacaccattacactccagcctgggaaacaagggcgaaattccgtccccccccccccccaaaaaaaagtggactcacacaggatttgtcctttcatgtctgtattcttcagaattaacaggtcgtgaaaaacaaagatcatggagtgttttagactcacattgtctaagctagcagttactagccacatgtagctttaaaatttaacttaaaattagcaatctaggttttcagtagccaccttttttttttcttttttttgagacggagtctcgctctgtcacccaggctggagtgcagtggtgcgatctcggctcactgcaacctccgcttcctgagttcaaatgattctcttgccgcagcctcccgagtagctgggactacaggtgtgcgccaccacgcccggctaatttttgtatttttagtagagacagggttttaccatgttggccaggctggtcttgaactcctgacctctagtgatctacccgcctcggcctcctaaagtgctgggattacaggcgtgagctgctgcgcccagccggactagccacatttgagtgtttggtgggcacaggtgtctagtggctgccctattggacggtagatggatagaacgttcctgtcattccagaaagttctgttggaggactgtaccagattaatggagactgaagaggcatggcagcagaaactgtgtgtgatcccatattggaacctgggccagtttttttttttttttcttttagctataaggacattttggttgtcctttatatattagggaaatgcaagtaaggtctatagataagataaccgtgtggtgtccatgttaatttcctggttttgctgtaggtactgtgattatggaagaggatgtccttgttcttaggaattacacactcaggtatttagggataaaggagtgtcattactgtagttaatctcgagtgttcagaaacacacacacacacacacacacacacacacacacacgcacgtggacagagagggactctaggataaaacagatgagtctgttgtctatgaacagcagccgacccctgccaggatgggaggagtggcctgaggcagaaggggctggggtgagcactgcctgctgtgaggcagggtgaggggtcagcaggggcgtatgtcctggctgggggaccctccgctcccagggcgttctcagtgctgcttggtttacgctcttaggctctgattctgacgtgcactatgtctaagtctgtccatttgtctaaatttccagtgagcagggacaggctctctgaactgctcttggagctgggcagtttgtccataggggacggttattgatgaggatgacaatcctgggctcttattgggctgtgtgtgccacaccctcccctcgcgaatccccgtgctgagctggattggggggctgatggctcccacaccccagtgcccactctggtcatcagggcacatgattaatcccgtgaggcaggtggcggtagaaaaccaggcctggcataaccactcaccctggtctccctgctggagtcagcagacaggattccaacctggggcccgagtgattccagagcgtgccccccgggccacctcacctgctgccttataagtttccttaccaagctgtttctccacgaggactgggcagatggccgttccgccccagccaagccttccgcccctgtggcacgtcaggcgcagtgagggccgagagctcactggttggcagtgggcagagaggagatgacccatgcattgatttgggaattctggcttttgtgctccctccacccttccactgtagttggcacctgccactctctgggtcctccgtggcttcttgggggtggcccctggctgttggctttgtcacccgtgattaggaaggatgtgttggtgttgtcagaagcctcgtgtatgtacgcacgcctgtgcacgtgcccacgtgagcatgcgccatccattcttgttgatttaaggcttgcatattctgccccagctgtgactgtcggcctcgacatgtgctgggtgcgcctgggagagctgggttggatggtcatggagggcccagggtgctgccttgccgccctgacctacggttacggggagtggcgtgtcttctgaatgcacaggccttgggggttttgcagctatgtgatgagaaggctgggggcggtggtggctacaccctcggatgtggagctggtctgcctgcttccacttccatccaggcctggcttctcaccccccagccttgggacggggggtttcgtcatctctctgagcccatttcctccttgagaaaacaggaatgagcttggatgtgctggcgcacggaagccagagcttgctgctgttgctgttacggtttttacagagcttacagttttaataagtttttccttgccctccctttgttttttccctttagtttctgtgtttgaagaacatacgcaccttcctgaaagtctgccacgataaatttggattaaggaacagcgagctgtttgacccctttgacctcttcgatgtgcgagactttggaaaggtgagcagtcactctctccagcctcggtcgctcagctgtggtggccgatttgccggctcagcggcaggtgggccagatccatggagcagcctgattggctccaacacagagccagtggatttctgcaccctcatgtccgggaggtgcaggcaggtcctgttacaaacaggaaggtgtgaaagccagatttgtgtgtcggggctgggacaacgggatggcccctttctctctccagtcatggtgaggccaggcgtgacgaattcaggcgggtgggggaagagcagagtgcagacaaccctggccctgtggttctagccaggggatgctgagcatttacctcctgccctgaatcttgattcttcctctgagaatgggtcgaagttagtaccacctcctaaggggctggggagatgaggaggggaaagcgcctactgtgtgctctgtaaatggattatctcggttaccccgggacaagcagaactgtctctgactctgggaaggtattgggcaaagagggggtattctccagtggtgaccccgggaagtgtctctgtgttctcaggaagcctcacatggcaccagtcctgcatgcaggagccgggctggtgcacatgaggggaccctgaggctggcaggtgcaaaggccctgggaggctgtagttcattggtggcctcctggtgagcctgggtacagagggacgcaggggccacctgccttccagagcccagcagctccacggttactctttttaaatggatgggatcagggtctcaatagcttcctgatggattcggggctggacgccggaggtgctgacggtggccgaggaggccccaggcccccgcctgctgttgggctgcctctaggagacactgcttcctggaccaccgggagaatggatttccacctgctgatgggaagtaacaagatatttactgcctggtttatttgagcatcattatcagggacttggtatctaaggaaatgctctgtgaatacatgatttgtgaggcgcagagggaatttgggtttgcagtggcgcatgctgagaagtcggttctgagaggagcgtgtggaagtgctgcacggcctcaggtcaggacctggaacaagggcgatcccggagccaccaggcttggcgcttcccttcctcgctcctggaattctccagacgtgagatctggggacctcttcatgagcccatctctgtgtaatcatcgaatccttagaagtttgtgtcccttaaatgactcactgagccccctccctgcagcagcgcacctgcctgggagtttgatgccctgttgaggcctgtgggtcctgctgtccaggggcttgcctgctgggctggagtcagggaggcttgaatggcctgggcctgtttctttcctgtaagtggcttctcaattcctacagatttgttttgaaatgagttggaactctctcctgttccttccctgcaagcagcagagatgaatttgcctgcagcaccctgggtaatggagaggctgatggttctggacttagtgaaggtccttcagaacacacacacacacacacactctcacacacactctcacacgcgcacacacactcacacgcacacactcttgcacccaccccacacatgttcacactcacactcagacacacacagctcacatacacacacacacagacatacagtctcacacacacacattgacacagacatccatggacacaccacacacaaacacacatacacacacttgaacccgtcttccatgttcacacccacacccagacatgcacaacttaacacacacacattcacagacatacagtcacccatacacattcacacagacatccatggacagccccccaacacggacatatcacacacattcacacacacacagtctcacatgtacacacatacttagacactcaactggtatttatgataactgtaaagagaaaaatacaggaaaaccctggccaaacctacttcttggccaacagttaaaatgcagcgtattcagtatataatttcattttgcttttaatttgctatggcggaatgcagtgatgtaagacgtacataaatttggattaaactctcattattcaacttaccagctgtgtggccaagcagtttgcaaatgggcagcccttgtcatcgtccatggtttccagtgaggcggctgcggctctgaggggctgcagaaggggcttcttgtcatgctggcctctggtctccccatgtctcaccgtggcggtcagtggtggtgctggccaagctgtggcatctctcatggggagctgggagtagacggcgggtttggaccatgagtcatggtgtggggtgctgggaatggaggtgatgtcaccgtgcagacccccgggctgagctgaggagactggatgaggtccacaggaggtgtttgtgaagtgcaggttgctgctcctgccgccccccaccggtcgcttaaaacaagtccagacttccacacacagatggcagtgcctactgtttttctctccactattttatacataaagatgcaatggctgggtcgggcatggtggctcacgcctgtaacctgagcactttggaaggctgaggtgggcggatcatttgaagttaggagttcgaaaccagtctgggcaacacggtgaaaccctgtctctaataaaaatacaaaaagcagctgggtgtgctggtgggcgtatgtaatcccagctacttgggaggctgaggcaggagagttgcttgagcccaggaggtgaaggttggagtgagcagagatcacgccactgcactttagcctgagtgatagagtgagactctgtcttaaaaaaaaaaaaaaaaaagacgcaatggctgcacctttgggagacagagcaggtggctgagcacatggacttggaccccggcaggctggctttgagtcccagccctgccatcccagggtgcggcctcgcccaagtgactcagcttctccaagtcccatttgtaaaatggcggtgacactcccaccctcaaagttcccttgagcgggtcaagccatgtgtgcagggtctcagcaccgcacgtgccccagggccccgccactctggggccttgctgcttctggtctccgcatctgagccatgccctttgcctcctggagcccgcgtgaatgtggcctgtggtgtgtcagggacagctggctggggaccgggccccctgggaccgtgtgctgggtgctggcacacttgggagcaatggagccggaacccgcacttgcccttcagcgtgggcctggcctcggccccgccagccctgtctctgtggcggtgcttgcttccttccctggatgtttttcctaccgtggtcaagctgtggtcagcacttccaaatggagtctggcctggggccagcggaggctggggagctgggacgttcaccacggtctggagcctgacggttctgctctgccagcgcctcctggcttctccgggacaggtgttctggaaaaacaaaacacaagcaaaagcccagctcctccctgcggcctggtctgcccaggtgctcagactcctggggacctcttgctgggccggggcgtatttgttgcagtccctgccgtggacagaggggaggaagggtcagagcagggaggggacttgccgaggctgctggtctctggcctcccggactcccagcttgttgaccacaaggagccggtgtggagggcggggctgataggcctggttccttacttggccattccatgcatcggtccctctggccacagagatgaagagcgaatgcccctttcattttttcggggcatttactgagcgtttcctacacgtccagattcatcttttgtcattcatgagctcagcccagttgggacgccctggccattccaaatgagctcggcggcctccagcaacctcagaccatgaagatatggctgcgtgccctccccctgttcctcccacccttggcctgcccaggacgggggtggcagctgtttctccccagaacacaaagctctgcagtcagaactgactgtcgtctggggtgggtggggctggtcaggggtaaccgagggggtgtggggctggggactccagggctaccaggggcagagctgactctcttactccttgtctgatcggctcctacttacattcacagcattcagggctgaaaggagcctgaccgactggccggcgcattagtcagggccctccagagaccagagagacagaagcagccgggtagaggcagacaagaggggccgattaggagcatcggctctcgcgactgtggaggtggagggcccccagcaggctttctgcgaggtggagacccaggaacgggggtgacagggcttggccccagtcccaaagcctcagaaccagggaagcaatggtgtgatcttcagtctaaggccaaaggcctgagaacctgtggggcaagtcttggagaccaaaggctggagagcctggagttctgatgtctgggggcaggagaccaagagtcccagctccaggagagggagagggaatcacattttctctggctttttgttctgtctgagctcccagctgcttggatggtgccgcccacaggaagggcatctcctcacctgctcacaggccagtctcctctggaaacacccgcacagccacacccagaaacaatgcttccccggttctccaggtgttccttcatccagtcaagttgacacctaaaattcaccatcacagctggctggtgtctctggctggtttaggaaatgccgtttcccctattatttaaggaggtctgtggtgtttcagatcttgtctgggctctgggtttgttgtcattcattttctaaacagctgcctcccggctccccaagtctctcatgttgtgggagtcattccttgggaagacaaaaagcattcatttattcgttcattcactcatccatccatttatccatccatccatccatctatccatcatccatccatccagccattcatccactcaccatccatctatccatcaatcattcatctgtccatccatctacccatccacccatccgtccatccatccatccatccatctacccacccattcacccatccttccatccattcatccatccatccaccatccatccatccatccatccattcacccatcatccatccatccatccacccatccatccatccatcattcatccatccatccatccacccatccttccacccatccaccatccatccatccatccactcatccattcatccatcattcatccatccaccatccgtccatccatccacccatccacccatccattcatccatccactcatccattcatccaccatccatccatccacccactcaccatccatccatccatccatcattcatctatccatccgtccacccatccacccatccgtccattcatccatccatccatccacccactcatttactcgtccttccacccatccatttgtccatccatccaccatccatccatccatccaccatccatccatccatccactcatccattcgtccatcattcatccatccattcaccatccatccatccatccatccactcatccattcatccatccacccatccattcatccatccatccaccattcatccacccattcattagttcattcatccatctatcattctgttaagcatataatttaccacgtatttagtaagcacttagtatgctggagttaaaatgaggagactcacgtagtctttgccctcacagggaccctcagattagctgctgagcaattaatggtaggagagaggagtgagaaagtaaaaactctggagctttggccccgaggcctgctggctctggcccacaatcagccttggacactggagtctttcctctgtgattttatcatggaaaggatcattccacgtgttaaagggacactaacgtgaatgagactgtctccctctcccagggatggccccatgtggaggctggtttgaccagtgttttccctgctcatggccctcacttgctgcttaagggcggtctccgcccactggcccttgggttttttcttctgccttccctttgggacaggtgtagagggtttccttaacccaggaggagcattgggaggggacccaccatgagtcagcctggttccctctgctcctggcccctgccacctggggagacctgggcagcaggcagatggacccctggaaaccctccaggttttggagccctgggaagcctgccaggtggtccactgcacctgccttctggtgcctcctctcatccaggctcggtggagccaggcgggccctggaggaggcaggcgggtgagagcaaagcttccgtcagacctggacgcgagttggactctgtagatacttggtctcgttgagcctttgtttctgcagggatcaaatgaagcttgagactgtccccttggaggtgttgctgtaaaggactcggtgaaaaaatgaacggcaggtcctagtcatttttattagcattttcttcctcttcactcaccccgcaagttccagtaggaactaaaggatccagaaggtttattccggaagtgtttctcttctggctgctttcctggtatttttttcaaagggttgcattaaagagattaggttttggctcaaataagttgtgtccggcttcctgtgctgcccggggtgggcgtgctggggccgagttatggccgagcgtgaagggtgagtccgcagcccttgctgatgggagccgttggccctgctccccgccacggcctgtagatcctttcctgttttcctctgtgccctgtgtctgggcggtttgtccagttgcccagctgggaaggagtgtggagaagcccatgggtcgccagctctggcggcttcttccaggggctggtttgccccagcttggaatccggtcgggcatttggagggaggattctggtgaggctgcggggtttctgtggcttgcttctgagattctggtccctggactctgcagatcatgatagttccgaccgtagggactctgatctcattgcgagctgggactgagcacaggtctgcgggagggaaggaaggcaccccggcagcgcactgactgtttaccatgtgccgtggtgtcgcctgtgttatccccacctaagcaactggtgcacggtaacatggctgtgagtttcttgggtcctcaaaccctcgctgtcctccctccccaggtgcctggtcatggcattgtcattgggatccgtccagctccttcgcggggccctgggcaggtggctttccctgagcctgatgtcctctcctgtgacgtgaggacagtggtcccgcttcccctgttgatcagagcctcctgggcaccgggtcacaggcagctctttgttagggctggagcggggtgagcagagcgtgatgaggatgctgttgctctctccctttgtggggatagttgccattgacagtgtgcacttgcaccctaggtcaggggacaaagggacagactcgttcaggaggtgagggctgcacttctgggcagaggacagggaaggcagctgggcagaagggagggaagaaaggaggggagaagggaagagggaaggacgtgtttctcctgagcagcacagggtgctccctgcctgcaggaggggggccccctgggcgcaggtgcttctggttgtcagagggaaagctctgtcctccctggtccctgccccttgctccccctcgctgctgtggagctgcttcagcccctcctgctgctgggctctctggctgccccctgcctggaaggttctccccagagctgctggtgccttcccgctctcctgcaggcccttactcagctctggcccagcagggcctgccctgatggcaccttgccctgtgcggggacaggtttccgagtgaagtctgatgctgcttctctggtgtcccagcccaggccaccctgcctggccccaggaacccgcggtgctggctgggcagtgcacttcactccagcctcactcggggcggaatgaaccttcccagaggaaatcgctaggccgcttctcttgctcgagttaaagagcagcgcgcaccttccaataaacgggcttaattctcctatttattattcattaaagcattttgggaggctcagagacttctgaggcagttaaaactggctctcagcactgtctgggggtggctccatggctgcttacagattctgaagtgccagctggcgacgctggacgcacaccaccggtcacctgagtgccggcctctcctgctgcccctccctcctccacgggagtaatcacttgtggctactggacctttatgtccacgagcacctgcaccctgcagggaccttaagaagtgaggaaggaaacaggcacagagaagatgcatctcacgtgtgctctgcggtacagtggagctgggggcatcctcaggtcctgctgatgacaggggccccgtttttatctgctcggctgtgccctcttccctctgactagcaaggcagctgttgcacgcagcacagttgtctgtatggaaggcgcacggaagacggccaggatgccgggaggcagagaggaggccgggtggcagtgaagaggccaagaggcaatgaggatgccggaggacagtgaggatgctaggagccagtgtggaggccaggaggcagcaaggaggcagggagggtagtgaagaggccaggaggcagcaaggctgctgggaggcagtgtggatgccaggagggagtgaggaggccaggaggcagggtggaggcagggagggtagtgaagaggccgggaggcagtgaggatgccgggaggcagagaggaggccaggaggcagagtggaggccggtggggctgtctggggagaggaagtaaaaggcctgaccctggaggggagggcgctgaccagcagtctatagaggatgcagtgcaatgaccaccggtgtcggtgctgacggcgtcagtgcaggtacggatggttcccttcagctgagaatctcagaccactctgggccttctcaagaggctgggaggaggaagggagggcagggccctgctgaatcggaatagctccacttttatctgttttttatgtggcattttgctgacattttgcttaaaaaaagggttctgaagagggtaaaaacatagttggaaaccattgatccgtcacagctgaggaaacctgcctcctttgagttgggcctggggacactggcggtggggacaggccgctgggggcactggcagtggggacaggccactggggtcgctggtggtggggacaggccgcatcactacgtccaggatgagggagtcggctgtgcacctgctgcagatgatggacgggcagctgtggtcatcccagtccctctggccctgggtttgtcagcagctgagaggccccttggcttttgcgtgcaggcagaggggcccttcctccttgctggagtaagacccctccctcaccacttctattcctctcctcttctgcctgggacccttgtctatcagccttgggtccccctacccccgtggaacctcctggcatgtgctgtcactctatccacctgagccagggcaggcacctcgaatccatcctggcacctcccacctgtcagcacagcaccccagcaccctagcacctggcagtcaccaggagctggcacaatgggggaccccagtttgtcaccctggacttcccatctgctccccggttgttgccacaacccctgccattgccccttcccccaccacaaacccacccaccactgtccggacttgaacttgagggctcaggtgggagactgctggtgcttctggggccaggtgagagtggacccacgaagacaccattgagggctggggacaggttgtgatgccgaggatcaggccgtcatcaggacccagtttgtcccacaggttgcttcaggtctcgcagctgtcatttccccatctgtaaaatgggtctaaagatttgcctcccccatgccgagggctgtgggcgggagattccagatggtgccgctgcctgttttcatgggctgggtctcgtgaggaagctcctgggagtggtgctgtgattgtaccagccgcgtttgagcacgtgggtgatgaccctggcagtgggcaggggtgcatctgatggccattccagtggcctggagtgccagcctcacccggccagtgtatcctgccccacacccaccatccacctgccctgcgtctggggctggacaagtgtatccagatgccgtctcagccatgtcattgatttctccattttacatctgcgttgatgaatgtgtcccgcaggctctgtctggccaggggagaacacagcagtaaccttggggtattgatccagcaccccttatctccacacccaggccccgaggctgcatgtgtttgttcatttcctcttcgtatttgttcattaatttgctgagtgcagaagactctgtgctcacccgaggcctttctgccagtcggtctgatgactctgagatgctaatgctgcggtgagttcatttgcactccctgccttaatgctggcagtgagacgtgctagtctttgtagcagcatccactccacactaattacttattaaaatgcagtcgctcctcgctggggtggggagctgcctcaggctcccggcagagcccggcgcaggggctgttggcaaaggccttcagagtttctgcttgaaaacatttcctcttttatctgctagttgttgtcatttcaggacgttattcacccacccactttcagatgaacttgacaaccagatatgctgcacatgggcacagacacacacatgcacgcacacacacagacatacacacatgcacgcacacacacacacacacacggagtcggtaagcccatcggatgctgacccgccgttttataactggggatgggagaggtttttctctgctttcctttccaggcgggagccatgcccgtcattaacttcacactggacaagggtggagggtggttcaattttggtagccgagtccctacaggtctgatgagctgcgtgcctggaggtcaggctcagcccactgtgcttcatgtgaggtggctgagcctggcgcgccaggccaggaagcctatgggtctttgcctcaaccctgctcacaggatcctaggaggctgtgatttcaagacctgagttcaagctctgggagcggccttggcccatgagtggatcccttgatctccatgccagtggtgtgaggtagggattcttgctcctgtgccaggaaatgtggtgccaggttgggaacttgtacctgcttgagggtcattactgttggctttttatagaaggctgaggggtgaaggaatagaaaccagagtgataaacgcagaggggaggatctgggggccgcttggagtggggccaactccagacagaaaggcaagggtgcagggggtgagttggggtgctgggtgtgggtgtgtggccaagacctcaagagcagtgtttcagtgaatgccaggccccacgggccacctagcacatggatatccagttttcccagccctatttgttgaaaagactgccccgtggaatcgggacaagagcctctgggctgagcctctgctgtgttctctgaccgtgggtggcctcccatctcttccctgtgcctactacatcagtggaggtaggagcctaattgaagacttggttaatcctgatcgattggtagtggctgactggagggctcagctgagaagggtcccgaggctcagccattgattagcgttgtctgccgtgggtgtggtatgagagcatgggtacatgtgccaggggtttcccactcctgggctagctggtctcaggtttcgtgtccccagaaagaggagagagcacaatagctgaggggtgctttccagaagcctgccttgttcttgccaccactggtaaggtaggtcctgataagagcatgtgtagggggggactcagcctgagtaaagcaaggactggatgctgggtgggcacctgcagaagtgctgcgggtgtctgtgacaggctgcccggtgtttgcagaattgcattgatttttctgagatggctgaggtttggggagttgctatagttgtggccagggctggtgctgggcctccccatccctccacagtggggctgttgccaggagggtggtcctctctgcttctgtgtgctctgcttagctcagctggtgccaggacatgcagcctcagatgatcggagcctgggaagacagggagccaggggccactgcctactgtgcagagtgacagggactttggtgggcagaggtgtgttagacagttgagctagtcaaggagggcttcctggaggaggtgctggggttcgagatgtgagctgcagttcaccaggtgaaggtggtggtatgggaggtctcaggggcagcatgtgcaaaggtccagaggctggtggcggtggcctggcctgctcaggtttagaagggaggtctgcttggagtaggagactgggaggggcaggagctagggcagtgccagagagccctaccagagagatttggggtgctatcctggggttttcagaagggagacccacgatctaaagctgcaagccaggttgttggaattagtaataataacttagcacctgctgggctgccgggggctggcgccctggggagtgatgcccacctgttgtctcccttccctcttaggacttggctctgggaagaggggcctctgggtggcagtggtggcagcagcccacgcttcaggacgcactaggagcagaggaggtgtgctcaggccctgccattgtttctcattgtacgtggactggtcactgctctactccctgggcctcagtttccccatctgggaatcaatccatttggttggactggctggatgacctcttgggtgggtctttgtcacttctctttcctgtgagtccccaccccgttggctgagagcttgcattttcttagctggtcctggtgcaactggtgcatgcttttttttttttttttttttttttttttggtccatgtccacagttaattaagttttaaatggttaattgtttctccccagtgcccccaagacattaattgtgtctgttggagcctgacaatttgatgtttgcagcaaaaaagccaaatgagaccaagaaggagaaaagaaaaaaaaataccaaagtgtaagtaattaattataacgaagtgtcatttcttggcaccctggaagacctttctccaggagtactggttttttgaaggtagataggagtgggcggccagcctggtaccaggcatcagctgtggggtcaggcccttagggctggggaaggcagcggctctggaatgacaaagtgtgtggctgtgaacttgctgggcttcccagatccccagcagcaagggcagtggcgaaacatgcagattccttggccactctgcccctggggactttggggctggagccctgggtgatccttttgattctcaatctttaaaaaacattactgtgaccaggtacagtggctcatgcctgtaatcccagcactttgggaagccgaggcaggtggattgcctgagctcaggagtttaagaccagcttggacaacgtggtgaaaccccgtctgtactaaaaatacaaaaaattagcaggatgtagtggcacccacctgtaatcccagctacttgggaagctgaggcagaagaattgcttgagcccgggaggcggaggttgcagtgtcccaagattgtgccactgcactccagtctgggcaacagagcgagaccctgtctccggtggggggaagaaaaaattattgtgataaaataacataagagttaccattttaaagtgtgcatttcagcagcatcgaacagattcccagtgttgtacaaccatcccctctgtcttgttctggaattttttcatcaccctgaaacaaaatcccatttcctcttgccccatccaccagttcctggtaactactaatgcattttctgtttctgtggatttgcctgttctggacatttcatataagtggaatcctacaatatgtggcctttagcgtcggcttcttgcactgagcgtgaagtttcaggtttcacctgcgctgtggaagccgccagtgggtcattcctttttgtgactgaatcatattttactgtttggatcgaccacagcttgtccatctatgcacctgttggtggacactgggctgttttcaccttcggctcctgtgaatattcatggtcatttagtcctgagccctctggcccataggccccctcccttccagggctcaggagaccatcaccatgaggatcccaggagctgacattgccccttggaccctgaaggctgttcctcttgagggaagagctggtggtgactggcctcctagtggacgtgttcttgtctgagctcaggggcaggcctgctgcagtgtaggtgacttagtgtacagattggagccgtggatgaggtgaggctgggggctgttgtgattactgctattgttaactgtagcacaaataataagggccaggcgctgtggtggctcaagcctgtaatcccggcactttgggaggccgaggccagtggatcacttgaggccaggagttcgagaccagcctggccaatatggcaaaaccccatctctactaaaaatacaaaaattagctgggtgtggtggtgcataactgtagtctaccccagctactcgggaggctaaggcaggaggatggcttgaacccgggaattggaggttgcggtgagcagagatataccactgcacttccagcccgggcaacagagcgagactgtctcaaaaaaatgaaaataaaaataaataatgccttcaagaccctgctttgaattctttttttaaaaattatactttaagttttagggtacatgtgcacaatctgcaggtttgatacataggtatacatgtgcctgttggtttgctacacccatcaactcatcatttacatgagatatttctcctaatgctctccctcccctagtcccccaccccccgacaggctgcagtatgtgatgttccctgccctgtgtccaagtgttctcattgttcaattcccacctatgagtgagaacatgcagtgtttggttttctgtctttgtgatagtttgctgagaatgatggtttccagcttcatccatgtccttgcaaaggacatgaactcatccttttttatggctgcatagtattccatggtatatatgtgccacattttcttaatccagtctatcattggtggacatttgggttggttccaagtccttgctattgtgaatagtgccgcaataaatatacatgtgcatgtgtctttatagtagcatgatttataatcctttgagtatatacccagtaatgggatggctgggtcaaatggtatttctagttctagatccttgaggaatcgccacagtcttccacaatggttgaaccaatttacactcccaccaacagtgtaaaagcgttcctatttctccacatcctctccagcatgtattgtttcctgactttttaatgatcaccattctaactggtgtgagatggtatctcattgtggttttgatttgcgtttctctcgtgaccagtgacgatgagcattttctcatgtgtctgttggctgcattgctttgaattcttctggctatatacccagaagtggaattggtggatcatatcgcatagtagttctatgtctaattttttgaggaaactccgtactgttctccccagtggcgtcaccattttccatgaccaccagctgtgagcggggctcccatttctccacatcttcaccaacacgtgtctttttgtttgtttggtaatagccgtcctctgcctaggtctgaagctcattgtggttttgctttgtatccccgaatgattagtgatgttgagcatgttttcatgtgcttgttgaccaggtttacatcatctttggaggaatatctattcaagtcttttgcccactttaaaatcagattttgttgttgttgagttgtaggagttctttacatattgtggatattaaccccttatgagagacatggtttgcaaatatttgcttctattcagtagattgcctttcaccctgtggataagttcttttgctgggcagaagttttagagtctgatgtagtctcatttgtctgttttcgtttttgttgccggtgctgtggggttatatcaataaatgattgcaaatccaatgtcatgaaacttttcccctatgtttttgtctaagagttttatagttttagctcttatgtttaggtctttgatccattttgccttaatttaatttttgtatatggtgtaagataaggatccacctgcatcctcttacatatagctgtccagttttcccagcaccatgtgttggaacgatgattctttcccactgaatggccttggaatctttgtgagaagtcactcagccacgtacctgaggacaagtgtttggttcataatatacagcctgcgggttggcagccagaagccatcacctgatgggcaggaaggtaaatgctcacagatgaccaggtcagctgctcactgtgaaggggctgccccgccaagcccagctcttttctgccccgtgcccctacatttaaattgccccactctggcatcatcatcaccaggccccttggtccactgggcacatctgcttccccgtgggtgtcaagccccttcctgggtatgtgaagcccaggcaggtagacgctctggggtcacggctatgacagagccagagggaggacttctgcagggcagggttccttctcctagcccagccaggcatagcaggtgggtgctgccccaccacctcccaagactgggctggagaagcttcccgctgccacctggcaaacaaagcagagggagccgggtccgggtccccctaacagcgtgggcttggggtccagcaggcggggcccatcccgtgcctgcatgcatggcgtctgcaccagccaaacacacctgtgcgtgcgccattagctggcccactcgccctgccggtgccgggaagcaagcaggctgactactgcccatcaacgggattagaaccaccctcgcttccagtcccatcacgatcagaaccacactcgcatccagcacaattagaaccactgtgacggttcgtttccatgacggatggggctctgctgaaactcaagttcatccgcggttgatttcttatacttgcttaggctaggggtccttgtgtgtggccgagcccctccacactgcagaggctgctgagagcacttggtcaggggagcagggcctgggccgtatctgggcttattgtaggagttctttacatattgtggatattaaccccttatgagggacatggtttaatcaaagactaattatgaactatatccccaattagagtttctttccccagcctgcagggagaggcacagggagaggctgcagggagaggcactgggaagctgggtttcttcgagtgagacacaactttctttctttttttattactgtttttgaaaaatagagatagggtcttgctgtgttgcccaggctggtctcctggccccagtcagtcctcccatctctgcctcctgaagtgctgagatgacagatgtgagccaccatacctggcctgtggacgttcagtggtctgaagaagaagccattcattcactcatgtgttcattcattcattcagcaaacatggcgctcctgccatggccaggtgcaggggtggagtggtaagggagcagagcccacactccggcacgcacagagctgtcatctggtggggactctctggtgtctgagacagcaggcggagggaagtgggctgactctgtatcccccgccgtctcccctccaaggactcctctgaatagcctgccttcccctctcagggctgcacggcttcagagattatgcatattaagccaacgacatttattaagtaattggttttctcattttttaattaatcaaagactaattatgagctatatccccaattagagtttctgatcccgcacgatagcagggccccccacggagggcactcagggccagccaggaagcgggtgggccgaggggtatgagttagacttttggggatgttcagggtgcttggagactcctgggacatgaccttcagggacctcagttggggcccctttcactagtggaggtgcggccccgtgtcgtcaggcagccgcagcagcaggcggccagtatgttgcccagcactggcctgctgtggggagacagtgacagacagcatcccccgccttgagccgagcagctgagccaagcctcctctgtgtgacggggcctaggggtgggcgggacctggtcctggatgggtctgtggggcgctcagagggagggacacctggggagggggcacctcccctgctggtatcagcgacgcttttccatgtggcctcagggacctcagtgctcaggcctcccaggccagctgggcaggtggagggggcactggacacctctgcctaatgaccatgggctttcagtgagtgatccagtggtgtggttctgggccagcccagcaccgcctcttctatgaagccaccctggattgccccagcctgcagggagaggcacaggtgctcacatggctggcgaaaagcgccctcagctgtcttgcactgctgtgcagtggggacactgaggcctggtgagggccagggctgcttcgtggccctttgtggactggaggcagagcccggactctctctcctggcccttggcctccatctaggcctttctggggctgactagaaggaggctctcagctctgcctttgatggcagatccctctacctgctgagctgtctgctggctgcatgtgcaggagtgagtgaggcctggttctcggtgtgcggtaagagggagtacctgtcagttccccgtgcagctggaggatggggtccacactggggcccacgcccaggcctgtctggcctcctggcacgtggctcagcgcagagaacaggtgctgactgatgcctggggcctggcagagcaggactgggcaacgtggaaagcagccttgggtccgccgctgtatgtccagcagaactgactctgggctccgcggaggacatgcggttgggtggtgggtgaggcaggggtggccggggcggcagggacagtcggggcagcggggaccttccatcttccatgtctctgcctcacggatgccaagaatgcgctgtttgtgttgctcccctgagactggccacgtccatctggccccactctctgcgctgtttccggcttacattcctctctgatctgagactgaaatatttgagctggtggcaaaagtggctgagcatcttttctctcccaagatgggaggaatgttcaggaaaaacccggtgtcctggtggcttcccttgctgagtgggcagcccttgacccgtggcttagaacagcctagaaattgccagccgacctggccccgggggacagtgagtccctgggctgggagccgggacacctgggctcctggaacccctcacccagggctgtccagtgaggaggccccacccagtgaagcagagattatggtctgcagctcccaggatctggtttcaaagcccggtggggccctaagagtctccagcctttctgagcctctattttcccacaagtgccagcttagcaggattgctgtgaaactcaggtgccagccccagagaagcttccaggacagcaggcagttgtgattttacctttcagtggttggggagtgtcagaggtgccagggcacagcagtgagggggtgcgtggagaggctgtgggcagagccaggcctgatggagagggcggagctaggtcagtgaagaaagtgtgaggatgggatgtggggaagtctttaaaaacatggtggcggccgggggtggtagctctcacctgtaatcccagcactttgggaggccgaggtgggaggatcacaaggtcaggagttcgagaccagcctggacaacatggtgaaaccccgtctctactaaaaatacaaaattagcctggtgtggtggtgcacgcctgtaatcccagctacttgggaggctgaggtaggggaatcgcttgaacccaggaggcggaggttgcagtgagccgagatcgcaccactgcacttcagcctgggcgacagaacaagactctgtctcaaaacaaacaaacaaacaaacaaacacacacacacacatggcggctgcttcttgggaggcttaggagcccaggggttgagaatgggacttttggactcagatgggcctggatttgaggtctgcctgtgtgtttattaaaggcgcgacctcgggcatgctacatgactctgtgggcctcagctttcttacccacgaaatggacataacagtatcagccacgtggagttgtgaggcaggaacgaatgagctgccgtgaaggacttggcactgtcctggcactagttggggctcagagattccaggctgactcttacaatgggtgccaccgagaaggagtctgccgcctttccagggcccctggcctgggtttctgagtgtttcctggtggtggtggtagcccgggctagcagctgggcctgggtccggaccagcagatgaaagtgcgggaaatgcagacacaaggctcggagccagcgccgccttcctgctctctggttcgcttttctgccgccgcagagagtgcgctcctttgtttaaaaatagtttctagccgagctggaggcaccgagtcctctttagcatttccgacggtttccctattaatgtcactggaggaaaccaccctgagatgcctttcaagtggaaaaggagagctgtcctaatactgtgggcatatcattaggaaaagcaaattaaatcatgtttaatggtgttagagtctcaatcactttggaaaatggagttggtgaagcagggaaatgagaaattgctgacctcctgtggaaggaggtcagtgaaggagaatctgggagttgtgctcgtggaagtggcgatgggccggggcttagggggctggggattcagccgggagggtggggggaccagggcgggggaccagggtctccaggaggctgcgtcagttctctctcccactgtcctggtctccctcgggagggtgtgggtccagctagccttttctgtccacagggttctctctctgggatctgttcggtcctgtccttgggggcccagcataggtcagtgtcagatgggaccagcttagtccttcaactggatgcccggcctgggccagtcgctttcctccctaagccttggtttccccgtcaataaaggggaggatggcactctctcaggcaggctaggacagggagtgaggcccagagggggtaggcaaagtcccaactgcatggcctctgtgggatgggcagggcccctctgtgctgtgttgacattttcagtggcataagttttccctttggaggttatgcgtctttgtgacttactagaaacgataaacaaataaaacccttctagccaaaaaaaaaaaaaaagaaagagttttctgtttttctcatgatgggttcccagctctctgttaagtcaaaaaatattcagcttgacattccaccattagagaatcattcctttgacttgagagtttgtccctgtcggcgtaggtaatccattgggctccaccattgccttttgagtgctgagtttgtcacctcctctcctgaaaatgggttcacatcaggaacaggtaaagaacttggcccctggaagaggaggacggggatagggcccctcagggaagggagatgatttagtgagctctagggctaggctgtcataggcctctgggtggggagcaggtctggggcctgctgggtgggcttttgtgcaaagagatttgcagtagagaaagaggaaaacccagggtgggatgtacaggggacaggaccccgtgagagtggcaacctcgtccttattagtccttgctgagtgttcccaaagctccgggtttctttgtatgtgtctcatttaatcctcacatttgatggacggggacgctgaggcttagagggggttgggtgagtggccatgggtcacacagacaatggcagagccgggacattctcttcaactctgccatgccagcatcttccttcacaccccttgacctaaacagtcccaacatctgcattcagaaggtacttaattaatgctttttgcatggctggaggcatccggggtgtcctttgcaggggaaccgacaaagttgtgctggtcctggaggcccagccgtgagcctctagccaactctttcttccagctcagcttctgggatcaatacacaggcactcccggctcttctctctccctttctctgttcaccccctcctttccccttctccatccatatcaccagtgagacccccactcacccagccccacatcctcaaactgcccagcttcccagcaagagtcccagcacttcccagggtggcagagagccaggctctgggatggtgacgccgacgcttttgttagtcctgggcctgtgcgcccgggccctcgttggcacccaccaccttccctttctacaaagagggctttatcccgtggagagaaactttccaagtgaatcactgtcagttagcattcagcgcaagtcacaggctccgcgggcaattcatcttgcgcctttcttccttcttatcgagtgggaccaagcccagctcggtgttgcctgtccgcctcctccatggagccttggataaccccgctggctaggagcagagaggcgtgtttgagcaaagcccctccttccctccattctccctgggggagcagccgtggcctgtgcccgtttcctgccaggcttccttcagaagggaaggtgcgtgtgtgcacgtgtgtatcttgtgtgcatgtgcattgtgtgtgagtgtgcatgggtgccttgtgtgcattccgtgcatgtgtgcacatgtatatcatgtgtgcatcgtgtgagtgtgtatgtgtacgtgtgtgcatcgtgtgtacatgtacatcgtgtgcatgtgtgcattgtgtgtgcacgtgtgcatcgtgtgtgagtgtgcatgtgtgggtcgcgtgtacatgtacatcgtgtgtgtgtgcgttgtgtgtgcacgtgtgcgtgtgtgagtgcatgtgtgcatcgtgtgtacatgtacatcgtgtgcgtgtgtgcattgtgtgtatgtgtgcatcgtgtgtgtatgtgtgcgttgtgtgtacatgtacatcgtgtgcgtctgtgcattgtgtgtgcacgtgtgcattgtgtgtgtgtgcatgtgtgcgtcgtgtacatgtacatcgtgtgcgtgtgcacatgtgcattatgtgtgcattgtgtgggagtgtgtgtgtgtgcgccttgtctttgagactggcaccagtttttctaggggtcttctccatggagacaaggggcccagtgagggctcctgttttcagggtgctttgtaaagtgggcacagccccttgtccggcatttttttcagtagagacttcctcattgcaccacctgtgctccttgggagaaagtcagctggccgttggcaggtggagtctgtagaacgccagatcgtgctgaatccccttgaaaatatcaggttgaggggtgtggatggtggctgccgggaattcaaaaagtgtagtcgtgaaaccacgtgatcacaaggagggcgggacggtggtgtgggggctgactgtggcttccagctgtggatgtccccactctgccccaccatggagaattccctgatgtccccagagccaatgaggactagagtcaaggcgtcagaaagtgggtgtgaactccctgagccaggaaaaggggacactaatggagaacaggccggtgctcttccggccaagcggcctgtttcaaagcactccttggtgttttcaagattcccagacacagcacccgtgcttccctgctccctcccaggtccttccccccgtgcgagctgtcctgggtttgatgccgcttggcccagcactggtgtggcgctgagtggaccggtgaccttggtcacattcacctgttccaaagtcccaaacctccctctccactttgtggagctgtgggacggcaacagagatagagaagtgaatgccaacctctcccctcccctccccttctcccttcccctctcctcctcctctcccctcccgtcccctcctcccctcctctcctctcccctccccttccctctcctccccctcccgtgatccctcccctctccttcccctcccgcttccctcccccatcccttgcttcctcccctcccccctcccctgcttcctgcttcctcccctcctctccccctcctctctctctctggtggtaggaatacacacagcagaaatcccatcccttggcagccgtcacccccaccccatccccactgcccttggtcaccagagtcacacgctgcgcgccctttgagtctgcatcttcccctgagtgtggtgtcctccaggctcactaagtcagcgcttcgttccttcttctggctgaagaatattccacggtccaggtagaccacgttttgtttatccatccgtctgctgatgaacatttggggtgtctacatttcttggccactgtgaagatcactgctggggacattcgtgtcccggtgcatttctgaacacctgtcttcccatcctgttgggtacatacccaggagcgggattgctgggcttcacggtaattctgtgtctggcccagtgagtgctgccttttctgatgtgtgcttagcccgctgtgagacacatctgtctcgaagccccaggcagcccatgctgggtttggaggctggcctttctgactgagctggactgtccagggcacctcctggggcttagggtctcaggggtttgcggtgagcatcgtctttggttgcttgttggtttacgtttcaggataatgttaagtcatagccagcggctcttggagtggggaccaaacagaaaccccttcgaagagctccagggaggtgggaggcagagtctgggggagtggctgaggacagccaggctggcattgctgggcctctgtctgctgcgggctccacctcctgctcctcctttgctcacctgcttcccgaatatcccaccatggctgcccccaatggcagtgtcagctcccacgagcgtacagccggccccgaggctcactgacctgggcgcggtgcccaaggcctggcatctgagcatctccatggggttgggagttctcagtcgtggccctgctgtttgccctgactttgccccctccctgtaggtcttcagaaaactggcaggttccgtgatgagtgtcgattgtgcacctactgtgtgcgcgtccggtcccccgcctcctgggaccatgtgcgcaggctctgcctttggttttttaccaagggcagatggggcaaaggatcggtcatttctgcactttttggagaaaccgcccttgaagattctgattggcatccctggcatagaagcctccggagtggggcaccaggaagcgcgcaccacccctgacaaggactttggtttcttcttctcgctggtgtagtgaggtcccttctgtgctgactgccaggtggctggtgcctgcgatcgttcccaccttcctgtcttacctttcgtgtgtgtctcccgttctgtgtggtggcaacgcgtgtttttatcgtccttctcatgggggccgtggcgccagctatgagccgttgtttgggagcacagggggtgttccagcccagagtcaccaaaacactgggctctgggacattgtctcaccagaggtgggtgttgggggcgcccctctcagagtgccagctccctggagaggaagagggggcaaagggctccacccaaagctgacgtttgtcttggaagtgaggtgaggtttgcacggtctgcgaacagccctgggtgtgcagggtcaggctgggccttcagaggacagtgcctgcctcccaaacccggttccaaatggcactccaccgcccgtggactgtgctggctgaagttggattttcctccttaaagtcaccaggatcaggagccctgattctgatgaatagaagctatgtttgggacgagtggtcactggctcacaggacgactctgattttagagggacggaacgaggacaggacgattgtgattttagaggggctgaacaagtacttattagcttagtgcagaaataaaagaacacaactatcccccctaatagtcaaccaccggtgactgcagcccctgaggatggctgcctgacagcttgggagcgcctcgggagtgctgtgcacacgtggagaagagcatcacacgtgtaatttgtgttccgcgattgaaatgggcagagaagcaacacgttagggtgcaggaacctctccccgtgtgcccccacccccagaatttggctgcagctcccatgctcggacccagcaccagtgacatatgggtgttgatataccctgacatgttggggtacagatggaaaagcgccactgcgtcctggttccttcatctaggcacactgtcctccagaagcctccggctcgtttgtgtggcaggactgtggggatttggacggacatagcctcgtgttcagcccgggtctcatgttcccagacctggaaggccttcccgccttcttggaccatcctccggtgacggtgtcctgatgccgtaggtttctggtttgtctgttttgtactaaaacactcctggttgtcagcccttctcccacgtgtgttggaggccgggactgtagccgcagctgatctaagttcaccagcgggagctggtggctgtcctgagctcagctgacaccccatctttgaaaatcagccatctttggagggcagggaggagatcaggaaagatagctaatggatgccaggcctaatacctaggtgatgggatgctctgtgcagcaatccagcatggcacacgtttacctatggaacacacctgcacatcctgcacgtgtacccctgaacttaaaagttggaaataaaaaaaaagaaaatctgacttactttcttggcctgggcaatcctgacctgtggggctctgggccacgtgagagtgggtttggaggacattcggtgtgtggttggtaactggcatccctgaggctcttgctgaaggcctgtgctgacgagcagccctccccgcccaggcggaccttgtttaatgcgcttacttttggacatggcgtctttagtgtgtgtgtgatgcagaggtcaggaggttgatgggggagcaggaaagacgagttacctgatgcacagctaaagtgcctgccaccctgacttaggcctcaggagtgacactggccatacagtggggggtcaccagtgggcactagaaaacattttggggccggtgaatatgttcaccgtcttgactgtgttgacagtgtcacgggtgtgtacatatgtaaaaataaggacatgacactctctggagggtgtgcagcttatcgtctgtggatcatacctccatagaggtatggtaaatttaatacaggtctggtaaattcaatgcagttgaacgtcaaggtcttagtctcaccagccgcatttcacgtgtgcaggctgtgtgtggctggcggcccaggcatccgcagcacagacacggcgtttctctcttcacagaaagttctcccgggcagcacgctccagggcgaagggctggggaacgggtgtgttcctggtgggacttgcttagtgagtgaggcaggctctttcctttttagtttttattaaaaatgtgcttccggtccccagtgcacgcgtgaatacattcctttcggtaaatatgaaactgtagagatcagacctgtgctcccaagaaggggcgtgcccggccctgcttcctgcagcccatgtagcctggccaggagctggggtgctcaggaggccacggcgctcccagctgtagcttcatctctggctctgtcccatcactgccgtgacccatagacaaacacggtgtgctgggatgggcttgcggtctgcgggactgtgttagactcccgtgcccgcctctgtaccagtgcagacaactctgactgcatttctgtccccagttttctttttctttttcttttttttttttttgagaccgagtctcgctctgtcgcccaggctggggtgcagtggtgcaatctcggctcactgcaagctccacctcccgggttcacgccattctcctgcctcagcctcccgagtagctgggactacaggcgcccgccaccacgctcggctaagtttttgtaattttttttttttttttttagtagagtcggggtttcaccgtgttagccaggatggtcttgatctcctgacctcgtgatccgccggcctcagcctcccaaagtgctgggattacaggtgtgagccaccgcgcccagccttctgtccctgattttctagctgtgtgactctggggaagtgactcactgaaccttggcacctcatctgtcaaatgggcttggtgccggttacatgagagagcccaccgcacggtgcccccttcagtccagtgcctccatctggaaggtctgaactcgcagcttgcgccagttagagtaggcttgactgcttctaacaaaaaccccagtacatcaggagccgaaactcaccagggtttgttcgtcttggagggttgcaggtaggcagtctagaataggggtgacggtgccatagtctcagggacccaggtgcacccagcttcttgttctacctcttccatcctcatggtcatggttcacaatggctgcaagagctccagccatcacttcttcattctaggcaatagagagggctggggtgggggaagctgattcattgaagccgacttttcagaagctccagtcactgtgttaattcctctttattggccagattctagtcacatggcctggcatagctcgtgtggctcgtggggggctgtctgatggagtgctagcatagctggtaaggatgcaggggaggatggaggatgggaggcccccagccctgcccttgccctgtgagcagccaagcgaaggacagagagtgagtggcaggctcatccttcttggcacacataaagaatctgaagttaatgcatgtgttttgggatgtaagagggcatgttaatcaatggaaatattaatacaatcctcaggcgcagtttccaaatagaggagaggagtctcagggcagagtgtttcttccggcctcacacaccgtgtgtctgccatcttctgtaaggctgtctccccctctttgcccagtcggaccatctagtctgcaagctctgcgttcatgttgtcagtgacaaggaggaagagatagccgctggctatctcttgtggatggcacagccttccatcctcgcgaacctgcagtgggcacagatttgtgctaggcgctgttctgagcactctgtgtggctcattgaggtggggcccatagctggatggtatttagctccaggctttgtttgctgcagtagttgacctaccctgatccattttgcagatggagaaacagaggcagagagagattgttagttgctcccacagttagcagtgcgagaactgagttttgaacctcctgctgagctccaggactcaaactcagctctgtgagtggcttccaggccagggacttgggggaggccgctcacatcttcaccccccttctgaggaggcaatgagaccaaaacacccagcccaacctccccatgtccagatttgtctccaccgggagacagttctcggaatgagtcaataaccatcttcatcaaatgcttcctctgccaggctgggccagccaaatccatccttcctcgcgattgctaggggtgcctggagttgggtccctactttgcagttttgtaattcaaagttaatttctttttgagttcgatgttcttaccggatcaggttcattcccaatcattcctcgtgggtccctgccccttttagtggaaggtgtgagttctgtgtggagattctgggagcgcagctgcctgcatgcccactgggcccacaatggccttgccctcaccagattgtgggtgcctgggtccccacacattttcagaactgcaggggctgcaaaaccaaaccaggcaagcggttggaagtccgctcccgagggggcctgctcctggcacctggtttgtagctgcgtctgcctcagaggggtgcagcgctggcaagggcgtggggacgccctcccagcggttcccatagtggaggcgcagacccactacagcctgctgccttccactccctgagtcttcctgggccgttaggttcaaagattccagacttccaaggaagctctgggcttggtgcagggtgcctttgtgtaccaggtggtgctgtgggggcctaggatgggctgggggtggacaccaggttggggtggtcactgcagttggggggcgggtccttgtctggcttgggggcatcagggaaaggtctgagaggtgaggggagatttccaggggaagagggtgtgaggttgagtgaccgagggcccccactggggaaggacagggtgcccactggcctcgcatggggggtttcagctttgggtgtggcaatgctggggaacgaagtctcagtttctagggtggcattttccctctgtcttttcctgctgcgggtccaggctcaccccatctccgcccatctcctggccccttggagctcatgctttaagtggccgcaaggactatggtgccacttcaaaggggagggctacccctcactttagcctccacccagttccactctttggggggccagtgaaggaaggggggcttggtgggaggggtgcccccagaccctccctccactctctgggggaaggcagagaaggtagggggcgtggggtgggaggggcgccttcagaccctccctccactctctgggggaaggcagagaaggaaggggggtggggtgggaggggcgccttcagaccctccactctctgggggagggtggtgaaggaaggggggcatggtgggaggggtgccccaggccctccctccactctctgggggagggcggtaaaggaaagggggtggggtgggaggggcgcccccggctctccccactgtgccgtctgtgccactgcagttggactgccaatgactggcattctctttgttactttcagcctggttgtttcaaaactcattaggcttggcatttctttacaaaggctggcatggcccgagccgagcggagagtgggaattgatttacgaggatggcggtggatctaggaaatgtcagcgtcccctccagagtccataaatcagttttgattccagcgaggccttctcccatcccctaaaacatctcccagggggctttccaacgtggtggagcttaaagttagtcagccgaggagctagtctcctgggtttgctgaaccagctggattaaagagctttctcctgattctgtctccaggccaccaaggtcagctggggcgtggctgtgaggttccttctgtcttttgtatgagggacaagtgccagccaggatcggcctgggcttgaaccgtgatgggatggagtgaccggcatccgggaggggccttggggagcagtggccttcctctggtgtggcctgagggctctgagctggcctggtgggcttgttggcctgggcagggcagggcttgctgggttcgatggtctgtagggagcgaggatgaatttgaggtgctggggccgcatgtgtctgtgtgcccagcgtgggctggcaccggcagccatctccctgtcgtcactgctcttggcaacatgtttggggccttggctgaaggaggtatggacaagagagtgtggacaccagagggccacaccaggtccttgtccctccccccgccgccggccagccaggctgaggcaggcctgagggggccgagcagcatagcggccatcactcacggaggggctcgctgggcccagtggcaggccagggtccctgctcctgcaggtctctatgtctgtctgttgtgaagggatgggacggggcgagggtccccaaagtgtctcagctgcagtgacttgagtggcccccggtgtagagccatgggtctccgcacgtcagaagggagggctgaggacccagagcctggctccgcagggaccccgctgcccccagctctccaggcgccactgggttttgtgtctgtggttctgacttgtgagctgtgccaggttctgcggcgtgaggtcatgggtgacttggggagatgtggattccagttttgtgtgcagaggtccagggtgtggggtcagtctcttggcctcaggggtgccttgaggctccgcccaaccatggtctcatcagtgttttcatggacctggtttcattgccggctgatcgggcccagtggctcccacgtccttgcaggattgaagctgggggtcctggctggctctctgcagccttcctgcttggtgcagtctgagctgtcagtggggcgagtgggcagggcgggggcggctccccggaggactgtgatgggcctagaacttgcatttggagcaggaggggcaaatgacatggctcacattgtcaacaccacgattcctcccacactgggagatgtggctgcgtttaatagaggtcccctcgtggaaaacagccctgcgtttccatcactgtcttgggcattttgaccctggcagatagtgcaggcacacggtgatgtgtgcagggatgtttgaaggtccccacagagccccaggccatggaggggccagcacctgtagcttttgggatccacgccacactggggactgccgatacctccagacttaccgtctggaaggtctaagggtcaggcagtttccttgtaggaacctctttctttttttgtatattttgagacagggtctcactctgttgcccaggctggattcagtggcgcgatcatggctcactacagcctctaccgcccaggctcaagagatcctcctacctcagcctcccaagtagctgggattacagttgtgtaccaccacgcccggctaatttctgtatttttttttgtagagatggggtttcgccacgttacccaggctggtcttgaactcttgggctcaagtgatcctcctgtctcggcctcccaaagtgctgggattacaggcgtgtgagtcacctcgcccagctataggagcctcatctgtgctgcagccccagtgatccactacagaggtggctaccccccagggctggtcttcaggccccattgtccatcagctccccagatgtcacagggccctgagggtcttccaggtcatttctgtgctgcttcagtctccaggctggcaggaaggaagggcaatggcagtcggcagggcctaggcagctggagctggggagaagggatgggcatgttgggctcaggatggcatcatgtccttggtaggcccctccctgacccagagctgctgttcttcttcttttgtttctttttttttttttttttgagacagtttcactctgtcacccaggctggagtgcagtggcacaatcttggctcactgcaagctctgcctcctgggttcacaccattctcctgcctcagcctcccgagtagctgggactacaggtgcccgccaccacgcccggctaattttttgtatttttttttttagtagagatggggtttcaccgtgttggccaggctggtctcgaactcctgacctcaggtgatccacccgccttggccttccgaagtgctgggattacaggcgtgagccaccgcgcccggctgagccactgttctggctgtggtgctgtgaagtgtgggccagggcttggtgagtgactttgcacagggcagctgctcagagccccccgccctgggagaagcctccacgtgtggtgctgcccgtggcactgcccaagccacaagatgcaccctctcccttcaccagtgtcccaagcgctccctgcatcccctccctgccagggccccaagtctgactgcccagtgcagcagtgctggtgctgtggccctgtatggtggacgagggccaaaaacaccatcatttactcaggcgaaagagtattttgtgcctagaggcccagagagggcttctgttcacaccccggtactctggggccttcttggggaggtgagcttcacggggccctcagcactgactcagcagcttggacagtagtggtgcattgagaagcttgcggggaggacggagccctggctgcacacctggcacccgacggccccgtggccggttgctgtgtcctgggagcagcgggcatgtcgtccgactccactgggagagggtgtgctgcatgcctgcatgcctgtgcccacgtgcctggtgcccacgtttgggctcggctggacacgtgctttgttgcaggggctgctttcctgcaagtgcatttgccgtcctgagcctgctcactcatcgaattccacgtggtcgtctgggagtgattccgggtgcttcctggtttgaatttcacgggaccctggaggacatgaactcagaaagtgaggcgttgatggtcgcttttattggtatattagatgcattgaggttttgaaagggaggacttgggattcttctgtgtctttttaatgtcttagagcgtctagaaatagcatttgctcttcagttctctagaggggtctcccagaagaacaaagctgtgtgtggcagagtggttccctttagaatgcggagctctgggggagagcctggcgcttgggctggagccggcccaccaggacacgggctggagccccattcgctcatctgtgatttggggcacagaatttacccggataggaagcagctcaaaatacaagctggttccacccctttcccagtaagaggattttaagtttcttggtcaacatgattttataagcttttagggatagatgaagtagttcaacatttacttaaatatttaatttgctcaatcgtttacatctttaaaaacatgaaaataacatgttcttgtaagttgcccttttttactcagtgtgtgaaatgggtttcttcaaactcttcccctggctttcaagctcagggtctctgcctccccgagccctctccgggtctcagtgtggacctgacgaagtggatttttctgccctccagggaccccttttccctcgccagcatccccctgttgagaattttttctgacgctgtttttcagtgacgcccacgcttgtgagatcagagccctaggagcaggggtagacctttgctaaatttctttatggttcaaaaccaggtgagcctctgtgagccaccggacccgaggctggctgaggccatgtccgactttgtgtcctgagaaccccagaaaaggcttgtgtgcagcccccacccccatattttctaagtgatacaaaacctctcctgactggcaggtgatgtggccgtcacatctcccgggattgttgtttcagcccctgtcttttgagcctgatgtggggctccaggggatggggcagacctggcacgccctcacagagggaatcccggtgcagggtgggcatgggaccctgagccgggagcaccacccagcgtggggtagaggaaggggcccgagggacagtgcagcggggagggaaggagccctgtgaaaccaccgaaatgtactggaaccgaaatgaggctggaagtctgagatcagggtggcggcggggctggtgccttctggggcacagggagactgtgtcccggggcactctcctgggcttgcagacggcgtcttctctttttgtattcttgtcgtctttcctctgtgcctatctctgtgtccaaactacctcttttttttttttttttttcctggggcagggtttcgctcttgttgcccaggctggagtgcagtggcctgatcttggctcactacaacctctacttcccgggttcaagtgattctcttgccttagcctccctagtagctgggattacaggtgtgcatcaccacacccagctaattttgtatttttagtagagatggggttttaccacgttggccaggctggtcttgaactcctgacctcaagtgatccatccacctgtcttggcctcccaaagtgctggggttacaggcgtgagccattgcgcctggcaaacttcctctttttataaggacacgggtcatattggattaggtcccaccccagtgacaacattttaacttgatttctctttgaagtctctgtacaagtaaggttaaattctgaggtcctggggattagcacccctatgtatcttttttgaggggacacagttcaacccgaaacactccctcatttttcttttgagcagatgtgtgtcttcccctgcaccaaatgtgggaacctgtctgcagcctgcaccccagcacccctggcctctggataccctggggggtttgtgggtgaacattttctctactggagctctgggagaacagaaacatctcaatgtgggagtctccccgcttccagtgctggccgcatttcaggctccgcaaatctggggatgtggtagccccaaggccgcagccgtgtctgcatggaggaggtttggtcaaattcagagggctctgccttcgtggggccaggtgtcctgtgtcctgcagcagaggcttctgacatgtcccaggccctgtgcatgttgtgtggattgtcctgcgtggtcctcacacgtccgacgcagatgcccgttcctatcccagtgtatagacaatgaagttgggtctcagggaggccaattgcagggggagctgatgggcctggccttaaattgggtcttcctgggtccaagtctgtgatctccatggtcctgacgaaactgtgtcacttttggcccagagaggtgggggtgggaggttctggtctgacctgtaggacatggaggctcggagcatccacagagtctcctgacgtgcagaccactaaggcaggcagagatgtgtggtaggaggaggtgcatggtagggacgtcggcccatctcctttggcctctggagcgcagctgtcctccccacccccagccccctccgatggtggtggcacattgccactgaccccatcggcccgtctcctgggaaaaggtagaatgtggcagtgggcgctggggttccagagtcagggacagcagggctgtctgtgcttacgggagggcctggtgtcagaacagtgggggaaataaataccccaggagggatgggcccagcccagtgcctacagacctaggtagagtcaccaggccgggccggcaggagcccctcagggcagctccgggcccttgctggagggcaggagaggcccctgcggctcagggccagcctccccatgtgggctctctggcaaggtagttggacttttttatgtggcacccacggaagcttctaggcctcatgagaccaggctcgaggtggtgccatggctctcccgacaggctcccctggtcagagccaccacaggccatgctggatccggggaggacacagaccctgcctcttgatgggaggagtctcagagagtgtgcagccatctttactctgcctcagggtccctgtcacaaacggggaataaccatgcctcttctgaggctcgggaggagacgatctgaggagacccgtggggagtgggtagccggcctgttgaatggcaagcgcccaataaatggtcgccattgtgaccactgggcccccggagtggtgcttttacatgaaatgttcctaaaactgggccatggttttcaatatcagttgagagtgttggggctaaggcccttggcccccttaaggttcactggaaaatcagacaggagaggctgggcacggtggctcatgcctatgatatcagcactttgggaggctgaggcgggcagatcacctgaggtcaggagttggagaccagcctggccaaaacggtgaaaccccgtctctactaaaaatacaaaaattagccgggcgtgatgacacgcacctgtaatcccagcttctcgggggagctgagacaggagaattgcacgaacccgggaggcggaggttgcagtgagttgagatcctgccactgcactctagcctgggcgacagagcaagaccctgtctcaaaaatacataaataaataaataaataaataaataaataaataaataaatcaagacaggaggtagattgattaattggagaaaaggcaaggcgattgaacatttatacaggggaacattctaaataaagtcccaaagataggggaaattgctcatttttatgtgcaagttccacaaagcatgggcaggcagatgagcctggattcttactggcctctctgagccgcgccccttccttctgggtgtggggcaggaccctctctggaatggtgggtcttatgacctacagtcaaacaaggtaggtcagggaatttctttatggccagtttttatacagatagggtggagggacagttagagtattatttttaggtttgatgactggctttaggggaaaggggttctggtttctaagacctgcttgggggaagaggcattctagtttctatggccagctccaggggagaatggaactagtgacaggagggccttcatgttggagtgttttctgagccccagtattaccagggggcctcaggagtggcttttttcatgaaatgttcctaaaatgggtccatggttttacttttcttttctttctttcttctttggtttttttgagacagggtcttactctgtcacccaggctggagtgcagtggtgtaatcgtggctcattgcagccttgatctgtgggttccagtgatccttcctgccttcgcctcccgagtagctgggaccacaggcatgtgccactatgcccagctatttttatttatttatttatttattttttttgagatggagtcttgctctgtcgcccaggctggagtgcagtggtgcaatctcggctcactgcaagctccgcctcccgggttcacgccattctcctgcctcagcctcccaagtagctgggactacgggtgcccgccaccacgcccagttaattttttgtacttttagtagagatggggtttcactgtgttagtcaggatggtctcgacctcctgacctcgtgatccacccgcctcggcctcccaaagtgctgggattacaggcatgagccaccacgcccggcacacccagctaatttttaaatttttggtagaggccaggcatggtggctcatgcatgtaatcccagcactttgggaggccgaggtgggtggatcgcctgaggtcaggagttcgagaccagcctagtcaacgtggtgaaacgcggtctctactacaaaaattagctgggtatggtggcaggtgcctgtaatcccagcttcttgctacttgggaggctaaggcatgagaatcgcttgaacccaggaggcagagattgcggtgagctcagatcgtgctataggactccagcctgggtgacagagcgagaccccatctcataaataaataaataaaatatattaaatttttggtagagttggggtctcactatgttgccaagactggtctcaaactcctgggctcgagtgatccactcacctcggcctcccaaagtgctggggttacaggtatgaaccactgcacccggcctgaggagtcccagctccccatgggtctcctcaggtcgtctcctcctgggccttggaagagacattgttattccgcgtttgtgatggggaccctgaggcagactaaagatacccacaaactctctgtgattcctctcatcaagaggaagggtctgggcctggcgcggtggctcacgcctgtaatcccagcactttgggaggccgaggcgggcggatcacgaggtcaggagatcgagaccatcctggctaacgtggtgaaaccccatcgccactaaaaatacaaaaaattagccgggcgtggtggcgggtgcctgtagtcccagctattggggaggctgaggcaggagaatggtgagaaccctggaggcggagcttgcagtgagccgagattgcgccactgaactccagcctgggagacagcgagactccgtctcaaaaaaaaaaaaaaaaaaaaaaaaaggcagggtctgcatcctccctggatccgacacggcctgtggtggctctgaccaggggaacctgccaggagagccacagcaccagctcaggcctggcctcatgaggcctggaagcttccccgggcaccacataaaaagtccagctacctcgccattcaactgatgattttaaataccagttgaggggattaaaaatgatctttttatttattttttatttttttgaggcagagtctcgctgtgtcgcccaggctggagtacagtggcacgatctcggctcactgcaatctctgccttctgggttcaagtgattctcctgcctcagcctcctgagtaggtgggattacaggcacctgccaccacgcctggctgatttttgtattttttttttagtagagacaaggttttgccatgttggccaggctggtcttgaactcctgatgtcaggtgatccgcccacctcagcctcccaaagtgctgggattacaggtgtgaaccaccacatccgccctaaaaagtctctttctgttgagggtctggcgttgtggagaaagcgctggactcagccttggagcccctctggccaccctgtcggctgccggtgacactagatcaacctgtgcccgcccggcctcagtttccttctctgtgctttgcagcccggggcaggcccatctccgaggtccctcccagcctcagggtacccggatgcagtatgttggaagagcttgggattttcaaagggggaagtgatcgtggccttccctggtaggaggctttgcgtggtctgtctgggcagagtgtccctaagccctgctgggccccttccaaccaccagcaagccagctgcctgtctctgccttcacaggttttctgaagttggtgggtgctggacgcttctgaagaggagttttaattggcagaggctgctgtctccctggcagggagacattctggaggcctgggggcgggttgttttttcttcactccattaataccagtgacctttttgcctccagcgttaattaaatacagacatttcaggcatctgcatggtcatggtctggcattatcttgaccttaggcgacttggaaattccatatttggccttcactaaacgaggcatagaagagcaatcatggacgatctggaaatggagggcttagagccacaccttttggccacccagaggggggcctgtgttgctgcggaggtggggagacagcagagctctctggcttgaccaccatggatgaagctgggctcagctctgggctgggggagacaggaaggagctcaccctcctgggacccagtttcgttcaaggagacacagcccagccatctgggtaacaggtgatgaatgggaggtaggggtggaagatgtcttgagggatgggccagatggtgggttacaggggggcagagcagggctgtgggtgtgagcccagatgtgaggctccctacctgggtgtgccctgtgctgggctcctgacccagtgagaggctgaggctggcacccgcctggacgcctctgccacttgggcggaaggagggggacttagtctcttgctgctgctcaaaggagcggctttcttcccgagtgtcagctcattttcccgcgtccttcagcaataaccagcatgtgccgataggctcccgagtcgcttcctagtgctgcgttctcacaagcccaacatctgtttcggttgggatttttttttgagatggagtctcgctctgtcgcccaggctggagtgcagtggcacgatgtcggctcactgcaagctccgcctcccgggttcacaccattctcctgcctcagcctcccgagtagctgggactacaggcgcccgccaccacgccgggctaattttttgtatttttagtagagacggggtttcaccatgttagccaggatggtcttgatctcctgatctcgtgatccgcccgcctcggcctcccaaagtgctaggattacaggcgtgagccactgtacccgcctggttggatttttttttgaagtttcttaagcaaaagacaagaaaagaaaatgtcatttatattaatatcaacttttcttcgtaaacacaattctagacacagctggtagaatttctgaaatcaaaccagaatggaattacagtgttgcttatgtgaatgaagtggcgctcggatccaatgaaatgagcaactgccctctgagagtgacctgaacaacagtttgaaagtttcgcatagtggagccaatgacgaaagttgcctagatctgacgctgcgagagtggctgtcgtccccacgtttcgacctgctctaacgtttataaagattttattcttttttattttatttatttatttttttgagactgagtctcactctgttgcccaggctggagtgcaatggcgcgatcttggctcattgcaacctctgcctcccgggttcaagagattctcctgtctcagcctcctgagtagctgggattacaggcacctgccaccatgcccatctaatttttgtacttttagtagaggcggggtttcattgtgttggccaggctggcgtgaactcctgacctcaagtgatccgcatgcctcgcgctcccaaagtgctgggattataggcgtaagccactgcgcccgacctactaacgttaataaagattttagtgttatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaaaaaaaaaaaaaaagattttagtgtggctgccaattaagaaggccgagaaccagacaactctggccttacaagacagttttttgccagtgtgtagaaagctgatgttcttgctctttttaaagtagcagcattgttgagatgcagttgacacaccatggggttcgcccgtttgaagtgtgcagtgcaggggttttcagtgtattcacaaggccatgtatccaccactaattttaaaacgctttcattacccccaaaaagaaaccccaacccattagcagtaactcctcatcccccccaaatttccccagcccctggcagccactaattcaaattgctgtggatttgcctggtctggaaacttcctataaatggaatgtcacaatagattgtccctgtgcctggctggcacccgctggcacgttgcggtgagaatcagagcttctctccttttcacgtcggcgtgatagtccatagtggctccaccgcaatttgtttgcccattcatctgttgacggacatttgagttgctcatttacatttttattttttatttttgcagggtaattatagatgcgcacggcagaaagagtcatgttacagacaggcttgaaatgaatggtggcctcctgcctccccgaccccagccccgccaggcctcccccaggagctgcacctataactgtgtctttaattctcctgcggtcacctttggagccctcagagatctccatagagcccagcccttgattccctgctttcaacacctgttgactctttgctgtaggagttgagcccctgtccccctcccctgccccttgtgctggtgtcattctcctgcgggcggccctcggtgcctcggcttggagcttgactccctctttcttgccgccctctcccacaccatctccggacgccccccacgcgatcttcagaacatcaacccctgcccttcctcctgcctcccacgtcaacagcggtgacaccgatggccagggctctgtgttccgcctgtgctgtctcctgtcctttaccccagggtctagggccggtgagggctagcagagtgctcagctctggaccctgcctagggtcatagcgtcatggcaggccctgctgggggacaggctgctgtttcacctcaggggccccaagtctggacttctttctctgggggtccagggtgggcgccaggatctggagcctcttggggtgccctgtgttctggggagaggcccacagccttccttagattcctggaggggtttgtggtccccttggggttaaggatctgcctgagacggtggggaaagggctggcccctcctcctcctgggagcctgtgaaccctgctgggccctcatgcctccctggacagagggcaactgtggcaaaatttcccaacagccgccttgtgcagggtcacccggggagctctggggtttctgggggcctctcctttgggctcagagggcgtaaaggcggtttccacctttattgggccctgtgatccttgtggctcctgtggccacagtgttcctgttggttttgtggatggatgcacccagccgcctctcctgtcaccagcctttgttgaaggagcttaggtctccttcttgggtcagttgcaccaggtctgggtctggctgcagccggtgctgatggccggcaccatccctggccaggccgggccccggctcccccatccttgggaaagggtggaaccctgtgtgtccacggtccctggatccctcacagtgcactttagagcggacatggtggtggcagtgggtactgtggcggatccagcgaggtgacctctagggtctcacccgtgcagcttccctgaattctgacgggcagtggaggcggggagtgggggatggattctcagccatgggctgtggggtggatgtcatgctgcttggcggggtggccttgggcccgttactgtcttccttctccccgagcctcagtttctgcagatgtaaggtggagattacgacagaactttccagaggtctgtgaggatccgtgaggtccagtaaagcattcaactgtgtgtgtggtacacgtgggcgcccgactctcgccgctgctgtgtgggtcaggtgcggtgggtttcaggggcggtagttggactctggcttctctgccacttgctgcgatgctgggcctcggtcatcgcggctgtgggtggaatcaccgtcccgccaccctccgaggttcaggcaatgaaagctgccgtgtggcgacggaggaaggcttgggctcctcctggccttggctgggctgggtgctcgcccctgttctgcaggcaccgttgacttcctgcaaactccgtttcttgaaggtgacctttggagctggccggagtgggtgtcggccatcttggctcctttgtctagattttgcttttatgaaggccggggagggagggctcgcccctggtaggcggccgtgcggggcaggtcccttgccacctgaggaccccagagttgtcgctagggcctcctcctccacgctgccccaccgtggcgctgcccgactgtgggaccgaggaccagctgaggcccagctgctgttgccgccgccttcgccacccgagcctccttccttctttcctccctccctttctccttcttcccttcctcttcagccctctccaccctccaccctgcagctgtggggcctttgtgtgacccctccacagcctgaaggcacctggctgtcagactcccacctttagaggcctgtggatttgggagggtggcaagaggagtcttcgcgggaggtgggactcaggctgtctggtaagtgcccagatcggactcagagccatagatcttggaccgtgctgtcctctgagagaaagggcagctgagtccgccttactgcgtgtctaagggccagggcccctcaccgcccagcaaaacctgctcctcacgaccaggaagatggtgttcctggtctcactttgaagtctttttgtgagacatcatcctgatgataattctgggggtgggctcgggcaagttccccgtggatggagaccgcttggctctttctttcccccttacaagaacctggaatgctttttattgccaaggctgggccaggtccgcttttctcgtctgcaatggcctctgagctgaagcctggcccggattcgcccctcctcttgcatctctggcctgtgagtcctctcctccctctagccctgcagctcagcctgccctgccctcctgagctccttgtgcccctgtgtccctgttggagccgaaggacagttgtctctgctggactctgacgcccgattcaggcacggagacccaggagggacggccaggcgggttaggtgctcggctgccctttggccgagccctgcatggggcccagggattgatgcagattgatttttgctgacccctgggatgatcttggccaagtgacttaattctgtctcctccccagtgtgcttatagacagaggtgtgtgcactggtaagggtgctctaatgagtgtcagctttcactccccacctcctcagcccccacatttccaaaataaacagaggcttgtttgtgttcaaaggacactcctggctcacaaagccctgcagccctgcggaagcaccaggaggcctcacttcctagcagcacagccccatgcagccaacccgggacacctgttcccactggcacctgagcaggccccttgctgatccccacccctcccctcatctcccctttatccccctctacccctcccctgcaccactggcctctgttccatcatcccccaccccgcccttgggtcccttccaccccgtacccaatgcccccatccctctccttccccctcctccccacaccccacctctttcatccctttcgtctccccacacccctggcaccccgtcctttgtccctctcctccatccccttttcctctctccctctctctccacctctcccccgaatgccttggtccactcatccactacttttacccctctcctccattctcactccacgccctctatccccacctctcccaactccatccccatgcctcccctccatccctcctctccatccccttccatccctctccctccatccccctccatccctctccctccctcccctccatacctctccttccatccctctccatcgctccccctccctgcctctcctccatgcctcctctccatccctcccctccatccctcccccttcatccctccccttccattcctcctcttcatccctcccgcttccccctccatccctcccccatcccccgccctccctcccctccatccctctccttctttcccctccctcccttccctccttcccctccatcccttccctccatacctcgccttccatccctctccatccttccccctccatgcctcccctccatccttctcctctatctgtcccccttcatccctccccctccatccctcctcttcatccctcctcttcatccctccccttccgtcccccctccatcccccctccatctcccctccatctcccttccctccccctccatccctcccctttatccctcccccttcatcccttcccttctattcctcccctctgtctccccctccatcccccatcccttccctccatccctccccaccaccctcccccccatccctcctgctgagagtgggagggagggagggagaagaagctggagctggagactgtgttcctgagggtggcgtgagtgccgggccctggcagccccctgcacccttgtcccccgggcctctgcttgctgagcaccttgagcagggctctggtgctcccttgcaagagccttggagagaaaatcttctttgccttttttacatttttcactcctctaccttatttcatttaacttccccacttcagaccagaaaatgcccaaatagatattagaagaccttaaagtatttttgtttatcaggtgtgaaaggtggcaggtccttgccagtttgcagggatgggtggctggcagtgaggtagcaagagagatgcccctccgtagtgcccacatcccaggcagtgccatagtccccacaagcagctcaggcgtgctgaatatctcactctgccgtcaccagcgtgcggcttccacctaagtgcttcaaggtagctgctgagctcctgccatctcgtccgtgttccatgcagcaggaaagaagcaggggaggcagctgtttccttttaagtgcatgacccttcctcacctccccttcctttcttacacagtgtccagagcgtggttctggggccattcctttctgcaagggagggtggggagtgctgtctttagcaggcagtcctgagccatcaagcatctgcctctcatggacaaaggggagagggactctagggggtggtggggggcggtcgtctttgctccagctagggagagccgtggccccttgaccctcggcacttttcccatttctgctctcccaagtggtttcttcctgcacctcttggaaggaagaaatgtagtccggggctgggaagctgcagtccgtgctcactcctggactcacagccacgattcctcctggttgccccacggcctgcgtgagacgcgccgtcagtccctctgtgacaggcagcaaggctccgtgtggtcgcggtggagccgagttctggctcctcggaagaaaccactgcccagactcccggcctgggctccctggttccaccccctggagtctcggctgtgtggagggctctgtgccctgtggatgtgccaggctggcacgatccgtgctgcccatgccctggctgccactcctgcctggggacctgcctcagcccctgcgagtcaccatcccacaccctggcaccatagcctcccggagtgtgcccatatcctgttagttactagctaattttcccagccaggatgacaggtccttccactgcagagacagtaattcgtggagtcatcccaggagtggccctgcggggtcatgtattattcatgggaaacactaatattccagcctggagttcttttttcatggaagctgtggggtcttcagccttgtatcgacattaacagttgagacatgagtaaaacaccatcacatcggggaagcctgattaggtttaacgggggacagagaagaaaaaaattttttgtgtgtgtgtgtaaatgaaatgtcttctgaacaaacagccgagcctcgttgggtgccctggggagtttcctgggatttcatgacgcactcggtcgctgaggaagcaggtgctgacgggccggctggcttaatgtatttgtgcagttgcagtgtgggactggggtggtccttgctgcggagctgtgggctgcccacacctgccccaaggcaagctatgtgctcccccaggccctggacccagtgcctttccctcccaagcatcccttagtctttccaggggtctcagggtggccttggggagagaagggaaccgaggaccgcagatcactgtgccagtggccgccttcccccacccctttgactcctaggctcttaggaggggtcaggccagtctagaaagccagcagctagcacccagagtgggcatgctgtctcccacacaggcgtgggcatgttctaggctcgtgcccgtgagcccccacccttcggcacccgctgtaagaggagcactgtgatgactctagtttcctggacgaggaacccaggccaagacctgggggtcagcttgtctggggtcatctggtatccgaccccaagcctgtggtttgctgggcctcggtttcccaccccgagggcggaagagcaggcagcactgagacccctttcagctcagctccagatccctgccggacctgcctcaggccatcttgatctcagcaaagagctcctcagaagtgaggcttccccagggacggggacgcggtgtccctgcccccctggcaggggcgcttcatttccatgctgttcgtgtcgtctccttgcgaatgcgaatgacgggctgtccgccagggcccagcgtcctgtaattggggtaagtgtcacttttgtttctgaggtgggggaaattaaattgtgtgtgcacacaattaatcttgctaatggcagcctccctggacctagaaattaaatgttaagtatcttgcagccagccgctgggatgacgccctttggaacagatcagtcggctcaggctcatgatactaattggggtggagtctggtgtttgtctagctctgaccctgtttgggggacgttggtcttatcgtgtccacgatgaggctgagacttggagatgtggaagctggaaaagcccttcccagagctgcatccgtctgtctgtccatctgtgagagtgacgtggctcctggacacagcggtttctatggaaactgccccatgacccagggccggtggtgtagggacagacatgtctgggcctgcctgtccgtgtttggccttgggttcaaaagagctggaggcctggaagatccaggtgtgcgtggcccccacatgcagctgctgctttgttttgttttattgactgtggtaaaatacacagaacatagcatttagcttcttaaccattttccagggcacaggtcggtggctctgaacacactcacgttgctgtgcagccgtcaccaccgtccgtctcccgaactgcttcatccgcccaggcggacactctgcccccattcagcgctcaccccagcctcccctggcccctggctccccacttctgcttgctgtctgcgtgagtctgccggctccaggggcctcatgtaagagagtcctgcggggacctcctgtagggagtcccgtggtatttgtcctttgtgactggcttatttcccttagcacaaggccctcaaggctcatccaaggggtgctcctgggcagggtctacccttcagcctaagctcgggcttgggaactgggggttcctggtggggagcatagaggagtggctgccttctgtggacgctgcgttgctctacgtggaagagggtcgctgtgaatgcgcctcgtctttccttcagggctggtggtgaggaggctggccacgcaggagccttaccttccctcccctgaagatgcaaaagcagcccctgggtggggggcgggggatgggaggcagaggcaggggcaggggcggttcctggcctcgctgatcgccgtgtcaggctggccgtcatccctctggtctgtgtcctggctgctgtgatctcatccctcagcctctgatgtccctggggtgctggggttggggagggtctctgctgggggtaagtggagtccgtggtgtccccagggaggcgcgtggggaatgtgtgtgtgacggtggtgatggctgcacagtgtgagtgagttcagtgctgctgacttgtgcatttgaaaatggttaagaagttacattttgtggggtggggtagggtgggatccgaccatggccctggggctgccattgctgtttttagagttagggcaggatcttaggccctgtgaattccctggggccagatgtccacacctctgaaaatccagcttctgctggggcatgcgctccctggagtagcaggtgggtgggcttggagcagctgcgttcagctttgtttcccatccaagggggtctggggccctcactgccccttcccccacccccatcctggggtggttttatgctttgaggcaattagtttccatggggagtccctgagggctgtggaggtgaagaggtcccttcctgctgaatgggcccagcagatggcccctacctcaccctgccccaaaggaggtgcgatttctgcgtggggcctgctgtctgggccctcctctgagttgggctgagccccagggaacccctctgggaaccaccactgctgagggagagcaggagggcccggggtggggagggggggcttggcacctgccttgtctggcttccctcccccatgggactgggaaagtcctgcctgaagggccgcctctgcccctgggcctcctgtgcatcttggaagagtggaacacaccttttcctgtccacctgccccaagccaggggacctgtaagcccagcagacccctggagtatggattatgaacacaggcttttgtgcttgcagaattcacctgctctcctggtaacagagctctgaccctgtgtgcagccactggggttgttctggacgtgggtgttgccagcggaagaggaaggtcttggcggggtgtgtaatgtgtgcaggtgccccgcggagcagggctgagtgggctctgtgctgtctctgggcccatcttgttttcttgtctccagtaggagattggggatttgcaccccccagacacaggcgcaaacacgtgggcctcactgactccgacacggggcccaggctcaggtgtgtggtgctgtcaagtctggggcttcctcttgtctgggacgaggttagagctggaccctggccagagctcagactgtggcgtcagatggacatgggtttgagtccttcaagctgggtgaccttcagcaggttacttagcctctgaattataaaggacctccctgtggcagggttaggcacgcggtaggctctgagactcctcctccaggatggaggctttgtggccactgctcagatgcctctgggccgaggcaagcatcagacgaggcccagcccctcatgtgctattcttgcggagtttcttgcatgtggcggagctttcccacctgcaggaagctttggggttgtctgggaccctgggtcccacatgggtgctccttcctgtctttccctccccgcctgctccagccccttcacccctggtttctgagctgcatctcagcctcccagggtggctctgggcccggctgggccttcccgccccccagctgtcagtacggagatgggaccagaccagtctcctgcacacgcttctctctctgggatttgtaacaagtttaaagttggttgtctagcatagtccccttaatggtgagtttgtaggtagctgagaactctggttctcaggaacactcaggaacacctgagtttggttgtcaccaatgggccgtcccagtggcgcctgtggttccttccagcccaagggtaagtgggtgagtgctttgtgaagggtttgtgccggcaccgtggtgggtttgcgaggtcagggagatggcatggagcgtgtgcccacctccatcttggggcagctgagcatcacctggtgaggccagatgcagagtccagtcatttcagagctgttagatggaaattggaggtgggggcccagcagaacaccacaccaagcttgggaggggtccgccctggggtcacgtctcccctgcggcctgagcaccttgcttgtgtaaaatctgaatggcattgcacgctcctggcggtgcaccattattagtaaatacgacacttgcagagtccacagtggcaggccctcaggaagtaccggccaccgctgtgcccttggatcaagacttgttttggaatgagagggctctgagaaacacaaatcgctgggccatgtttgctcatcgatgtgacagggatgcctgagtacaccgaccttgaacttgtggggaagaagcagaggcagacagtgcagctgggcagggcaggcgcttccactgcggctggacatggaccaagtagacagccgcgggggctgcatacatgcccttccctgggccgcccttggttgagtgggctcagaagttcagaagaatcaatcgcaggacactggagcaaatgaagtcactggttcagagaagattcatgcattttgatgaatattggctgtgcttgccagtcctctggagagaaccctccagaagggcccaacttatctaggctctgcctgtcactgtggctggctcagatggtgtcatcggcctggaagtggagcctttggcattatctttggagtctttggaatgatctaggctccacctgtcactgtggctggctcaggtgggttcatcaggctggaagtggggctgagggtgtgagttgtggacagcgctgcgcccctctggctgagtgggaggggatgcttgtgtgcacctgtggtctctgatagagctgcctgcccagtggtgcttccttccctgggtgtttggttctgctccctaccagcattctcacggagccgtcaagcttatccgtgtgttttgagtgaataaagctaattaaaaatctttggagttaaaacatttttaaagccagaggtgtttttttttgtttttctttttagcaagcttcttattgaagcatcttatgcatatagaaaaaggcagctgtgccaagcggtcagcttgctgatgttccataaagtaacagcctgggaaccagcctgggtggagaggctggcctgggtggagaggctggcctgggtgggccagcatctgttgagtgcttgcggagtccccaccacgccccccaggctggcacccccctccctaattaattgacaaagtgtggcgggcgttgagaagggcagccagcccactgcagtgagcacccaagcgcctaaggaagcactgctttgatgagcgtcctttgagttgtactttggaggagcctggggtccagctgggaggcaggacgcgtggtggtggtgggtaatgatcacatgttcattcagtgtgctcccgtgctgctcatctaggtggcttcattgcacgtgtgcacgtgggggttggttaccatttattttggattccctctctttgctcatgagttgctagaatcattttttttttttggttgagactgagtctggctgttgccaggctggaatgcagtggcgcaatctcagctcactgcaacctccgcctcgctgcaacctccgcctcccgggttcaagtgattcccctgcctcagcctcccaagtagctgggactacaggtgtgcgccaccgtgcccagctaatttttttgtattttagtagagacggggtttcaccatattgatcaagatggtcttgatctcctgaccttgtgatctgcctgcctcagcctcccaaagtgctgggattacaggtataagccaccacaccgggcctactagaatcaatttaagcaaagttgctagtcacctgtggacctcaagtgtgagttttggggtgtacttgagcctcacagtggcactggatcccgggagggcttctcgtccgccaccttgggtagtgagctccctgtcatgggaagcatgcaagaagctgctggtggcattgcacaggtgaccggaagcctccccaggtccagtgcctgagggcctgctccggccgagctgaaacctgcctgctgctgggccgcctgcctgccgtggctggggatgacttgggagtctctgctgggctgtctgcctgccgtggctggggatgacttgggagtctgcagggtgagtggttgttctatcccctcattgtttcaacatgttccgacgaatttttaagtggctgagctgctgcagcaggtcagcagctgactcggctctgttcctctccctggccctgactgcccactgtggctcacacccgtcagccccacactcacttggcacaccccggcagggaggctgtctcaacggatgggtctctgcgccttcgctcctctgtgggtccgccatttgtgcagagaatcgttgtcaattaccagggctcttcgcatgattaggggaacgtgaaatgagcaaatgatgaagggcccatctgctccaggagtggtgtgtggggacagccgagtcttttgcaggctcagggacttgactttccatgccaattaggagggaaggatccagagagagcagcagggggtggggacatagggatggagcctggggaggttgttccctgggaaagagggccattagggggccaagcctggcatggggtgggtgtggggcccacatcccgaacccagggtgccagaggcctctggggaaggtggaacccctgtccctgcagtcacagcacaccgtccctgacttcttggcatggcagagtccctcttgtcctcctgggcctctcagctgtcgccccctgctccctgggggtcctgtctcagtggctggctgcctctgctgcaggggttcaggggccccaggggtcaccttatgacatttgtatccctgagtctgtctgctctgaagggctgagcgctgtgtttgtgacatttatcctttttctggcgtccactctctgccatagccaagtatcacggacctggtgccgcaaaacaagggggatttattctgccctctcctggaggccagaattccaaactcaaggtgttgtcggcagggccacgctccttccagaggtcgcgggggtggggatctgacttcacatggcctcccctttctccctatgtcttttctcttcttttgagggccctggtcacagtggattaagggcccaccttactccagggtgacctcatcgtcactcatgacatccgctgtgatcctatttccaaagaaggtggcattctgaggttccaggaaggacatgaaccgtaggggatgctctccagccccgtacagatgtcggctggctgtgacggcagcatgttcgggccaggcacagcagggccgcccctttggggctgtgaaggctgagcggacagggtctgtgcccttggcggcctgcgtgcttcacctgcttcactgcagggttcagtctggacccagcatgttctttgccttgctttctgtttattgacagtctgcttcctgccctggaatctccgagagctctgcagggcatggctgggcctgtctgtccactgtgtcccgtacagcctggggcctgccacacagctatctggggatggctgcctcttgcctcttttgttttcggcactgtatctcttgggagaggaaccttctggagagtcagtggagactaggttgaaaccttgacgccctcctttgtagccccgcacactcgctgggcacctggcaagcaggaggcgtcatgctgggatcctgtgccaggcgccctggcaggttctcagcacgtacttgctgcgtgtctgatctgcgccctccccagtgttgccgtgatgccagccggggccactgaactcttccgcccccacacgctgcctggagtagtatgaaggatggagttggttttgataggacattaaataattaattcctgtctgggctgaaaatatagaatattaaattatacatttggtatcagacacatgagagggcctctcaaagttcccggccacttgtaggccaccctcaaggacgtctgggacctcggcggtttccagtggctggctgccaggcccaccatggatctcaggcctttctctgcaccttcccccttccttgtgttcccagctgtggactgtgttcctcgtcagttcctcgtctccacctgctgcctctgctggaggctcgagctgcctgggaatccgtcagagcttgccttggagactcctttgcagccttcatgcagggcctcccctcctgtcacccaggcccctgatgggatgcaggagagctgggcgctcctccttctcagtcctgttcacaagccccgtctcactgggaggaaccttgtggggcaagtccagacacattccagagggccttgtcccacgtctgcgctccgctatctgcagatagcatcatgcctgcgggaaggccgcatctctctgtgtctggagcccatggctccaaggcagcttttctggggacaagttctccgggtcgtatggtgggaagcccagcagcctgaaggccagtcctagctccaccacctcgggccctgtgccagcagggcctctctccctgcccagcctctctgggacgtgggtgggccatggcccccagctctgggctgctggccccttgctgaacctgcccctgtatggaggggggtgttgctgcccccgggagcacctgacagtggggggactgtgctgtagccaccgaaggcagcacctaggctcatgcccagggatccttgcagttcacctgcctccatcctgagccacggccagtgtcctggagggccgaccgcagaagctgacctgctgcccacctgacctgccaaaggggcagcccctgctttacctagatattttagagcagttttagacttagcaaaattgagaagctagtgcaaaagaagattgtattccacacccgggtcccccatccatacctcacagtagttggtgctttggttacaatgaatgaaccagtgtggacacattgtcactaactgaagtgactctggcttcctcagtttcccctttatgtcctctgtcccaagacccatcagggactgcacatcacattcacttggccatctcttggtcccctgggcggtggcattggcagtgccccccgcacccaccccttcttcatatacaagattcctactggagaagctgtccctggtgcttcgtgtaaaaggcatcttttataaaaccatcggtcagatccagccttttctgacctgggagttccccatggctgcccctaaggccattgtccttccctgcccgcctttatcatctcatgagtccctgagcctggctgacaggtccctcaccacctgcctggttcagaggctccctctcagctcagctgcttcctgcccactctccctccccgtgctgcctgccggctctttcctccggtggggcacacagagcttcttggggacacaccttgtaccctggtgtccagggctgctcgtgagtgccaagtgggcaaggggctggtggagggatgcctagcccctcttcctgcagacggcgcaggtgggtccaggtgggtccttccttggcctgtcttccccatgcagcgtctcttctttctcctctacttccagatggccttgtccttatccgtgtcctcactctcatggtttagaaaatcttttctgggaaaagtgcatttttgaatcctacccttagacaggaaaagaaaaatccataaagtggccattttgggaagtcccttgatgggccaggattaagcagtcatcaaggtaaaaccgcttggaagcaaatctggatgccagagcttcgtctgcggccggtttccatctgtttccataaacacaaagcaccggggaggaaaaatcactttagacttttttcctgcaggggctcacattgcacagatcggacttgcagctcgcaaggcggtagggattctcggataggttctgctttggaagggagagcaggttcttggtggttcatctgagccagcagtgctgttcgtcctggtgtgtgcggcttgttgcttagatttgcatttggcagaggactcagatgtgcacttggttgccctgtgggtctgtaatgtcaggtgctcaaggctgtggcagtgccccggggccacctactgatcgatgccttcttataggaggcttgcccacatttatggtgagcctctgacacacacttgtccatcctgcaggcctcaaggtgacagcagcccctccagagggccttctctgattcctggacatctcctgccccttgctttgcttgattagggactctgctggactcccctgcttcccagctgctctgttctttaccctgcggcattgatcacaccctgctggttccttggagctccagaggtcaccctagcacagtgcttggtacgcagcagctgctcaaagtgtattgcacacctgagtgaggaagcaagagcccccagagggcctcgttacagaggagggcctggggcgcagagagctccggcactgctgcgagtctgcagctgagacggggtccagagccaggttcagcagcacaagcccggcccggtcccctctggaagactatgtcacaggatgcctgggatgggggcggatgatgcctggggaacggggggatcctgaggagacacctccctgcccctgccccaccatgctcctgctccatggagtcaaaggctggatttgttgatctctcgaatggggcgacccgaccctggggaaaaggtttctgcccctgcggaggagcctggcatatgtgcaaaggaggccaggctgcccgggccgagggcgcttccactccgagtgctcagctgctgtccctggcccctgcccccactgcccacagctttgcacacccattggaaacccactggctggatcgggaccccctggtgtgggtggcggggacgtggccactgcttgggggatccccctgcggttgtgacttcctgggaatcctcctcctgagacgggcggcaggtggggtcagcagggatggcctctcaaaggttaagctctgtcctgtgacagacatgcacagaggacttggcggtggtggaggtgggggcttgcatctgcaggaggggcagcaacgatgatggtgactgcagcggggcagccgtgggcagtgtgttgtctcccttactcttgcgggtgccgctgcccccatctcacagctgaggaaaccaagactctgcctcactcaccatgggccacctggctggggatggatggggagctgcgttggccagattctgaacaatcttagtgctcagttcggtcagatcctttcagaaacacacagcctcgatcgtgcttgggtcgcagttggctctgtagtgcgtgtggttcgtgtgaggccttccttgtgtggctcctacggccgcagaggtgccagcaacctgtccctggcctctgagcctcccctggctgccacatgtcagcagaggtgcctgccccgtggtacacccggagcatctgtgagacgcaggccggcggagagtgctgagctcagccctacgctgagactggcaaagagacttcgcctgctgagcctaagggcctgggtgggccccacaccctccttcaccgtcagacagcctaggggagaaatagtggggggtgtcggggggccaagtgctttcccaggcccttccaggcactcctgcgggagttcagagcaggagcaggtgtggagttgacgtcgcagaggagattcacgcaccttcctgtcctgtgttaacgcttgcacttaataaccgagttactaagtcatcgcttcagagataagggtagacactggaaagttattgccgtagtgttagagatacagttattagtccccttcccattaaaatggccattaattagggaggccagtgaagccactggaaacccatcagcccctccaggtgatggctactgtcacctgtccccattagcagactgggaacgtgcagtggatgaccaggccatgagaggggggttctggggtgaggctcagtcgggaggctgaggcctttccttctgggtgctttccctttaagagcttgcatcagaccatctagctgatgtgtgcaggtgaccactctgaccctcagtttcatcatttgacaaggggcatagtaacattgacctcattgggtggttgaggattcatggaggcagtggggtaacttttgagcccagagccgaacgtgtcacccagaacacaagcactggctcttccaagaaggttcctggcagtgtgatggtcccaccctgcttgtgggcagtggctgattttgggcttgtccgcctggccagtggattgctgtgtgtctggggtgtgggtcccagctttgtgggctgcatcttggcatcgttgtgcagagtgtggagtgtgccagttacctgctggggaagaaaggcgctggcaactgtttgagggcggagggagcctctcctcgtacagccagggcatcccgaggccagaggaaggtggcagaagggggtctagcaggccgggcgggggttctgtgggaaacagaaatggggtggtggtggctcagataaccacgtgcctctcagcctcccctttccccaggtgggtggggagggagactcggggcaggcagcgacttgctgaaggccacaccaagggtttaagctcagccttgcccagacgccagccctggcatcccctgccttcccctctgtagctggccactgtgcgtccagaccccggtggccagcctcccccattgtccccgttcttcaggccagccctttctgtgtctcctggcagaaaggacagagatggtttctctcttccctgcctcacccctgcacccaggcagccttgatcagccttttaaacagttctggctgtgtcctctctggctgtgtccatccctgtggcctcctgcccaggccttcctgccatcgtgcacctggcctggttagaagactccttggggccgcccccctcccgcggtcctgccttccctccacccagtatcctctttgcagcctgaagcatctctcaaacaccagcctgaccctgcactcccactgccccaggcgaggccagctccttggccctgtgtccgacaggcctccgctctttggtcccctgtgtggccatggccgctctccgggcctgtgcgtgggctctgcccctgcacgttctcctggccttggctgactggctgctctccctcagtcccagggggcctgccttccttaggggaatagtctttgctccacacccaccccgtcccttgccccctaccactcttgtctccacagcgcctctgctggcagcggtcagtggtgctgggcgtgggagcagggcgtgcctgaatggggccatcccaggggagatgcatgctcctttccaatattgtattagtcagggttctccagaacagcagcgctgatagcatatggatagataggaagatttaataccagggactggctcacacgatcctgggggctgagaagtcctgaaaccagctgctgtgaagctggaggtcaggaaggctggtagtgcagctccagtcctgatccgaaggcccaagacccaaggggcctgatggcgtgagtcccagtctgagcccaaaggcctgagaacgacgagcgtcgatgtccgagggcaggagatgatggctgtgcccgctgggcagtgagtgaataaggccttcgtctgccatcatgacctgtttgggcccccgcagttgggtgaggcccgagggcacgggaggcgtctgctatactcggctgccgactcagatgctggtctcctctggaaatgctgcccagccactccggaggtaatgtcctacctgccctctgggtaccccttagcccaggcaggatggtgccgtagcattagccacattagccatcacaaacgtcaattcattctatagcctcttgtgctagaggggactggagcgggggcctcgcgtgtgttcctgcggtgtttctcagcaggtcctggcgcagggcagttggtagctgagcttttgaagggactggcagggtcagtcctgccgtgcgctgcagtgccgggcagtctgtgcctccaaggggatcgcctgtttctttgctactttatcataggcctgcgcctcctccaggcagccctcacttcgagctgctcagactctctgactacaattctgggttgcccagagcctgccttttgtctgtggggccccctctgcctgctcagggcctgccctctgcctgatgagctccttagccggcagaagggtggcctgttcccatcagctgtggatagctccccggggctgtggcgctgggctgtgtggtgggggcagttggctctgtgaagccaggccaggcagtggctggggactgggtctggccttggcacggagggttcggcactcggctctggccctgtgaacccgggttcccagcccaccctgagtgacctcctgagccccggcttgcacacacgtgacctgagcgtggtgagagttcagagcttgggggcagtgaaagaaacgcaggtgatcccgtgaagcgctcagtctggggtctgcagcgggagagcctgtgattctgtttttatggtgaccgtcctcattcccacccttgttctttctggggctgctctgccccgactggctatggggccttggatgagacgcacccatttctagacccgtcttctctgtgtgtaaggtgagggttctggacgcatgtttcccccaaggcctcttgcagctcggaccatgcacagcgcctggctccatgaggcctccacgccccacttcctgcctggacagtctgcagttgtgggctggggagggagatggatcctagggtcccacatgggaatctgcctgtgtagacgcctgtgttccagccccttggttcactgtctccacctctgggaagagggaagggtccaaggaagaagcagcgcaggaggttcttggagggggcaagacatctgtgtagagagtggggtggtgtgggggaggccagaacccctccctcctgcccttgaggtgctgttcccataaccccaccttggcctcaaggtctgggcgggtaccttgagcttcctgtgggattcttgtaccttggaggcagtgactcacgcgctaggcagcagatctgtgtcatggtctccggccttgcctctgattaaagagggactgatgcggctcgtctgcagcctgggtctgggatgcctcccacactggaacccacctttatccccgctttttcctggtggacaggggagggaggcgccatctgtgcctggctcctgcagccacagcagcgctgagtgatgcccaggaggggctggggagtgtctctgggaatgagagagcagcattcgcagacagtgagtggcccagcctgcccagccagtcttgctgggacaggtttactggccttgcaggctgcaggcccccactcagaaaccttgctttcatgcctggaggctgtggtttgtccctcagcttcaaatccaggatggatagccggccctccagggcagggcggcgtggagagccgggctctgctgccagaggcaccagctgtctgccccagccccggtgactcctcctcagaaaggggagagccacagaaccatctcgtggggggttttgagggaataaaatgaaataaacctgggaaagatctggcaggcaggaggcctagacggtggttagctgtcctggaggacgccgtgtctgggagagacgagcctcaggctccaaacaggaacccctcgttctaggctgggccctgcctggaagttgctgggtgggcttgtgaagctcttgcatcttcccagctgggttttaggtttcccatctcaaaattggagaatttggaccagatggctgctaagctgcttccatgaaggacgggaaattccccccaacagcccctgacccccgactgattcctgtagagtttcctggtggggagcagctgccgcctgatgcagctgcctcatgcagcttgcccagccctgggacacagggcttccgtgctggcattaggaacagtgggcagtcagtgttcaggggacctgaggctattggtccaggcgtttcccagggcagtgccgctcctgtcttgggtgctgattgctttcacaggcagcgtctgcccggagcactgtgcagagacagctgcagaggccagtgtcttcagcaggggcatggtgaccagctagtgactccaccgtgagcacagtgggactgggagtgtggcaggacgccctttgccatctgtatgtcttgcggtttccttattccacacacagggaaaccgaggcccagagaggagtggctgagatcgtccgtggcaggcttaggacttgatcccagctctggcgtaatgtcctggtctgagcctctgtactgttttgctcaggatctcagattaaattgcagcttccctcacatgcccagcacagagcaggcactcagctaacatgtgagcccagttgctgttgtgtgttttcctgtcttccttcctccctcccccacccccccgccccctccctctgtcgcccaggctggagtgcagtggctcaagcttggctcactgcaacctccgcctcctgggttcaagcaattcttctgccccagcctcccaagtagctgagattacaggtgcacaccaccacacctggctaatttttgtatttttagtagagatggggtttcaccacgttgcccaggctggtctagaacttctagcttcaagtgatctgcctgcctctgcctcccagagtgctaggattacaggcgtgagccacccccttgtgtgcttttctgtccacccatctgccccgcttcttgagcggtagactctgtcttagtcaagaagctcccagagccccatggttggagtggccgcctggagaggacgtgctgccccggatactccaccagcttacgcctcctcctgtgctccaggaggccacctgggcccacttctcccttccagcctcttctctccccgggtcccaaggtgcacaaagcgactctgacccccggggcttccctgccagccttcctgcctctgctccaggctttgggtttcctctggaggtgtcgggaactgggcctaggaccccgacccttcaagccgaggagaggctgtgcccccacatgctggttggggcagctgggccagtgtagctgactgcagtggggaaaagacggtgcgcggagtgaggacgccatcagcccttttcctctagcctggccacaccatggcagagaagagggggaagttagactcgcagtcacccacccagcacagccatggaaacatggaggacgtgggtgctgggagccgagcatgcagggaggaagccagggcttgcagttttctttggggctggcccctgcccctgcccctttcttctcttccctcttggggtcggccaggtcactgacgccctggttcacatacgatcagtctccccacatccctggccctggccagtgtcccgttcacagctatgccatctctgggggcttctcagccacccccttgaggagctcacaaggattttcaggtctgccctctgtgccagtgcctgagagtcctggatgtgattccagctgggagaaccttccagactagaatcccaacatttcattcccagtggggcagacactcagaggaagggtggagcgatgaccccatggagccagggtctagctggaggctgtgtccctgaaccacctgctgggggctcagaaggggcagggctggcccccacccctgggcaggtggtggctctcaggtaccttactgttaggagctgggctctgagtcagacccaggcttcagcctcccacagcaatgagaccttggtcgagtcatgttacctctctgaacttgggttttctcagtggcaaaatagggtcagtggtgcctccatggtgggtggttgggaccccccaccattagggaggacatttgtacagaaattgtcaagggtgtattagggactcagggagataggtatgaggctgccgtcaggggctcatcttctctctcttctctccttacttcatcagaagggactggggcaaagggatctctctgagtcggcatccatctacccaccatccatccatccatccatccatccatccatccatccatccatccatccgcttctccatccatccatccatccatcaatcaatccatccatctgtccatccatccatccatccgtccgtccatctattcatccatccatccatccacccacccatttaccatctgtccatccgcccctccattcatccatccacccccaattcatccatccacccacccacttatccatccacccacccactcacttatctatccatctgtccatccatccatccatctgcccacccacctacgtacccacttatccatccagccagccatccattcatccacccactcatctatccatccatctgcccacccatccatctgcccatccatccatccatctgttcacccacccacttatccatccatccatccacccacccacgcatttatccacccattcacccacccactcatctatccacctgtctgcccatccatccatccatctgttcacccacccacccacttatccatccatccatccatccatctacccacccacccacccgtctacccatctgcccatccatccactcatccatccatccatccacccacccacccacgcactcacccatatccatccacccacccacctacccacttatccatccatctgcccatcccatccactcatcaatctatccatccatccacccacccacccacttatccacccacatacccacttatccatccatctgtccatccacccacctgtccactcatctgctgatccatccgtctgttcacccacccacccacttatccatccacccacccaccgacttatccatctatgtcatagacaaggagcacccacagagtgtaagacacaaagattcgggctgctggtccccaaggctcaggtggtctctcagactcctgcatttgaaggtgttgatccagacccactgagatgaggaagtatatatttgggtatcatttttacatcctgttgaaagctccaggaagagtgggccaattctgagctgttcatttacagagaagttgctctcacctttttctttccttctaaatgactttcgagccctgatcttctttgtaaggacaaccagaccctcctttcatgcattccccttcagagtcgctgctagttgcctggctcgagtgagtggcatttttcattttgccgctcagctgtcttggggcctgggggcggctcccacctctcttcctgcactctgccggccccctagaagaaacttctgatattgatgttgggccccacagccctgccattgcccaatgcactggctgagaagtgcctttcctgctcgcttttgtttttccagcctcctcctggtggcaaaacctgaatgtgaagctgtgattgcacatgttttgtaattatcactactcgatggtcgcttgtcattctgaaggcaagtaccccaaatttttctgtccgtgctttccacaagaaaaaagaaaaaaaaatgaaggataacacaggctgagttagagaaagtaatttataatgatttgcttctgaatatgcagcaatagtagctgtagatttccaaggcagataggtgagtttccggggcaacatattcaaatgagtttgataatcttgccatttggctccgttgggctgcgtgtgcgtgtgtgtttccagatgtgtggtaatggctgataaggaaggtctgcggctggggccaggtctgtgcagttcctgcttactgattgctaatgacagtcggagggtcggggccagaaagctcttctgatcggcagagcctctgagagcaggctgggtcggcggatggctcatcacatggtcgccagtgtggctcagggctccaatttctttttaatttttacttatttttgagatagggtttcactgtgtcgcccaggctggagtgcagtggcatgattctagctcactgcagcttcgacctcctgggcttaagtgatcctcccacctcagcctcccgagtagccaggaccacaggtgcatgccaccacatctggttattttttttttttattttttgtagagatagagttttgttgtattgctcaggctggcctcagactcctggcttccagcaatcctcccgtctcagcctcccagagtgctgagattgcatgtgtgagccactgcacctggccttaaagactttgttgttgtcgttgtttaagagatgggactgggtgtggtggctcctgcctgtaatcccggcactttgggaggccgaggtgggcggatcacctgaggttagactagcctggccaacatgctgaaaccccatctctactaaaaatacaagattagccaggtgtggtaacacttgcctgtaatccccagctactcaggcggctgaggcgggagaatcgcttgagcccgggaggcagaggttgcagcgggcggagatggtgccactgcactccagcctgggtgacaagaatgaaactctgtctcaaaaaaaaaaaaaaagaataaatagatggggactcaccatattgccgaggctggtctcgaactcctcatctcaagtgaggctgtagctgggattacaggcatgagccactgcacccagcttgatttccctttgtaaggcacacctgcatccacctgggtcattgttctgggtcactattgcctggcttgagtgtcttgactgaggtttggctggaggaaccacgtgctcaggttcacatcccaagtagcaggggaagctgtggggctgcagggataggacgggccagagcggcattcccaggagatggcgggacccttcaggggttctgagtgtcttctaaagtcataacaaacatgcacgcttctggccctgagcctagtactttgctctgtttttgtttcttcattcgagcaagtggaggatggagtgcagccatgagtccctccgtggaccttctgatcgggcacagtcccctttccgcaagctgtgcgcgagtccctgctttgggccaggctccgtctcattcacctacagccacacgggtagacactgttatccccatctcacagatgagccaaccgagcctcagggagcctcagcacggtgcccgggaagggcggatttgaacccagggcagtctgggctcttccccattcgcagagcatctcctggccagaaccagaagactcatttctcttccttctccccaccgcgccccacctcatggggatgcggtgcctgctgtgctgtgggcaggttgcccctcgtgttgccacacagacccgagccccgggtagctcacagcagttgggttgagtcaggacccaaccgttacttcagatcgagaagcatggagggcagcgaggattcctgtggccaccttgggaagtttcctcaagatgaaggggacttttaaacatggaacaagacagttaacaatcattggagaagccagtggctctctcactccaagtctcctggtctgtctgtccgaggtgcacttggggccttgggtggagaacagccgggactcttcccgagacctcagatccctgtctgagcaattcctgtaggcggtgtgggaggagtggctcatttccattggttcaggaaacgatgctggaggctgctgtgagcccagcactcagctgagccggcgccaggtggaccgccccacactggaccatttctcctggcagttgttagcatcctcagtcgtccagctagaggaccatggatgggtcgctggatgcgacagagccttgctcctcctgggagaaggtgcatgtcctttccagctccaggtggcgagagctgggtgggacatctcaggtctagcactgcacagggcttgcggggcactgaaagccattggctgctgctactcttgtcttcacctggtgcattggggtctgtaggtggtggccaggagggtgtggctggccctgccagggggtcctggaaagggagattccctccagaggctctaagcaaagccagtactcctggaggcttgacgagggtcagagaggggcctgcagggtgccggggacttgtgagccttttcagagcacgtggcacccttccctagggccccaggcggccccaccatgggggcactcagtggcttcactggctcaagtgcagggtgattgggtcacttttttggcttccatctctccaaggcgccagaaagagaaagctagagttgcgcacgcaccacctggcgagatgggcttcctggagggaggcctggtgggcactgggtgttgagccttgatgctggccttggcctgcccagctgcagacctgctctgaggaccctatgtggacagacgcctgccccggctctgcagggagcgccgggaccctcagcagacccatggccgtgtcctcactcggcactcacgggcggtgttgtgtcccctgcaggggcgtgtcctcctgcaggccccagcagccttgtgacgagacctctgttaggaccgtgttttactgttgaggaaacaggctcagggaggctgagagtttgccccagctccgagggggaggctgacattcgaacctgaacttgtgcggcccggagttcccgcttccatgtcactgccccacgctgccaccctgtgacatgtgctaaacagacaccaccccatcatctgtcatcataatggcaaaattggcaggctcctctttttttttttttttttgagacggagtcttgctctgttgcccaggttggagtgcagtggtgcaatctcggcccactggaacctccacgtcctgggttcaagccattctcctgcctcagcctcccaggtagctggaactacaggcatgtgccaccacgcccggctaatttttttgtattcctaatagagatggggtttcaccatgttggccaggctggtctcaaactcctgacctcgagtgatctgcccaccttggtctcccaaagtgctgggattacaggcgtgagccaccgcgcctggccaggctcctctttaaaatcatcgcagcgcagttgcccccacactgactgatgttgagtaggcgtgtcctcactcccaccgatgggctgcaggctcatggtgatttgacggctgttttgcttggaggttcttgtgagttcctgctctgcagaaggcgtagggatttctacaaaacacagtggtccagtgagcgtgggctcctcccctccccccaacacgtagaatccctctttaaatgaaataatgcaaactaaaacatgattactaggcttagaactagaaagggaaatcctcaattgtcagaaaccaagagggatgtcaaagacagaaagaggagccaggccagcttggctccccacccaccccctggggggcctggaaccaggcccaccctagggcttgggccctaacagcgggggttgcatcatggtggaggtgagggagatggaatggaggcagtgcagagagctgagccaggaaggctgagagagccatggaatggggaccagagagctgtaccctggcacacagaagcagctgaccatcccaggctgggcagggaaacagtctctggcaggatacaccctgctttggcaccaggcatggagtggggcctgaaagccaggggaaaccaggagagccctcatagttatgtctctcagagcctgggggctccctccacccatggaaaacaattcccactgaggatgcacttacagcatagaacaatatatacgtgtgtttatacacaatacatataatctgtgaatatatgtatgtttaccagactagccagctggtgctcaaaaagaaacaaatcagcatgtgggagggggctagcagatgcagtcgatgagagagaatttctattctcggaaaaaaggaacagaatgcaaaagaaaagaagagaaaatgatgagcaaacaagcaagacaaaaagaacagatggaatttgagaaaagaactaaatagaaattctcaaaatgaaaattgagattgttgaaatgaaaaactcagtatgtgtcttaaacagtagtctaggtggagccgaagggagaattaatgaatcagaagacagaaccgaggaagtcactaagaatacagcacagaggaatgaagttacaggaggtgtgaaaaagaagtgaggcagaagatgcagagggaaagtgcagaaggggcagtggagactgggatgaggtcacatgtgaatagctagacatctgggttctttccagaaggccatgcaagattgggtgattgtcctacagtgaatccgcagtctacgtttcctttttcttcctggccctgtcttgagttttgattgtggatgtttaagttgcaaatactgtgagcacagcacctctgtcctcagtttggaaacttggtgcagtaaagtaaaaatgccgaagtgtttttgcggaaggacccatcacgtggagttttcggtgcctgggctctgggagcactgaggcttcctatcctctgctgaacctgcagcatagagctttgcatttacagtcactgtgatctaaaggtttctcaggtggagttacagctgatgggcctacaacctgaagacattggagataaatcattcagcaaagccaactttgttcctaccccggaggagctcacagaccgcatgccctttcctgtgtccttcctgaaccctctgcttccctgtccattgtggaggggcttcagggaccctggctctgcgaggagtccacaagtggacaattgggacgtgctcctggcttcccgcaggctttgacccagtctgtggcgttacccgtctggccagtccttaggggacagagggccccagcgggctgcatatccagccacatgggccctgaactataaatgcagattcccaggccccagagcctgtggggtggcgggggtaggacctagggtctgtcttttaaagtgccgcctttaaaaggttgtgctgtggctgtgtggaggctgacgggctgccggtgtcttggaacctgaggtcagagcaggccatggttgggtggggatggagccagggctgccatccaggatccagactcaaccaccacagcctgtcctctgagctctccagtccccacctcgttcctcagtgagtctcaccaagcgtggcctggtgaggcctggacgttggtgaatggcacagaggcctgaagctttgggagctggcggtgcaggtgggctccccagcatgcctggtcgttttgagtggcacatcattcctcttgtctttcctccctgttcctcgtccccagcacacacacattcctttcctcctgccccgcggctgtctgcgggagagggagggaggcaggaagggaaatgcagctgtgcgtcttcattcgtttgttaactgggactcggaacagacgaggtaataaaagtagggaaaatgtcatcctttgacatttgcgatatcggaagagtcggctggggctgtgggctaagaggtgtttgatcattgcctgagagccgggcccctggggacacccagctctctgtctgtcctgggagtggggtgggcacagccagaggtgccctggggagctactgtagggcatccctcctcctgcagggaggtacttctgctcctaacctttcaggccagtgggtttcacatggggccggctttgccccatctgaccccatggctatctcaggggtccggtgtctgctccagcagcccctgccctgggttttgggtcactggagtgtggttccccgtggtggacttctgagcttccccccatccccagtgccagctaggaagcctgaaattcaggccgatggagggccagggctcctccagcatagctggccatgctgaacccatggaaggggctgccccatcgatgctgcaggccctccagagcccttcatcagctgctcgtgacacgttcatcctggggcaaagcgccccaagcttggggctgaggctgctgtggtcatagcagctgtagaaattgtccacaggggccacagatgcatggacgcaggagaaccatgttctggccttggctggctcgcccgccacgcctcctctctgtctccggttccatctgtacgacccggttccatctgtacgacccgacctggggcctttgcgctgactccaggttgacaaacaggttcttgtgtgtcagcgctgaccgaatgctggtgcctccttagactccacggaggagggctctgggcctgcgcccggctcctcggagggattgatcagccacgtctgccgcaggaggtgtgtgagagggggcttgggtgccctgtagttgccaaaccctttgggatctaacattcttccaaataactgtaaggacgtacagcaatattgctttcatttttgttttccctaaatgcttagagctcttaaaagccaaaaacactccagagccaagttcctcattacttgtgaaaggccccttgtagcatcagcatgggagtgcggctgggctggccgcataatgggcccatcgagtcttgtgtgaggaagcacagaaggaccctgtccttccatgaccccagcttccctgagcgccggtcccgaatcacgagcacgtacaggaaggcagcactcagccgccgcctccttggtcgaacccgccgtctctatggttcattttctttcctcttccccttttgaaaattgctgctggaagcggaacaggctgaagggaagcctggggagtgcatctggctggggagctttgggcaagtgaccgatcctcggttttcctgtctagcaaatgtgcagcgcaggatggcctcgtggggttccctggtgtggtgtccggcacacagagcgccctctgggctccgttcctatgacgccagcacccagtggagggtgtctatgaattcggcacgtggccgtcgtgggccttttcttgttgcccacccccagacacacacgtacacacatgcacatacagctgcgcagccgtgcagtgcacacagacttgtagcacgcacaagcaacatgcacacacgaccacacacgcgagctgtcacacacatggactcacagatgtacttggtgcgatttcaatgtcgaggccgcacctgcctcctcagggactgagtctgtcgctcaggagctccattcaccccgtgagttgtgacagcttcccgcccatctcatgtgtgtgacaacctgtgcccctgggccagccagctccctgtcccccaccgcgggttccccgtattcatctgcagagcctcttgctctgtctccggcctgctagccacctgtccctttggagatctgtggagtggctgtgttgggctttcaatgccaggagacaggtgggtcctgcctatccagaggaggcccacatcacggggcaggccggttagggggagcagagggaggaggagcggctactgcttctcaccaaaccttcctcttgaccagtctgccggccaggggagacaaggagagatcccgtcatgccactgtgcacctggagctcttgaccttctgcatcccgagccctccatggagccaggcatctgtttaaatgtcatgcaagggagggcttgaagggaagcaagcagcaccctgggatatttgcatgtgggtggtgccctggctgctgggtgactttgggcaggtcacttgacctctctgggctcccatttcctcatctctgaaatgtgttggcacctactgtgaacacgagctgtacttagtaatatggtaccttgcagaacagcagcatgggatgagtgagccctttaaaggtggcctcggtgaagccctctggcagcccctgacaaaacagaccctttctgggtgagaagcagcttgggagttgttagcagcatggccacaggagccgggagtgcagcagtgccccgcaaataccagcacatccaaatgacaagttttgctcagcaaatacaaaacaagtgtctagcctacaaaacgctatgccgtgtttcttacccagatgcgatgtgctcagttaacagttctcgacgtcctgcaaagcagcgtccccagttctgtgatgcctttctggtttcttgtgaaattacaggagcgtctcttcttgtctcccccaggtcatctccgcggtgtcgaggctctccctgcacagcatcgcgcagaacaaagggatcaggtgagctctccggagtgcgctgccaaggccgggtcctttcatctccatcgacaccagcgtgccttgtcacagatactggggttggaagcagatgccctctgcctgtgtctttatcatgcatttgcagcgtgttgtcgcgtaacccgttggcggctgcaggaaggggtgtggggggcgggaggcttcagctcacaccggggaaatcttgcaagcatgttactgacggctgcaaaatctctttcgatttaggtaataagatcagcaaattaatcctttcacagatcattgcctacctaaatgcactctccacacatcagaaccgggggctgtgccgagaatgaggtagctggggtctgtttgcagggatggcgccggagcatggtggacttgcctggcttaggggctgcaggtccctgtgcagggcactggacaagccaagccaaggaatttctccactctccgtttattctgcttggactgcaaaattcagcctcagagggtcccatgacccctgtgatctggcctcctgcttctgacacttggatggggcacttgggcgtctgtgagaggagagaacagccccagatgagaactggtcactgtggattctgacccacagattgaggtcagggagaccaggttcctgattgggtggggacgtgtgtctgggagacccttgggaggacaggggccagcagggtgagaaggagaggctggaatggcagagagagcctggcctgagagcagcgaggatggggtcacatctgggcacaggtgacatcatgagggtgccctgactttgggaaggggccttaccctgatgtgatccgtgggggatgctgtgtatgactacaggctgaggggtcccaggacgatggtactggagcttttgggtggcgcagttgccccttggtgggggccatttgctcaggttcacagaggcactgggcaggggtaaatgttcctaaacccacggggacttccgttgttggattctcagaggacacagaaattcctttgaattgaggtttttaaaaaatgtgaaatataggatagacttttttttttttttgagctggagtctcactctgtcactcaggctggagtgcagtggcgcgatctcggctcactgcaacctccgtctcccgggttcacaccattctcctgcctcagcctcctgagtagctgggattacaggcacgcaccaccacgcccggctaattttttgtattttcagtagagaaagggtttcaccatgttagccaggatggtctcgatctcctgagctggtgatctgcccacctcagcctcccaaagtgctgggattacaggtgtgagccacctcgcccggccatggatagactcttaaaattaaatattaagcacatacaaaagaatatttagaacacatttggggcataaagaatagcagtcaaaaccccggtgcccagcaccctgagtactttctagaggataactaatgcctctgaggccccaccagtccctccgccaggtgcataggctattttccagctggtgcaaagtctgtaataggcaccgtttaaaacatgtttaattgtttttaaaagtatcatttctggatacaaagactatgtgttttttgtttgtttttgtttccagaaatgatggttccttctcctttccaccagcccatgacaatacagtactgtcagtggcgtggttatactccccagcctgttttttttttgttttgttttgttttgttttttttacatattaggcaggaaagagattcatgcaacaaaaaatcagtcattttaattgctcctgcacaaaatactagacttttgatctcttctccaaatccattagacattcttccaaactggaggcctggtgccgcagaccccacgtcagacgagtgacctgattctgttcctggggaggcaattggcccggcttggcattggcgtggtcctgccacaggtgcccacagccctatcccctctcctgccgcagacagtccttgatcacagtcctgggtcccagctgtgcccgtgtcaggctctcgatgccgctgccctcctgaggctgaggtgccccatctgcagctctgagggcctgtttcccttggggtttacaggtggcaacgggagcccattggtggcttcgggggtggtgaggaccatggaaagggctggccctgcatctgtcctgcatgtgtgtcctgctgattgatgaatggggaggccctttgaggcccggggtgggcaccctccctccgggccaccccctccgtcccccacgtctctggcccctccacccagccaacccaagaggatgctgctggtgcttcacgctgccgctcctcccaggatgggcagagcagtcggttggccctgcttgctggccctggtcctggggctggcagatgtacagggaaacctgccctcttccctctcaggtcggggaactgcccaggcagcatgtgggcacagtggccccctggactgggactgtagaccccagccctgaaggctgccaccccacaggagacccgagtggaggtgtgacgagccagggctgcatgtcggtggacccagctctgaagtctgtgtcctgcttagctgtggacctcatgccggagatgtctccccgagcctccctttttacatctgcaagatgaggataaacactgggggcgtctcggatttattgagatgagacctgtaaatcccagggctcagggctcggcccagagaagggctcagtaaacacactcagtgacagtagcagggtgtgtgtggggtccccaagaccatcctcaggttctcagattcaccaggagaagccattatggttgcagagaaagatctagagtcaaatcaacaaatggaaaaggccccggggtggagccaggatacatcgggcgtgggtttccatttatcccctccccatagagccttctgcatagtgctcagttctcccagcaatggtgtgtgacagtcggcatgtgtggcaacagccacagaacattgccacccaagccctggagtgcgggtcctcactggtggccggtggggttgggcatgcctgtgaggctgaccttagttactccatccccagcgcctgcagaggccacactgatcctgcatgcccacagccccaccataaaccacattgtgagcatacgctgcgtggcccaacgcctcaggtatacaaagacgctcttatccggagggcctatctggcagacactacggggcttagaggttagaggtcatctcctaggagctgagcaagagccagtcttgtcttcggcatgtggaggggttgagcaccccaagcctgctcagttacccctttctgcacacaggataggcagacatgagagacgaaggggaggtgtttgcaggccaaagggaagggcctcctgggcgcagagcgaggctttgcaggaagacctctgcaggccctcctccccggggcctggctttcctgcccttctcctccaccctccctcctctgagccccactctgggacttttcctgggtcctttccctctgcagcccttggggttgagcgcagacctccactggttcacacgctcacccgggagctcaggagacaggtgacaggcaaccctcccaggcagccccacttggtggctgcgtctgagcaatgtcccaccttgctccggatgggctgggatttccatggggaattgaaccttctgggggcagccaccagcacttcacaagacactatttcatttcgagcgttttgtagtgttagtgattagcaaaaggttctagtttaacacaaccctttccttcttgaaaacccacaagccaagcccacagccctgaagaatctctccctcatttcatggctgggtaggagcccaacgtgctccttcaaaaaatcattttcacaacccttgcactttgcataatgagctgattttccataaaagccccaattatacttctcagaggctgatgaattggagacttaatctaagaatcccgccctggtgccggctgggggatcaaacgtgttggggaagcggggcaagggggaggattgtggttgtagagtgggagaggggtttgtggaaggcacccagcgaggcgtgtggggatgtgggtcttgctgtggccagagctagccctccagattgggggtgccctaatttggggtcatcacagctctgaacggctgggagggaggagatggtgaagggtaggacttcctgagaaggaaaccgaaaggtgtcctcaggctgggaggtcaggtcccatgaaggaagcttctgtcagccaaatgaccttgggcagggatgctcttggaacctttgtctcttctgtaggctgggagcatgactctgcctcgcggggttgctctgtgtctgtgcatcgtgcagcgcagcacctggtccttgtggaaggcccgcggctgctaggtggatgtcctaacccccaaaccctgagagtgtgacgaggaaaagggttttcgcagatgtaaatacacataattttaagagggacgcaggaaggtcagagtcagaaaaaggagatgtgacggcagagttagagcgatggggctgtgggcccaggaatgcaggcagcttcggaagctggaaaaggtaagggacaaattctccccggcacctcctgaaagggaccagcccctcgataccttgacgccagcccctaagacccgcttcagacttctgaccccctgaactgtaagagtctgtgttgcttgaagccaccaactctccaactctctggtgacctgttagagcaggagcagagccccctggattggctgggaggctgtctgaaggcccagctatgtggcgtgtctgggcacatatcagcatggggtcccagtggggggcacataccagcatggggtcccggtggggggcacataccagcatggggtcccggtggggggcacataccagcatggggacccggttggggctcaaccctggctcctcactgggctgggctcctggctttgattgtctcatcctggcccagccctgccaccctctcttctgctttctgacttgtaaaaattgaaatacattcatatcacataaatgtaacccttgtaaagtacgcaattcagtggcatttagtactttcaccatgttgtgcaaccaccacctctatctgctttcacaacatcttcacaccccaggaagaaaccggtcgccatgagcagtcaccgccctccccagcctcaggcagcccccagcctgctttctgtttgcctgttctggatgtttcatgtccatggaatcatacggtgcgtgcctttcgcacgtggcttctcccaccccgcatcttgttttcaaggttcacccagccgtagccggtcattgcgtcattcctctttatggccgtggaacattccagtgtgtggctaggccatattttgcgtatccgtttatcacgtgatgaactctggcctgtttccaccttttggctcctgtgactagcattgctgtgacggctgcaaggcaggggacaggggtcaggctgaggttggagtgagagaaatggaagtaagctggaacttcctgcttcaatttgaagtgaattctcagaatatcagacatacccgtattgaatctaagcacgacaaagcattaggaactggaagcagtgacctcgcatttccttatggcttcaaggacccaccttttggtcttcccatgtgcggggggagctggtggcgggtggcaggctttatcccggagcactgggcaacgagacctaagatgcggctcgtgcagggagaggccgggtgccctcccgggatacggaggcagcttgcagagacagcctcttgctgagttctttccttttagcctctgctcctgcagtggccgggagagcactggaaccccgtgccttgctggctggccctgataatgagaaagtctgtttgtgcagtggtgagggctgcgtccttgacttccactcccaaacctggttttgccttcccaaatcacctacaaggtaccaaatacctctcatgtgagacatctcagccggaggctccgtgaatgggccttggcagactctgcagttcccacacctccgtgaacgaatgtgctatcctctctgcacactgtgagccaaggtgaagggtccgcacgccaacaccttgtcctgccccacgagtcccggcctcttctcccctgagtctttgctgtgtttgaagacattgctgtggctcctgtagccttctctcttgggcacagcatcccctgctctctccactctcttccatccgggctggtgtccctttttcttccatctgggctggtgtcccttttcccatctggtgttgcctgcttaattccaggtaattgggctgagaggagatggggacggaaggtggcagtcattatatgcttagcagctcatcccgccagcaagatgggtttaattgtcccacctggtgacatcaaacatcctggccacctgtcctcagtgggtctgctgtgaggggacaggatgacatgtgagtccctgggccagcctaattggagagtcttttttttccttttctttcctttcgttacaataatggattcaacctcctctgcatagggagtgggaggggagtaattggaagacattaaactccttcctggggaggggaggtcagaagaggccacctttggattgctgggctttgaggctggggtctggccccctccagcctgcttctggtcacagcggccagctctctgaagggtaggctcgagtcaccagctggcttgctccatcagtctggcacctcttccacaccccaggcctctgttgccctggtcagtagcacaagccaagggcaactcagtgaggagtagcagtgggcagccccagttctctggcctggcatggtcactgcctcattcgcaccactgctcctcttttgcattcgtccagccatggctggggcctccaagtttaggcagaacaaactgtgttagatggtgcgtgtgtatgggtgtgcgcgtgtgtgtatgtacatgtgcacatgggggtgtgtgtgcaggtgcacatgggtgtgtgtgtgtgcatatgggtatgtgcgtgtgtgtgtgcagatgagtgcatgtatgtgtgcaggtgcacatgggtgtgtgtgtgcattgcagatttgtgtgtgtgcaggtacatggggtgtgtgtgcatatgcagatgtgtgtgtgcaggtgcaaggggtgtgtgtgtgcaggtgcaaggggtatgtgtgtgcatgtgcagatgggggtgtatgtgcaggtgtgcaggttcatggagtgtgtgtgtatgtgcagatgggtgtgtgtgtgtgcacacgtgtgtgtatatatgctcatgtgcccacacccatctctgcactgggagctcccggcaggcctggatcttgctcattctgtatcccagtatctcccacagttgagtctgaatgtagggatcatgccagcgggagcagcaggcacccagagtgttttggatcctccctggggcttggttgcaggttctcaagggctggtgctcctcatggtgaggacaggtgaagggagggtgctcggctgtcctgtctgggcagtgttggcatggggagggagagcccagggcactcaggcctggcttggtttcttttggtttagggatgccaatgctgatgtggcagccaaggctagtgacagagctggccctgggtggggaagcgctttggtgcagcaaaggggggcggcatgtgtgggttggctgtagtgcagggtgatgcagactccgcttggccgttccctgccccgctctagccttttgggtgcttgtcagatggaacctgccacacctgtgggagttgccactggtgggtgggactcatggtgcagagaggggacaagcaagcgtcagcagaggccgctggggcagggcctccccagtgcctgagggattccttttccatgcactagacctggcctagtgtccagtgctgctgctcagcctgggggcagctctgtaccaagccttccaccctctcttggccgaggaccctctccccatgcttgctgactggagacccacacttgggaaggaatgagtggccctggggtagagggaggccacatctgcaggggcagcagaacactgacctttgctgtgctaaagccacaacctggcccactggccaccaggagtgtgcacctggccccacggagaaggctttgaacctcttcctgctgtcctgggcctgccacggcttttacctgacagccgagtggctggcggctggaatccagtcttgccacctcctagacctgggatgtcgtctgtgaatagggtgactatggcatcttgtgtgtggggttttcataaggactgagtgagagaatcgggtgactctctgggcctggcacacgggaagtgcatggtgcacattggccagtgcaacctggggtgagtctatgtgtagcacagaaatggcagggggggcccaatgggtcagcaggggctgtgcccccaccctgcacccctagccgagtggcagggctagggaacactggtgtgtcctctttgcggctgccaccatgaggatgatggtgtaaaggagacacatttgttcagaaatacagtaactggctgtttactgcgtggctggtgtagatgagctccctcttgctggagacggtcaggagaagcagggctggcagcctggcaggggggcgtgaacagccagcctgagcttctgcagtggggcagggatctgcctgtgtctgtctttaaaagacaaaatgcagctgagtttctctctttgctccactcccggatcatcacagccattgtcagatgaacttgctgagctgccaatttgcccactgagaatacttctctggctcatctaatggattttattattgcttttctcctctcactccctccttcccatccccgcactccccccacccttctgctctgccttctttccttccttctttttattcttctgtctactcacttatctacccatctaccattcattcatcatctatccacgtatatatctacccatctgcctgtccattctttcatccttccacccatccaggtaccctacaacccatccacgcacccaccaagccacccatctccctgtctattcatcagtctgtccatccgtcccctcatcgctacatctacccacccacccatcattcaagcaccctacaacccatcaagccacccatccacccatccattcttcagtttgtccatctgtccactcatcagcccgtctgtcactcatttatccatccatccatacatccatccatccatacatccttccaccacacatccatccatccatgtatccatctgtccatccattcatccatccttccatccatacatccatgtatccatccatccatccatccatccatccatccatccatccacccatccatccatccatccatgcatccatccatttattcacccacctatccatccatccatccacccatttgtgcatccatccatccatccatccatccatccatccatttattcacccatccatttatttacccacccatccatgcatccacccaatatacccatccacccattcattcacccatctattcatccattcatttatccactcatccatccatccatccatccatccatccatccacccttctgtccatttcgctctgccctatttcacatgaatataacgcgattggtctcagtgtggtactctagaatcattaaggctgcaacctctgttgtgaggttaggacccatctgctcccaggcacatagtaggcacagaacaatatgatgtgggtggatgaatgagctgacttggttcactcgggtgctgatgagatgctggatcaatttcttacaccctgaacctcagtgtcctcaccggccctttggagttactggattgttatgaggattcaaaagatgatgtctgtaaagttctcagtatagtgcctggcacacagtgggtccaaaagctgagagtcaggaggaggaggaggagctgccactctgtgcctcaggttcctcctctgcaaatggggatctcccggcacccacctggaaggctgcaagggttaaaggaggtcgtgtgaccagactttccatgcgacacatggctgcaaagttgtctcctgagtgcgtggtggaggccatgtggcaccatctgcagcggaactcaggaatcccctaaagcccgcagagccccaggggcatgactgtccatgaaagtggttttagaagatgctggagaaaaatgtgcctcagcagttgtgtgtctgctccagttttcagctccagagcatcacacctgccctaggcctactcgggcagctcagatgcctggaatttgggcttgttcttcatggcaccatgatgggggaggacatcctaggtgtgccagtcgacagcagggtggtaccctgcccaccattggctgatcctcgtggacaaatgtcacttgtgtcaagatgagagaaccctctgtttgaggaagagcctgagggtgtgagcttcctcctgggctgaggcacatcagggcagtgagatgggaagacaaagggattcagggcaagtcctgggacctggcaggtgtctccaggtgaccccagtgggctcacggggccctgctggctcacatttcagaggctgtgttcagctcctagagcctggcacattcataccagaaggatctttcattccctcccgttacagatggggaaactgaggcccagaaagcatcactttcctgaggtctcatgatgttgatactcagcccaaggagtccatagccgtccatttgtttctttatttgtttgttccctcattccctcattcgttcctcattctattggtgccttgttctgctgggcccggggccaggtgctgggacatagcaggagctggccagccttgggatgtgcctggtcatgtggggagtggacaccgggccactggtcacgtgcaggtgaacacactgcagctgtacctgggtcagggcagagcagggtagggcgtggtgggtcccagacccggaggctcagggttaagggcctggcctgaggttgagagacttgggttcgaggcccggctgggatccttgctcctggtgtgaccctcaccaggttccttagccctgagcttgttccctcatctacaaatggaggcccatgtgggcctgatgggcagagctggtggtgagggacccaaccagtgaggcacagccgcaagaggtggttctcaaagtaaggcctgaggaccatgcatccgggtcccctggctttccatctagatcccagacaagcctgagagaagggggtgtatggggtgaatggtgttccccaaaagctgtatccctccgaacttgtgaatgggactgtattggataaaggagtctttgcaaatgtaattaaagtagggtcctctagatgagatcatcctgaattacctggttgggccctaaatccaatgacaagtgtccttataagaaccacgcagaggagagacacagggagaagaggagaggatcgtgtgaagagggaggcagaggttagaatgatgtagccataagccaggaaacacatggagcccacctgagctggaagaggcaggaaggaccctcccccagtgcctccagagggagcacagctctgcagcacctggatctcaggcttctggcctccagaactgggagaactggagagaagaaatttctgttgttttaagcccccattcgatggtgcttggttacgcagccccaggacacaaacacagcagggacatgggtttcacttcacagccagctctgggacgcagggtccaggagggggtccctcagccacgcctcctcagcctagcctgcctgtggggtggaggcctgcactccctggaggccggaccagcatcctcacgagccctaaccagtgcttcttaacgtagccctggcatccacgagaactcccggcccaggaggaggcccgcagctggtgggggaggtttggggttcaaggacacccctccaggtagcagggatgaggggtgagccttcggggtcagtggcctcctccttcccagtgccctgtcccaagtataatagcatggtgcgttcggggcgggaggaatgtcccgtgcctgctcattggcatgaggtgaagccctttccaactcctgtccttccctttagggagcgaagatggttttactctgtaacaagcaaaacaaaccaaggccgcctcttcagcaactgtcagcattaaaaatgtatctgcgcagctgggtaacattatcggctcattttcagagactgagaagaaaagacacatcatgttttgtggtgggatttatacataagcagatgagacgtgagatcattaagaatgtcccggaacagaagatgacgtcttggcatggtggtgtcttgggggactgtggtcatacattcaggttgtggtggaaacaaacccaaacacgggcctgggtgactgcacagccggtgccaggctgccatgggatgggctgccaggagttcaggggagcctgaacgacgcaggagcctgcctgggcccagagctgtctgcctcacccccagcccatggctttctttccccaaagatgcccggctccacgtgaggcatgttcccaggggcccgtgcctgccagcacatggcctggttttgaaggcagcgcttagcggcgtttcgacaagagaggaaggaaccctgggatcggccatctggtgcccttgctggttgctttctccagccttttgttccgctctttccctattatctttattgatgcattaatttaacttgtaattactttgaacactcacaagctggccagtcaacccaagaacaagaaacttggaagtttctaactcttaggacacaaaggagctgcgtctactccagcgcctgccaggaagtaaccaccatcctaaatttggggtttacccttttatcaaaattcaaatactgtttcgtttcatcttcattgctttggatttttttttttttttttttttttttgagacggagtctcactcagtcgcccaggctggagtgcaatggcgcgatctcggctcactgcaagctccgcctcctgggttcacgccattctcctgcctcagcctcccgagtagctggaactacaggcgcccgccactacacccagctgatttttttttgtatttttagtagagacggggtttcaccgtggtagccaggatggtctcgatctcctgacctcgtgatccgcccgtctcggcctcccaaagtgctgggattacaggcgtgagctaccgcgtctggcccattgttttggatctttacatgaggagacccattgctgttgaagtggactcttggacttgcttctttccctccctgttagtgatcagcacggtttttggcaagccactctgtgtcccatctgtcactgtggcccttctggagctgccccgtccacccaccatcatagcagccacgaccaggcgtgcacagggctgagcacctcccaggcgtcagctcattaaatgttccccttgatcctgggagtcagagattttcgcccccattttgcagaggaggaagttgaggctcagagaggtcacctgtagcccagggccaacccgttgggcagcgtggggctggaactttatctgacgtcctcaagtggggtctgcctgggagtcagggggccagggttccgggcccagtattcatctaggcatggagcccctggcccagggtgtccgggctcttcccgttcggttcttggtaggactggcctctgacagctgagaaaaccagcctcatgcgtcatctgctgaccctggggacaggagaggctccactgcccctttagggttgctggtggggagactgaggcaggcctcaacccctgtccagcaccgaggtttcagccctcccggaggtggggctgctcacgctgaggcgcggtgcaaggtcccggctagggttggtggctgcggggtcctgggttttctgctatttggagaattttgttcttggatcctcccttccctgagcacccacttggtgggagggggcagctgcaggatgggaaccctgcacgtcgctccaggttggggatctggcattttgggagcagggagggtttggatggaacaggtatcccaggaaggcagaggtgaggcatggccagttctgattggaacttaaggctgtaggcctgaggctccaaggtgggtagttgggggcctggacagctggccctcgcccagccccatcccacccagggccgccttcaggcccacggctggcaccacccacagggtcaaagcccagttctctgctgcaaaggagcccagccaagcccatcccctcggggttactgtgggagagtggggctccatcctcatcttcacgcttgctgggagcccctgcccagtggcctggtgacccgatcactggggcggacaagtcgctccctctcatccctgccgcccgtcggccagtcatgttcacctactgtgtgcagcccctccaaggcccagagttcccgggacacggtctcagggtggcagcagagggatggggtgaggtgggaaccctcagatgcagtggtctgtgcgcctcactgaggaggccatgccctggctgggccctgatggccatggggaggtctgggacagggaggcccaggcagaagccctggggaactgcttggcggccctggatagagagcggccggggccagggcagccagggacagggctggacaggggagggagcaacgtgtgaggggagccctgggggttccagcagggcagtggcctctgagattttgtccagacccttcctctggccctgcctggcctcaaggggctccagagtggaggccagggccaccgaggggctgctgtggacgcccaggtgggagtggcggagggttgtgggtcgggatagcaggaagagggtgagcggggctggtagccaacaggaggtgccgacaggaggtgccaggggtgacacccaggccctttggtgtggtcagtcccttgcgatgacccagggctgctctccgaggcatggccaggtggtgtgaggtcctggctcccagcccacctctgccactttctggctggcctccttgggcagctttcttcacctctctgggcctcagtgtcttctttgggatggagacggaaccccatcttgtggggctatcgggagcttcagcacagcttccgtcctgtgaggccttccctttcccctgctctgtgaatgtagaggaaagattggggccccactgtgccctttcagctgggtgggtgtgcccccaaccctgctccaagactccaccaatggacagaggctggtgtctgtggagcagcttgaccaggctgtcctgggactcctgagactggccccacctcggtcaattgatgccacaatggagggttgaccagggctctcctggaaacctgctctctgctgggactggcatccctgtctcaccagggctgataaatccatcagccacctggagtgtgtccatcccagtggactcagagagaatactgtgattgactagtgatgcctgccatgggcaggggatggaagggtagtggctgctcctagacaggccctggggttgctgtccctgtcacagccgatcctccaacgtgaggccccgtcacactagggagactgccaaggcctcggccacccagctgacccttcatttcccagcagacaagtcggcaggaagtgcagggagggggaagagggccttcagctgctgcgtcacccagtcccccttggcagcctagagaggagagagatctcgcctgaggtgacacagcagattggtggttgcagagaacccccagtgcggccccccattctggccctcccaccccagctctccgagtagggatcctgcctgcagctcccagcttccgagtgtttgctggaggaaggtctgcattttaaacttgttgccttgggcgtgccatgcgggctgttcctcctgggtctcagaccagagcccctgccatccagcccgtggattcagtccccggcctggcccagcgcgtccacgcttctgcctctggccagggtgggacacacgtgcagacaagccgctgtggcccatgtccgcccacccaaaactgcccagcctggcttgtgtgatccggcgactgtgccagacgcgagagcgggggaagctcaggaagccgtttgtgtgctgccctcctgcaacagacctccactggcccagggaaggaaactgctgtgttcagggagaggtaaaaaaaaggaacggtgtttccagtagctgacagagcgttccatgttcacaggaggatctcagagctgtcctggttggggctgctgaggaacccgggagctgtctggggccctcatgggcaccgtcgggcacagagagtgctgacctgcaggcctggagtctggaagcttgggcagacccaagccttgcctcagtttcctcctcgtgaatcagacctgtcgtgtctgcgttcctgtgccatagtcctcattagtcactctgtccacctttctctgcccagcatgactgagctcggccgagggtccccaggccaaggccagaggacagctgggggctctggcccatcagtgcccagtttggaagcatcctgatccctgtcctgtgtctgcagggagtgtgtgtagctttgggtttgcagaagtgagatgcacagaggcctgacctggcagctgggtggagcagccgtgccagggactgggggtgcaggcctcagccctggaaagcccctgctggcctgtgggccgcaacgcccctgtcctagagcctcctccctcagccccgttctctgatggacaaatcctaagtgtttgtccagggggtttcctgccaagcctgggcaggtgttccctgggaagagggctggcatggagtgaaaggcagagtagcttcgggggctctgcatgctcaccggggaaggacaccctgtggaccactggccatttccttccaaaccggtgccagccgaggttcccttacgagaagcgtgttggaaaataaaaatatatattatgccttacagctgctgagaagtcacattcctctgtaatcagcagccacgccaggccccttcctctcccagacaaagtagagggggcaggggaccgagcatttctttccgcctgtgagatccgtgtcttcctctgccttgccgaggttctggaaacaggggcagaaacagcctcgctggattgggggtcacgtggggtctctcctctggggctctggtgtattcaccatctcccctggtggccttggagctggccacacccccacctcgctggacctgccatggcagatgtcaaggtcactgccggggctatggcagtggttgtgcctcagtgcccccaccttccaacccgccactccatgggacagagaccctcctacttccatcctgactttggtttcagaccctggtggccacaccgggccagcccattggtcactctcgactccacccccgtgagactcctgccccacttggcacttgagtcttcatctaccccctgcccgggctgcctgctccagcccctaaaccatgcccatgtccatcatcaccttccccctccttccttcacataccacatctgaggcaggtggcttgtccaaatattacagtgagtgagctgaggccagggggtgtagggcccttagcaagcctgtagctaggagtttgtggccagggttcctactctagcctgtcttatacaaagctggaactctgggccaggtacagtgcctcccacctgtaatcccaacactgggaggccaaggtgggaggatcgcgtgaggccaagagtttgagaccagcctggacagtatagcaagaccccatctctacaaaaaaataccaaaaaaacccaaacaaagtcagagctctgaactcaaaattagactttactcttcacaccagctcccttgccgccacctgcgagaagcccttcctggtttccccaggttcagactccctgccaccccgagctgtctctgcgtgctccctgcacccctcggccctgtgctgccttcgtgctgggtgtgtcaggctcatctccgacactgccatccccgagccgggtgtggccatgggtggaaagccgggttcgacctggcctcctcccattgtgatagccctgctgggctgggtgggatggcgcgctgaggaaagaaacgtgatccctgggcttgttttgacagttggagctgtttagcaggagaaccgtttctaataagcgaagccctggtgcttcaaggcctccctgccaattagaaggcggcacccaggtgactccctcaataattaaacgggtctggcgggccctccacgctgcgcttcctgatggtgcctttcaagtttgcctggctgctgtttccccggcacacagtgccaaaagggctagggcccggctcccatgccctgggcgtggggtcccatggcccctccacccctctgcccgcgctgttctctttctcctcactatggcctccgcctgggtgagatgccactgcacctggtggtgttccagtaccaggccagcacctggccctcccaaagcctgattttgaagctggtttcagaattggaaactgaggcttagccaggcccccaccaccccccgatagtgtcagcaccataaatggaaacactgttgtctgccatctgcaagactagggtggccaacttgtcccagttacagcatcaaaagtcccgcatcccaagaaatccctgtcctgggcaaacccggacagtagatgtcagggctggccgcacctggcctcagaggccgagggcgctcccttagggccgtgagccagtcccgccctccaggatgtaactcgaggctctgcctgttctctcggagtgctccggctgggcgaggagcaccagggtcacgtggagcagcctccctgatacactgctggtgaacacggtccttggcagtcaccgtgcggggccttctcttctgtgagtcgggttccactttctttctgtaccggccaagtggaggcattagggactgtctcaagccctggatccttcacctgagatgccagcagagtgtgggaaacaaaaactgtcctagactctgtgcatgatggctggatgagccaagcactgatttctgtaccttctgcaatcgtcagtaccttccagaatccaaatgttcattgagggctgcgttcttgttcagatgtactgtgggaggaagtgctcagtggggtgccctgcctgagccatggcagggccgggtggaccatctgtggggaggggcgcttttccaattgtgatccaggaattggtcccactgcggctggctctggaggcagagtgggctcaggctgagctggtggaaagcggaaggggagagacccacgctggcacatgcaggatgctcactaggaggcttatgcaccatctcccttggtcttagcaattgctactaccggcccccattctgcagttggggaaactgaggctcagagacaggcagagccagggcttgaacccagacccattacctgcagaagccttgctcttagctctccccacaaggtctcccctccagtgagcacagttgaggtgctggggtctgttctgtggcttctccctgatgttatctctgggtgtttggggacggagcctgggagctgcatgttggccctgggcagggctgtttgtggacactcactccaggacgagctgcatacctgctgggtggattcactctttaagaggcaagaggggcttccctgctctgaggtggtggttgtccccagggaaacagggccaggactccagggctgcaggagtggccacgagctctgcatgatggagccctggagtccactcaatatgcagaggagttcgctgccacatggggtcaccaggcccagtgctgcatccgagatggttttgaagcacttggccagatcctggggcggtggtggtgtgggggcccagccttctctccctgtagctgctgctgttgtgaaatcttagatcagcaccaacaagcggtcgtgctccccattgaaccccacgtttgaggccccacagtcctcatggaagcacagtaaggcgtgagctgtccgggctcgtcccctagaacccaggcacctgctacctgcctgggaaggagggcagctgtgtttagggtcctctctttgctactctggtctttgtcttaaaaaccaaatctggctgccggctcctcagggccctccaagaaagcaaacccaagctgtcgtccctctagctgagatcctgagggtctgcactgacagacctgtgcttgctaccctcagcttggagacccctgcgcgtccaatgtgcccctccctctggactgtggggccaccatgcagctgtaggcacagtgagtggcacaggtggtgccctgcagacgccatcgtttctagcagattttcacagaagtcctgagggcaaggataggagcctgatttattatcccaaagcgagattcaagctgttccttctccctgaatcagtgacaaatggccgcccatgccagccccacgcaggtgccccgtaattccccggggaaggacgggaggagagtgaaggagctctttggaagcaggagctgtgtttcctctgctcttccttcggggtttgggtttgggcacccctgtagggtgttctgttttctggtctgtgtcctctggctggtgacttatttggctgtagcactgggactgtgattgtcctgcccagaattgagctcatggggaaggcctgttgggggctgggggagctccttgagcaagcagtggctcaggggcaggagtggggagtgggtgctgaggaagcttggggagtgggattggatgggtcgtttgggaggaggggctgctgcccaacgcgggctctgctggggatttctctgcactcagcacttggggcttctctgcttcctgtgcggacatctgcttcgtcccctcggcggtgcagtgggaaactctgcttcccgaagccgggcacgaggaaatgcatgctcaggaaggctctggtgggaggagagggatgcagccgcccctggggagccaggatgactgctctcaggacaacttctggataggctgtggttggccttctctgcttctcattccctgctcttaacgagcaaggcaacgccacagggcaaggtgtgggtaggggacgctaggggtaagtgcgggaaggaaaatcagctggtgcctgaagatggcctcgggggcggggagtggggggtggagctaggccttgttgcaaaatgaccagagtctccacccaacccacccccactgggctttaagttacagctgggatgtggccccaggaactctgctcagacattctctgtgcaaatgtgtgtcacactgtttaatcgaggtcagtgtttacaaagtccctactgaggggtgacttaaatacctctgtgtgatctcttacaagctctccttgaaaatgcctcctcgtgtaggctgggcatggtggctcacgcctgtaatcccagcactttgggaggctgaggcgggcggatcacgaggtcaggagtttgagaccagcatggccaccatagtgaaaccctgtctctactaaaaatacaaaaaattagctggacgtcggggtgggcgcctgtaatcccagctacttggaggctgagacaggggaatcacttgaacccgggaggcagaggttgcagtgagccgagatcatgccattgcactccagcccgggtgacagtgtgagactccgtctcaaaaaaaaaaaaaaaaacttcctcgtatctaatttgaggctgccatttcaggggattaagagcagcctgagaatatctgacacccacctttctgtccacttatccatgcacccactaatcccacccaccaacccactcatttgttcatccatccactcatccatctgtctgtcagcccacaaagtccaactactctctcatccatctgtccttccagacatgcatccatgcacccatgaatccagccacccgacaacccatttatctatccttccacttacctacttacccacccacccatctaccactcatccacccatcccaccaacccagccatttacccatctagctacccatccatccatccatccatgcacccacctagccattcatccaaccactcgcccatccatccattcatgcatcttttcatccatccacccacctacccacccatccatccatctacccacccatccatccattcatccatccatccacccacccacctacccacccaccccatccatccattcatccacccacccatccatacatccattcattcatccatccacccacccacccatctatccatccacccacccacccacccattcatccatccaccaacccactcaccaacctatccattcatccatctacccacccactcatgcactcagccatccatttatccctccatccacccatccattcatccacccacccattcatccacccacccatccatcaatccacccacccacccagctagccactcagccatccattcgtccttccatccacccatccatccatctatacattcacctacccacttacccatacacccatacatccatccatccacccacccattcatccatctagccacccacccacccgcccacccatgcatgcatgcatgcatccatccatctacccacccacccacccacttacccacccatccatccatccacccatccacccacccacccacccacctacttacccacccatccattcatccatccacacatccatgcacccactcagccagccagccaaccatccaccccccgccatctatcctccacctactcatccatccatgtactcatccatgcctttctagcgccaggcactgtgctaggcagaggcagacccaagctgagagactgatcaagtcttcccacatgcagtagggcttggattcagccctgaaggatgctagcacttgggtgaatggtgggagggtgggggactaaaggcagagagcagagcaggtacaaaggccagaggtagcatgggcatggagggctgtggggggagcggagtgaaaggggactggggcctggtgaagcctcctctattctcctgcatattcctgcgccagcggccaggcgctgaggccgtgcacggtccctgacaggctgcctccctctcctgctcttccccttctggcagagcttttgttgggctgtggcagaaattaattggatttgcagctccattctcaaggggatttgtggcctcaaatagggatcttagaataaaagtagtaaagattttacgggcagcagtataattctttggactttaacattcctgctttatctcctctgggttgggcaggtaaaggaaatgacagtaggggttgaacaagacaccaaatgagatgcaggaaagggaaaattacgacaatcatagctcaaggtcaggtttttaaaaaggttttttttttttttttaatttattttttttgagatggagtctcactctgtgacccaggctggagtgaaatggcacgatcttggctcacagcaacctccgcctcccgggttcaagcaattctcctgcctcagcttcccgagtagctgggattacaggcgcccaccaccgcgcccggctaatttttttgtatttttagtagagacggggtttcaccgtattggtcaggttggtctcgaacttctgacctcaggtgatccgcccgcctcgggcctcccaaagtcctgggattacaggtgtgagccaccgcgcctggccgacaaaaggttttgaaatgactgttgtgccttattttagtgggcactcactttctgtgttaggaaacaagattccaaaatcatcatggcgagtggggctcttaggccctaacgaggcatcagaaggcagttttcttgggcagtggaaagtgccctgagtgagaatgatactagaaatactaaatcgcagctgccactgttgggcccccctaagtacagagcattctgctatcctacagctgctcttcccagcagacctctgagaaggcactattacttccattttccaggaggagaaggctgacactcagagaggttaagtaggttgtccaaagtcacagggagcaggctgtgggcctagggttcacacctgggtttgcccaactccaaagcctttcctctccttcgctgccccgggctcagctctcctggcagggcaggtgggttctgtctgagtcccaggactgatggaggagtagagccctgtgttaagaaccctgcgctgggcttcagggataggagagctttgattggtgagtgatgtctgcctgggcacaggaagagtgagaggcacgcgtgtgtgctcactcaccattagggtgggtttccttacaaagtgtgaatgcatctcttgatcggcttagcagggcgggttctagaagtacagtccccgaatggccgtcctgttgataatccagggttcgatgggatgccctgtttccctaaactgtcgcccacactctgtgatcagatttgaacaagatcacaacctcaggagtttggtattttctcttccctctctacattctacgtgagaaagcacattaatactttgccatgatgtcattttatatgtaacatacttttataggagatgagtggggtttaaaatttttttacttttgatgaggacacattttcataatgagaattttgattctatttttctttattatggaagtcataccaatcatcactgaaaatttagaaaaagcagaaatgactgacgaggttggagacagggatggctgcatgtaagcgaggggctggtgcgggagcggggacagcccagggctggtcctggcagcggggtttcaagcctccatctctgggtcctgaagtcacatctcagcctggcagagcctccctggctcctggccccccacgtgctcctgtgctttctggggtcacctgcgtgtgggccagtcccctccaggttgtggctcctcagccccacccccatcacctgggcgggatctgtgtcggcatggggctctgcatatcatgggaggagatggattccttgaggggcttcttggccgtaaatggcactgtctcagcaacggagccctgatggtgaggatgtcgtggcagcctcagctctgcctgtgacccagggacacacacctcaactgggggatgctgctgtatggtgatgggtggaaggagggagagtggctgggaggagagagctgagctcacccatgcagaggtcaggcctggccgtgctgcgcccttggacacgggcttttaccaggaagccacaggggcacgctgaccaatggcccagtccctgcaggtctgtgacagagccaggtaggacccaggtttccagctcacagatcagcggactcccccctgccctcccgcaggagcacaggtccccggcctccggttggggcggggctgccgggacggaccgcgcgtccctgctggatctcgggctgagcaaatgtcagcctgaccccaggcaaggaagcaatcccagctggcatctgggcccgggcagcccctccagctgggatctcccgtcccatccttagtgacaggtttcctaccagaacacgcaccctggggctacagggggctgtttggtttaattaaggggcctttcgtgtctcctctagagatgagtggatttggcccatagcgttgagccagctgcagccccctcttctgggtgtttgatctgcctctcctgcctctcctccctccccacccctccctcccttccgcctctccccgcttcctgaggctgacctgacatttcagctctgagtggttggcctgtgctggcctgggctcgccttatgcagggaggcctgtagactcggggccacacccatctgtctgtctgcagaggatggagcagagtgatgttttgggtcctgggggaggaaaaagcgcttccttccacccctccaggttcttgagctggtttatgaattaaattgacataagacagatgagcaggagaaaaacaattataattatgtacatatgcatgacagttccacaaaaatgagactcaagaagagcccagatgattaaagtttatgtgttatatatatatatatatttctataccatcgtgaactgcagaaaggcaccagggttggggcatctggagggcggagtgtgggggagcaccgccgcgttccttctggggagaccccatggggcttctgctccctttgtaggaggggaggctgtggatccaggcggaaggtccgagggcttttcattttcgggactctcttcctgacctcaagccagtggctggtgggtggcgtgggtgagcccctaccctcagtgcctcagaagtcacccctcccttccggagtcccctcctgcttcctctcctgcgtggactgagctggcagccctcccacctgcccaccaggaggtgtgcgaggagcctcatctccactgtgaaccccctggaagtgggagggtgggtaaaggggaaggcaggtcgcccagcagatgaacgctttctgcagccctgacctgggcctctcgtcttcccactggacacccggagcccggagtgggcgtgacacattccttgccccctggcaagtaggcatgggtctcctcttgccctatggcccagttggctcgtcctgtgactccgatcagtgtccgcgcaccctgtgtccttccagagagtggacaagagcccctttgctcctggctgggccacactgggctctgctgtggggtccagctggggtcccactggccggcagtgccgggacctgctcacctccctctcgccttctcttccgcaggccttttccctcagaggagaccacagagaatgacgatgacgtctaccgcagcctggaggagctggccgagtaaggcggggggatgggaggagggatggagaggagggaggggcagggaggttcctggtggtgtccagggagtcaggaggaaacatggcggccacagtgcaggcagagctggccctggcccttcccaccggggcatctcctcatgatgggtcatggtgtgggcttccgtgctgagtgggaaggcatgcatctgagagacctcagacatgagcagatcttcatatcccttgtacattctagaaggctgcccagccagtctaatggctggcccgggtgttggcccattgccctagcagggtcctccatgagggcttgtctctgcgaagctgtggggcagagagggggctggccatgctccccaagccgggtcctgggatgccgtgttgtgaggagggagcggtgctgcctggagcgcaggttcagggcacaggagtgtgtgggctcggggttaacacgtggcccggcaggcactgccctgcctcggtggacccgcctctgctcttctccgtgtccacctcattcctctctctgagaggcctctgctccacccaggcgctgcccaagcctggccacagcaccagggccccatcgggaccgtgggaatctgtgaccagggtgggatcacgtggcccgctccaggaggagggaggtaggagggtaggaggaaggggcctcacctgcaggtgagggacctgggctgagaccgagcatccttgctggggcctcacggcctggctcatccaccaccctcccaggccaccgggagatggtgccttcgggcatccttgctgcctgggggcctctggagctgtttgacagcagcttgtgtgttcttagctcaactacggtttcttctggaagactcttagtgtttctctctcccttcgttttagagcacagactgagaatgacaaccgggagaggagtaagagggggagctgcgtgtatgggagtgcctgctgtgtatgctggggctgtccctgtcttactgctcagcccacatccagggctgcctttagcttgcagggcccaggaaaatactttccgcaggatccctgtgtatatacacaattcaagtcatccccatatcagcatgtggcaccacgctggcggcccagtctcatgcacttctgtgaaagaaattcctcacccaccagctggagtagctgccaccagcccatccctttgatgctgggctggccacggggtccttggcaaatcccactggccagactcccagagctcctctggacatccggtcggccccacgtgggtctgagggttgtagagcatcttaaaggggagagatgggcacaggggccatgcaggtcacagccaggcctggggcgcccacctggaggccactgtccaccctgaccagcctcaggaatctgagggagacttcaaaaattcaaaaaaaaactgctcactcctggaatcccagcattttttggggaggctgaggcgggcggatcacctgaggtcaggagtcggagaccagtctggccaacatggtgaaaccctgtctctactaaaaatacaaaaattagccagatgtaatggtgggcacctgtaatcccagctacttgggaggctgaggcaggagaatcacttgaactcaggaggcggaggttacagtgagccaagattgcgccactgcactccagcctgggcgacaagagtgaaactccgtctggggtaaaaaaaaaaaagaaaattccaaaaacagctcactccagcatgcaggcttctgagactgactgagggactgtccatctcaaccctgtaaggggggaggaaactgaggctcagagagggcagggcttctggctggtggcatggccagagggaagtcccttagggataaggccccaacccccagcagagtctgcagccaccctacttgctatgctcagagttggaacatacccccctgtacccttcctggcattccttgccttggaaatccttctctgccacatccaggccaaggtgtctcccactgtgtgaagctgctccatcctggccagcgccccctcagcacccatgcctctgttgggtctctgggctgcccaaggggtgcacggtgattagggggttaaatgcctgtcccctgcctatcagagggtcagaccctgcaccttcttcctgtcctctcctggtccagccctagcagggcaagccttctgcacatggtaggatgcctgtacccacaggacaatgacagcaacagtgggcggtgcttacgagcttttttggggctgggcactgctgggcttcattccctcaaatcccccaccctcaattgctctgtgaggtctgttctgtggttgtcctcattttacagataaggaaactgaggtccagagaggggacaccactggcccatgtcacccagctagtaagtggcagagccatgatttaaccctagccccccaccacacagagcctgtgccccccagagcctggggagctcctggccggtgtgagggcaagtttctgacctgctatttctcctaagttaccagcctgaggttgggattctgtgctctccagaaacatgcctcagcgtttctggacagtcagcacaggagggctccgggacgatggggcccacatcggccttatgtggccagggactgacatgaaatgcccactccgtaggagcctcctgggtgttcagcccaggacacttcctgaactacagcccccacatggccaggcctgcccctgctggtttatagtgcacattcagtttagaggatttctgcctggagagtcaggctagatcccaggttgcccattttctttttcattttttttttttctttttttgagatggagttttgctcttgtcacccaggctggagtgcagtggcgcgatctcagctcactgcaacctccacctccagggttcaagtgattttcctgcctcagcctccccagtagctgggattacaggcatgcaccaccacgcccggctaatttttgtatttttagtagagacaaggtttcaccgtgttggccaggctggtcttgggctcctgacctcaggtgatccacctgcctcggcctcccatagtgctgagattacaggcgtgagccaccgtgcccggccagttgcccattttccatctttctctgcccgtcctgattgtgactgatctcttgaaccaaaatgcaaggtggaattcctctcacccagaaaagcagctctggggaacctgtggctttgcactgtccaataatgttattccctgacattaagactgagcctccttaatccaacgagctctttatgactgcagttattgcaaacgtaaatcatcagttctaaggaaggggaatgcatttgaatctttaacttgcaatttggtcccagtggctcaagtttaataaattttttatgttgtttttccccctcctcctttcactgaaaggcaagatttcctatcctttctctgtggacttggtgtggatatttagccattatggcaatttacaagacacaagcgcatgccatttcttacctggatcctacttggggaggtaatgtagttgtgaattttcaaagctggagctggggaaatggtctaatcagaagccaggtctattagtattacagtttaaagattgcttgaattgtaaaggaaagaggtttagttgactcagttccaccggactggggaggccccaggaaacttatagtcatggtggaaggggaagcaaacacgcttttcttcacatggcagcagcaagaagggcagagcaaaaggaggaaagccccttataaaaccatcagatctcgtgagaactcactcactatcatgagaatggtatgagcgatacgagggtcaccgcctccatgattcaatgacctccttccaggtccctcccacagcacatggggattatgggaactacagttcaagatgagatttgggtggggacacagccagaccatatcaccaggcacaggagtgaggagaaggaagggacatttggagcagaacgcacctgttctttgctttgggcccatagccagatgcccaacatgaaggtcaccttgaatgtctaaaggactccgctgactgcccagaccccagacactctgcagctgtttggggaaagtcaaagactggctcacagatgcagcttgtctcccagggaacctgcaaatgtggttttaggacaccagcgaggggcaccgtgtgagtgcctgtgtgctttcattcattcacacgatcatcgttcattccatcgtcagctggttcctaaacactctctgtgtgtcaggcttggaaccaggagctggaaacatattaagatgaagacacatttcctgcctcccaagacccaggccccatggggagtgtggaagccgaaggacagtttcagggcagtgtggtgggattacagcggagccacgtcaaaaaataagaagggacaaacgaaattaatcataagaatgtattttataggctgggcatagtggcttacacctgtaatcccagcacttcactttgggattgcttgaggccagaagttcgagaccagcctgggcaacatagatcctgtcactgcactccagcctgagcgacagagcaagacctcatctcttaaaaaaaaaaatgtatgttatagttaacccagcatattcaaaatattatctgggtcaccttgtgatcagtgtcacagatcatccttgggcagcctacgttttgtggtgcttgcgctgagtcctctgatctggcttatggagctcgcacttgggcgcaggtcactgcagcttgtcatgttgtgagccggacagccacacgtggccagtggctctgtgccgggtagcacaggtcttagatccagaacatctttctgggagctggagccagtcccctgtgtgggcacgtataacactgaagttattttctcaagtgctctaagctcgcttttgagagctttgaataatgcataatcaaataataagagcagctggttgaaaaaattaacacaaaatattgccacttaaaaatgctttatcaagcaaaataagcccaaatggagggcctgtttttaaattgctctaataatcagtaccttgcatttgcataatggcttttccttggcaggcactgcgcttcccttttcgttcctgcccaactcttgggggcccagggctagatgcctgcactggggggctcccagcctggggtccagaggcaggtttgtacacagaagagtgacatgcacaagatggttggctgtgggagcagagtggggctggcggagtgctgggtcagaaagcaaggaaagcttctcagaagaggtgacagccgggcctcctcagaagaggtgacagctgggcctcagcacccaaggaggagtttgctgaagaccggggcactatcccagcaggaggagttgtgcagggtgtggaaggcgaggctggagggcaaggtggggctccccatctggaggtgtggctgagggttgttccagcgcaagtccagcgtattgtgctattgtgggacaaggcttggtgtttgtaacgaatcagaattgtggaagttccccggggactcacagggaggatcacctctccctcaggaaggcacagggcccacgtcgaaatgcctgctgtgaccccaacttggtggcactgcagtgacagtgtttctccgcacggtagaaggacaccttgggtcagcctgtgctggctgcagggggcagcactgctgggtgtccaggaaggtggccgcatgccggcgatgcccgtgctcagtggtcagccccagtgggcgcagcggtagctggcgatgcccgtggtcagtggtcagccccagtgggcgcagcggtaggtggtgatgcccccactcagtggtcagccccagtgggcgcagcggtaggtggtgatgcccgtgctcagtggtcagccccagtgggcgcagcggtaggtggtgatgcccccactcagtggtcagccccagtgggcgcagcggtagctggcgatgcccgtgctcagtggtcagccccagtgggcgcagcggtaggtggtgatgcccccactcagtggtcagcctcagtgggcacagcagtagctggcgatgcccgtgctcagtggtcagcctcagtgggcgcagcggtaggtggtgatgcccccgctcagtggtcagccccagtgggcacagcagtagctggcgatgcccccactcagtggtcagcctcagtgggcgcagcggtaggtggtgatgcccccactcagtggtcagccccagtgggcgcagcggtaggtggtgatgcccgtgctcagtggtcagccccagtgggcgcagcggtaggtggtgatgcccccgctcagtggtcagccccagtgggcacagcagtagctggcgatgcccccactcagtggtcagcctcagtgggcgcagcggtaggtggtgatgcccccactcagtggtcagccccagtgggcgcagcggtaggtggtgatgcccgtgctcagtggtcagccccagtgggcgcagcggtaggtggtgatgcccgtgctcagtggtcagccccagtgggcgcagcggtagctggcgatgcccgtgctcagtggtcagccccagtgggcgcagcggtaggtggtgatgcccccactcagtggtcagcctcagtgggcacagcagtagctggcgatgcccgtgctcagtggtcagccccagtgggcgcagcggtagctggcgatgcccgtgctcagtggtcagccccagtgggcacagcagtagctggcgatgcccccactcagtggtcagcctcagtgggcgcagcggtaggtggtgatgcccccactcagtggtcagcctcagtgggcacagcagtagctggcgatgcccgtgctcagtggtcagccccagtgggcgcagcggtaggtggtgatgcccccgctcagtggtcagccccagtgggcacagcagtagctggcgatgcccccactcagtggtcagcctcagtgggcgcagcggtaggtggtgatgcccccgctcagtggtcagccccagtgggcacagcagtagctggcgatgcccatgctcagtggtcagccccagtgggcgcagcggtaggtggcacattggcttcttccttccagcttcaagaagcatctctctgattgctctggcctggagtcctggggccctctgtccccctcctggcactgcagccagcgttcctagttcccattttctgttcactgaggctgggcgtggtccgctgcagtctgtggggggccctgggaatgcttccaggccttgatggaggaggatttggaaagggcacccggattgggtgccacagagcgccgtgatgagtgcgtcttgcgaggacactggtgccgctgtggcagggttgcccttgcctgtctgtgaagtaggctgcacaccccagtccccagcagggccaggccgcctgcctctgccctccctcccgtggtgccggcaggtcagaggtccccgagaattcttaggggaattgaagggacacgggagaaatttgaaagctcccactcagggcagaagagaggccaaaggaaggacatggacatgagaccaagctttatttagccaccgcttcatcctaggtggctgggggaggggtggttggacctggagcctcttcccagagtgtgctgctagatgtctgacagccagctggtaaacatgccccaccaggagcatccttgtctgcagagcagggtcctgcaacctcacaggctgctgtgggaaggcaccccgccactccggtggctgcatgaggagggagtgatcctagacacagccaggctctgtcaggaaccgcgtgtcctcctggcttctccccagagagcatctgagcaggagcatccttgaagggagagctgcccctgagtgcgagcggggagggagattctggggccagggctctgggcgagggcttggatgtgaggctgcagctgctggctgctttagtgtggcgggtcaccagggcccaaggtctagctggcctttcctttcctttcaaggggctgcttctctgggcaagttaaatgccacacagggcctcagtttcccagtctctgaaacgaaagcatctgcccagatggtctgtgaatcccactgagcttgaggaatccacaattttatgatttaggagcctgctttgcataacactggtttcactttcctgggagttgaagtgattttcaggcttaaacaaatgtgatcgtgacacggcagggaatgtaatgtatccgcgaatgtagagctgcatgctttattgcatcataaaatgactgtgcagctttaaatgtgtcatgttagcatcattgggataattttttagggtgcataaaatgtagaaggagtttctggtgtcgaggaggtttggacgtcttctttctacatggggagtgagtgggagctgcctgctggcggcgacctgggaggggagaggccgtgcttctcccattggatcctgccctggggccttggccactctgtgctgtgccctttgtctgcaggggtacaaggagtgaggaacaaaccgctgtcctctatggcccaccctccccgccgttgtcctcaccctgcccacctctcccagaggaagtttgtttagataccatctcctgagctcatgtatgttcatcttcactctgggaggtccgcgttgtggaggacgcctgagtgtggagcccgagttgagctgggagaggctgggtttgggacaccttatgttcaccccagaggattgtttttccaaaggggacaagtttgaaagcagactccacgaaaacggccccacgagaaacaagcaaatgaatccagccctgttagacagcccccggccccaggcacatgcaaagcctgccctggtctgaaggaggccggaatgaagcccccttccccagaggaggtgttgacaggcatccccccgtccctccctggtggcccgaggctcgtgtggggatggaggggagactggagagacggaagacggggcgtttcttaaggcgggtgatggccgggacagaaaggcctttgtcccccgcccccccaccccaggtccttcatcgacaaggacacctggctggaccgtggcattgtctccttggagctgcctccccactggccgtggtgcctcatttgcacaacagaccctttaagactgcgtgctcggccccacctgggcttctccttggccgcatgtggctccctcaaatgctgccaagggtctcttgctcctcggtgtgactctgtgaggccaggcctctgtggggactggcagaatggagtgaatgaagccagcgtccccggagggtccctctgtcaagacgcttccagttgcatctccctgagcgctgcaggccgggccctgagccctctcgctggacaggaaggagacggggctctgagagaggaaggcacctggtcagagtcgtacagaactagggggcagagctgcaatttgagcccagctctgtctctccaagggtcattgtcagaccacccctccctaaccccaggggtggctaaaggagccctccctgccccacagacctgggacctgggaccccgttgtgggcccctgcacttctcactcgaggttcctctacctcccacatgtgctgtccaggcagcagcctctgggggcagaccctgacaagccaggagggcaggaagccttcctggaggaggtgttcattttgaagagtgcgtaggatttgccaaagtgtgatttaggaaacctgctcttaccccctgtgccaggccagtcactaccttgttttgggctggggttttaagagtgtcctggctgggtctcttctatgtctgttctcgggaactgagggccgttttgggctggggttttaggagggtcctggtctctgctgtgtctgttctcgggaactgagggctggtggacctggctcggtggggatcctctgtaggcagtccagcctttctcgctcctgtggtctagacaagcccagtccccgtcgggaggtggctgtgggactgctgggcgggagctccctgtccgcaccttccctgttaacagagccatcagcacttccctgtggggctggctgtggagaccgcagctcgttgggatgagagccccacactttcagggaccctccctgcccccctcggacatcttgtgggccccttggtactctggcaccacagtgggccccagctgtctccagaggccctgctgccacgtggctgggggcttcagtgacctcgaaaccctgctcccccacccccaccactgagggagaggccgtttgttccttctcagtgggagatcgcaggggaaccctctgacgcacgcagagcaggtgcgcgtgaccaccctgcccgctccgcattcccgtgtgtgtgtgagcaggtatggcctgggacttccaggggttttcatttttaatacctcgttaaactcgagtgctttcaggactgattcggtcacagcaactctctggtctcatttaatgcagtctctgcagagggaggggaccggcgcagaagggcagctttaaagacatacgcattcatcttgccattttccaggaaggagtaggcagctgggcttcggcccgaatgagagggctgtgctgtgtctgatgaaggtccctccccctctaaatcgccctcctcgtgctgttctggaactccaggaagaggaagacttctcccttttgacgttatttcccttgtattcagcgtagatctgactgacacacagtggcacttaagaaatattgctctaaaatgaacaagcgtcacatgctgggttttattgtagaagtcccatcacgtacgtagtatctcctatatcgattgcccaactcctattcattctacaaaacccaacccacaggtcaccttctctaagaggcagcccccaaccctaccaggctgaattgaagttcaccttcaccagatgcttagaaaggacagcaggacagtctctgccaccaactttcccttgtcttcctgcttctgtttctcactgctgagataaacgctccataagggtcattcataaaggagcagagcacagagaggacacctaactaggcctgggcctggttcactgtggtaggaggaagggctggggataatgaggtcccgagagcattcacgattcccatactggaggatctgagccataggtccatacgctgttcgacaatccctgctcctgtcccctgagagccaggccctgggctttgccgcttcatctcagccctcacaactctgcaaggtgggtgctccagcccccattttgcagttgcacaaattaaggctcagagagggtaggtgacttgccggaggtcacacagcatgcctcacatagcagagggggaaatgaaaccctgtgctgtggcccgggacattcccctgggcctagtccttgtgacctggcccaggggctgttcttttttggttcctgaatatttttagatggtgggaggctcttttactgcttagaaagaagcccccaaaaagagggagttacggccaggagggacagtccggtggacgggtctccttccgggaatctggtagctggggcctgtgcaggtacccgcctatgtggcttggcgagctgggtgactctcatgccctctctgagccctggtttccccacctgtagaaaaagcaaggcctccctccctcatgggtcgtggtgagggtctgccagggcgtgtgagaacaagctccctgatgtgtaaagcggttcttgtctgtctgtctgtctatctctccgtccgtccttccccacatgcacaccatccagttcccagccggcttcttcagaggctcgatgcgccttctctctgctgcccccaccccagtcccctggggatgaagcaccctgaggtgtggacggaggtcaggaaacatccgactcggtttcctagtaacacactaatggcagcttggtaccctgcttggcagcatcagacagcccggggccagtgcggcgcatcccagcctgtcagcaacactattttatgtccgccgtaaacacacaggctcaccaggggcagaaagcagagtttgttggttttcttttgattttctgtgggcggcgggggcaatggcctctgagcagctgcctttctgtaacagaatcggggcaggtgggcgaggttgttgggctggggcctcagggtctcgggcagaaggtgaaggtggcaggttttgccgtccctggagagctacagccgtgctcggggcccctcctggaagatttcaagctattgtgaggacaaaaataatggtcgggatttagcatctgtcagcgcagctgactcccagaaaacagcaggagtgaaaggatgagacggggcaggaaggaaggaggggtggtcactggcctggggtggagggagctgggctggggcccaggtctggccgtggaggcccattcacgtctgggcttccacattcctgcctggccatctcgggcctcctcatggaccactggacagagaagaatgatccctgaaacccacaaaagcaacacagctgagcaggaactaacgcagcaccaacccccatccaactttttagtctcctaggttttaaaaaatctgtcatttttaatgctgaccacactatgtgttgagaccggcccctgtgctaaatgccgtctcattgaatgagcccctcctttcgccctctggggtgataggccatgctcccacttattgagcacctactgtatgctcagcctctactggtcttgtacatgatggctgatccttggaactgtcactctcctgttgcagatgggaaaccgaagcttaggttatcctggttgcagttacagagctagaaacaggaagggctacaaagacaaccctagtttccctcgctgcctcccctccaggggctcaggagcgacagtcaagttcctgccaacaagagacccactgcggcccgcctgttccgaagtgatgaggactggcctgctctgtggaccagacactggtgtggcatgggtgtggagtttttccacgaagtatagcctctgatgacacggagcctccacacgcttctttctagccgagacactgatgtgaaaaggatcagtgtgtgacacagcagcctgccacagagccacaggagagtgatgtaattgtgccacggagattccagagccacttgcagacgtggcagggccttgaggtgcttttcaaggactgggggagagtgggctgggtccagagggaaggcacgacagcccggcccctcccctgtgggattgcgtggagggccatgtggggctggcgctctggttccgtgtgccgcgtcttcgctgagttctcgtcaagctcatgtctagtgagaacgctgaggtgagggtccttgcacaatgggaccctcctgccctgtcactgccctgtactcccaggagacttcagacccctcagtgggtctcatagtatacccctcctccagcccagcccctgagggttccctcttcctcccagtggacagctgtggccctcaggtacactgggcctgctggtcatgacgtaagtgaacctgccttccaggtgactgagactggccgtgtgtcacctccctgtgcaagaaacttgtttatggaggccgggcgcggtggctcacgcctgtaatcccagcactttgggaggccgaggcgggcggatcacgaggtcaggagattgagaccatcctggctaacacagtgaaaccctgtctctactaaaaatacaaaaaaaattagccgggcgtggtgctgggcacctgtagtcccagctacttgggaggctgaggcaggagaaaggcgtgaaccccggaggcagagcctgcagtgagccgagatagtgccactgcacttcagcctgggcgacagcgagactccgtctcaaaaaaaaaaaaaagaaaaagaaaaagaaacttgtttatggagatggcatctttgccaagaagccaggtagcagtggcatttccacgtcggtgatggccaaaggaaaggagctattagggagcagagcttgtttccccaagtgacaccacagtagtgtctgcctctaggatctgttccgtacctgggagatttcctggtgccaggattcagatgcagctgctgcctagtcagtctccccacttggactgtgaggtcattgggacagatggccattgtcccctgtgtcccaaggacccaacatatttctgatgcagaatcggtcataggagaaatactggttaaacccattacatctggtaggtttttatcttaattactaagtttatattattaacattgttttatcaaatacgtttgattttattttcctaatttaattttattttttgaaaaaccacttctttaccgttccctttatttctccctctctcatcatttagaatatgtgtgtcatgaaatttcagttccactgttttagaatttcaaatgacacagaggaacccatctctcccagtgttcattgaccagaatccagatggttgggagagcgctttggacgaatgaaaagtgccatccgtgtggccaggctgatggtcagtgctctgggctccacaaggagggcccggtaggaagggagcctaagggtgtggcaggcagaaccgggtgaccccagattccgcccccccagtatcaacaggctcggataactgacattggatggaagggagagaagggatgttgtctgcgtgtttaagatgattctgtcccagagacagattcccaaacacagcttctcctctagtgtttttggttgctcactctttttttttttttgagacggagcctcgctctgtcgcccaggctggagtgcagtgacgcgatctcggctctctgcaaactccacctcctgggttcacgccattctcctgcctcagcctcccaagtagctgggactacaggcacccgccaccacgcccggctaattttttttttgtattttttagtagagacggggtttcactgtgttagccaggatggtctcgatctcctgacctcgtgatccgcccacctcggcctcccaaagtgctgggattacaggtgtgaggttgctcacttttaacctcggtgccccgggcgaatgacaagaggttaatgggaagtggtgcatgaagaatgagcccgtgtgaaggaatgttcctcgtagtcatggattaaagaaagaaaaacaacacaggcgtggctgggcacagtggctcatgcctgtaatcccagcactttgggaggccaaggcaggcacattgcttgaggccaggagttcgagaccagcctggccaatatggtgaaaccccgtctccaggaaaaataaaacaattagctgggcatcatggtgagtgcctgtaatcccagctactcgggaggctgagtatcgttcatagcatctcgggtccaagaaagaaatcaccaaacgcaagaaacaggagaaagtgagtcatgctcagaaaagaagagtcaatagaagccaaccctcagatgacccagatgttgcaattagtggcttccaagaagcataaccagtgggatctctgtagatggctggggggatttattatgggaattggcttatgcaattatggaggccagaaagtcccgccatatgctgcctgcaagctggagacccaggaaagccagtgatttaacttaagtctgagtccaaaggtcagagaaccagggagccagtgatgtgtcagcccaaggccaaaggcctgagtcctggtgtgggatgggcaggtgctggtgtgtgttctggagtctgaagatctgacacccaggaggagttccgatgtctgagggcaggagacggtggatgtctcaacttcagaagagagcaagtccacccatttttttttttttttttttgagatggagtcttgctttgtcacccaggctggagtgcagtggcgcgatctcacctcactgcaagctctgcctcccaggttcacgccattctcctgcctcagcctcttgagtagctgggacttcaggtgcccgccaccatgcctggctaattttttgtatttttttagtagagacgggttttcatcatgttagacaggatggtctcgatctcctgacctcgtgatctgcccacctcggccccccaaagtgctgagattacaggcgtgagccgccgcgcccggccgccctctgccttttttgttctacgtgggccctcaatggattggatgacacctgtccgcactggtgagggtaaatctttacttggtcttctgattcaaatgtcaatctcttctggaaaccccctcacagacacacctagaaataacgcttcaccagctctctgggtagtccttagcccagtcaaattcacatacaaaatcagccatcacagcagctattataaatacggtcacggacttagaggaaaacgtacgacaaatgaatgagcggatgaagagcctcagcagggaaatagaaactactgaaaagtggcaaatggaaatgctaaaactgaaaagcacgatatctgaaatgaacactctactcgctggatcagcttgattaaaaagttgcacacggcagagggaaaagtcgttgaacttgaagatagtacggtggaagttacgcactttattattttattttttattttttcgagacagagtttcactcttgtctcccaggctggagtgcagtggtgcaatctcagctcactgcaagctccacctcccaggctcaaacaattctcctgtctcagtctcccgagtatttttagtagagatggggtttcaccatattggccaggctggcctcgaactcctgacctcaggtgatccacccacctcggcctcccaaagtgctgggattacaggcgtgcgccaccacgccaggctggaagttacacacttcaaataacagggaggaaagaagcctggaaagaagggacagagcctgagacgtgtgggatgatgtcaggacgtctaacacgggtattattgcagtctctcagaagaggaagaatgaaggaagcagaataaacattgaaaaagaaaaggcccaattcttcctaaattccaaagcctctgtcgtaatactacaaaatgtttctgagagaaattaaggaagacttaaataaagtatatactatgtttatggattggaagatgttatcgttaagatggcagttctccccaaattacactgtagactcaatgcagtgtctaccatgatcccagcagacatttttaaaaaaattgacaagacggttgtaaagtttacatggagatgcagaggaccttggaatggcttaatcagtcttgtagaagaacaaagctagatttacattacgtgatttcaagagtttctatgaaatgtatcaagacacagaagtgttagtgtaaagatagacaaatagatggatggaatagagtagttattccaaaatagactcacccttatttggtcaattggtttctgacagagatccaagcaatccaatggtaaggtttttgtttgtttgtttgttttctaagagtcagggtctcactctgtcgcccaggttggagtgcagtggcacgatcataacttattgcagcctcaaactcctggactccagcaatcctccttcctcagcctccttagtagctgggacgacaggcatgagccaccatgccctgctcgaaaaagaggcgttttgagaaattgttctggaacatgtggatattcctatgggaaaaaagtgaaccctgctacttcataccacgcacataaattaacttgagatgaaatcagagacctaaacagagtggctaaaactatgaagttccgataagaaaatatattgtgattgaaagacagcaaagatttcttagacaaggcacaaggatttcttaggacacaggacagagccaggatgcgactaaggaaaggtgataaattaggctttattaaattaaaggtgaatgcttgaatatcattaagaaagtgaatagccaagctagagactgggggaagaatcacaaaacatatctgactagtatccagaatatgtgaagaactcaccgaattcaataagaagacagacaaccaatttttagaaatggacaaaagtcttgaacagactcttcacaaaggaaggtatacagtaaggacgcaggagacccctcagcagcgttagccatcaggaaagtgccaaatagaaccacagttctgtttcactccacacgcactctgggggctgaatggaaaaagaccggcaacagcagaagctgatgaggatgtggcgcagctggggctggtgagcgctgctggctgggggtgtagaatgcacccactttagaaaagcatttgtcagctgcttatgaggttgagtctagacctcccctttgaccaggagttccagtcctagtggaattttgtttccaaaggaaaagaaagcctgtgtaaccccccacccaccacacaggcgtgcgtgcatacacacgcacacacacaacttgaatgctcatatagcagcttttattcacaataagcaacaacttggaggcaacccaaatgtccataaagaaggaagatgggtagcacgttgttgttcatgccgtggattagtactcagcagtaaacaggaatgagctgcaaatgtgggcaagtcagaatggatgtgtctcaaacaagatccaatgttgaggggaagaagccaggcacaaaaacaaatctaacgcacaacaccgttgacattctacagacaaggctcgtctgtggtgaagaacagtcagaagggtggttgctcggggcgggaaggagactgatggggaagggcaggagctccggtgagatgaaaatactctatggtgtgggagggcatgagtgacacaggtgtagccacttgtcagaaaggtaccactaagggcgtattttgatccttaaaaagcttagcaaaaatattatgagaaccctatgcttggcatttctcaccaagcttcagacgcagcgggtgctacacagacgtggacttgtacctagatccgggcgtgacagttctgtcttcaagatggggccagggaagagggaggcgggcgggggactctgccttccacaccccttttctaggtccacccgggcttcaaagcatccttcgagtctcatctgttcaggaagactctgaccatcccagccttccctattctctccctccttaatatgtttgggctccagatggagctcgtgcctcttccatcccgggatcagtggatcgtatcctgtatttcccggaatacgttcaggccttgtcagagccgggcacgtcgtagagtcctcagtaaatggcagtgcaaggccactgcggtgggaggcacgagtgaaggatgtgtgtccatggcatctgagagacctgcagcagcccgggctgggctttcccatctgcactgtgacaagcctggggctcctgggggagaggaaagacgttgcatgtcgtcagcaaccggttctggtcgacctgtgatgggggcggcatgggggcctttatgaacaggctcctgagtggtgggggagagccctgggctctgttgggacaccccacagtgtggccgtttgccatccctgcacgggacgatctccaggcccctgtccaggtccggcttgcagccgtttttgatccatgtcatcagctcttgcagcatttaacggccaacccccctccttccacctggcctgttggagaaaagctgacgtctgtctctagacagtctgagtggcctcatctgccctcgagttgtctcgttcagcagcctggaagcttccctgtctcgcctcgcctccagctgtcaagagttttcgacagaggctttgccgccagcctcgctctgccacgtgacggaaacgtggggtggctggcagccgctgagaacaacccctgcagtcacttgcctgcatccctggtagcctggcgggcagagaggtgggggctgtgtccttggggacagcatctggagaggcaggggaggtgatttgtgtcatcgctggtggcagtttctaaggcagtcgccggacctggctggggatggacctttgagatgggttagtaagaaaacctgtgagctcacaaacacccttcctgccttcatgtctgttcccaggggagcctctgtcaccagaatgtgggcccaacccgtctgacggctgcctttaccccggcttcagttctcccgcacggctgagcgacacccagatggacctctcatggtggagggcgggtggggagagaggagaggatagtgagcgagggccacagccctgccccttgctggctgtttaacctcagtttgtttgttttaatctgcacaatggccacagtgctgttaccgccaaggattctgtgaggcccaagagaataactgtttttctacaggcgctggcacacagaggggcttgcccatgggtcggtggctctttgaatgctggttggagggttcgatcagtctggtctgtcccagggccatctgccctctgccaactttgctcctctgaccggctttcatccacctcactcacgactgtagtggtgcagaaaatgaagtacccggagcaacagcttcctccgcctcctttgcccgcctgcctgcgggaggctccacaaggcaggagctgggctcacccccggcttcccctctagagaggcacagatgctttgcccacagacggacgccgtgtggcttgtgcattgcagcgtgtcctccagggaaggtgctgagggccttcctcgaatgcacacgggccctccctctctcaagtagaccttgaatggtcctccccaacccaagccttaaaaggcgacagctgatattcaaaggcgaggtttgggatgaggccgtggcacacagcgtggctggggaacccgttcctgagtaccgcagggattgctcctgccccggcttctgtccctgcctcgcctccctgcgtgctggccatggaagggggtgctctgcatttatttccgtccttctagcagtgaactttgccacccactttgagcccgggatgtgagatgtgtccttgtgcaggggtgagggcttgcaggactgaatacacaacctgtctgggcctggggtagctcctgcccctccacccccaggtgcagtgagcccccaacggggcctgtgggaacagggggtggttggattggctcagttgctgattcagtgaaagacttgctgagccccagcaggtcaggtgtggagcatcaggagggctgaggaagcccagtgtggggaggggccaggctcatccgctgccactcacagagtcactggaaatgtagccaaggagctgcatcgagtacacgagcgtctgcaagagtccagatcacagaccaagtggggatcctggtgggtgtcttggaggaggtggcccgtgagctgagtcctgcaggcagaggggtggcttgttggagtaggaccatgagctaaaacaaagctttattgtattagattttggtaggaatttctttggctctggtttcagaaggcaaatgacaaactccgggtcaccctccatgtacccggaaactttgcaccttggatccaaggactgcaagagccagggctgagccggaagcactcaggtctccaggtcacagccttgggccaggggagagaggcttctgttctggaggcaggagctgggggctcctgtcaggtaggggtgggaagattctggtgaaggcaggggtcccgcccctggacctctggcctacgtccccagcatttaccaaagggctggagaagtgggttctttgtcctggcagatccctctgaaatgcacctagtggaggcagcaggcagagcactggaggatgcgccttacgctgcccagttcgcacccacagacgccctgcaggcggggcccaccccactttgtagactgaggcccgggcaggtgacctcgctgtggccccagccgcctgcgtccctcgtggaccctcgtgctctgcggctccccggtcagggtggcgggagcctcccctcccctctaacccgcctcctcctgtgcagcgagcatgacctgggggaggacatctacgactgcgtcccgtgtgaggatggaggggacgacatctacgaggacatcatcaaggtggaggtgcagcagcccatggtgagccctgccccgctcctccctcccttcccctcccttccctcgcagagcagcctggcccttgcttaacacaataccgagctgtccccatgtctgagccaccgaaggggagctgctctgggtgcagggggacgtccagaggtgcaccccttggtccttcccagtccccacggagctcctctgaggagcatccttggaaaccctggctgactcctggtccactctgtgcccttcctctctatggagatgttctcaggtgcccagagatgacaccaccacggtcatgacccccgcccgtgttgccatgggattctccttccaagggcttgcaggcccctcagttgttcctgcccagggagccttaagatagtaacttggcgcatggtctaacagcacgcgtcattttccccctttgtgtggagaatgatgagaccaatattggcccaattagccagctgtgcgtcttttatgtttggaggatgtttatttccaagcaggcactggcgaataatctctcggacgccagtttgctccgcgtgggtttattgccagcagctgctatgtggaaggtggggatccagcggagctggaatgaggagacagggacctggtagggcaggtcacaggccctcagacccccaggctcccaagagtgggtgagatgccacttgccaaccgtggaggcttttgatgccattggcttcccccaaagaaataggaaatttctcagaaagctgatttcagtgttttcctttagtgtgggagtaaccagctggtggtggagaagcagaaagctggggaaacaaatccctaaagaggccttgcccactctgctggcatcctgctgggagagacaggcaggtgcagggctgggggtctcacagcccccaaactgactgttaagagcaggtttctctgcttgtcctcgaagggtctcgactgagttttgttccccgccataaccggggggtctcccccgagggatggtggccctttgtggaggcagcagggcctccagtttgccttcccggggagcctggctgggtagctgttagggctggaagactgagccatggccctgctgctgggggctcccctcgcctccccggagctggcctgagaggtcccgaggcggccggcgagccgtctggacttgggaatgagctctgactggtcaaggccagttcactccccaagttgtttgaaagctgggcgtcctgcaggtaaacttcagcaggtggctgcgttgcctgtgaggttgtgtgggggatcctggccctggatcctgcaggctctctttctcgagacccccatccatgcctggtgagagtgggtgctccctggagcccgctgctgtccctggttctgaaggtctcagacctctttgagaaaacgcatgtgaaaggacatggagtgtccacagaacctgccaggctggggaacagcgctgcctatgtcccgctctgcacagtgtcctcatgcccagcgctggtcccgctggtctcgagctgtccagtccatccaggcaggggctgggggcaaggggcagttcctgcttcctgccagggtcctctgagataaaacagctgctccatgtccttccctgtcatgtctggagctctctgaacagccccagtggaaggtaatagagatggtgacttccccaaaggaagaagaagccagaggatggcagatgccatttcctgagcctgggtagggggctgctatgggagctctggcccatgagccatcgccctgcccagctgggcagcacgaggggccgtgatgtggctttgggtctgttggctggttgtggggtggcgttcctgatgtcccaggcccagcttgccaggacagtgtgggccctgctaaccggcgctgtttctggttctttctccacgcttgcagattagatacatgcaggtgagtggcccggaaggggaggctggggacgtcctgcctgcgccgtcttcttgacctttcagggaggtctcagacctctctgagaaaactcgggaccctgcccccaggaagacatggtcaggcacacatgacttcaggcatcagagaccctcggcacccccgtggtcctgtacccacagccccatcttgcacgttgccttagagacctgcagcctggcagacccaagcggacccttggggatttcttggaggatgatgatggtcttagggccgacacgagcgctgtgggtcacagcaccatttctccagagccttctgacaggtggggtttacccagcctaacagaaccttaaagacagtgttgggaaaatccatcactgccccacagtgaccccacctgtcacctcaccctggaccatgggccaggcaatctctaatcctgtcccggccacattccaccagaggtgggggcaggccctgctctggaggaggctccagggaccctgctggcggtggggggtcatctcaggccccctggctagaaaccagtggacactcaggggaagagtccagcctgcaggtggctgtactgacatgtgcaatggtggatgtggtctgcatggagccgagcacacagtctgccacgtagagaggacttatgcacacagtaggtgttttagcaagtcactcctgctcctgtgctggagggggtagcttctgaggccctcaccccagtctggtgaagaatcgagattcagaatcagaggagtaggagcctgggattctagaaggctctgcctccaagccttccttggcactgtccccacgtcacatcccctccccgtgcgtcagtttcttcatctgcaaaatgaatgggaaggggttggccctctctgtcacccatctggctgcagcactgcacactcagtgacctcgtggccaaacccaaggagtcctcttttgtggaggtgtccgggtgtcgcggtgcagatgtgcaggtggcaggtggccgggcccatggggtcctgctgactcccccttccctcctctagaaaatgggcatgactgaagatgacaagaggaactgctgcctgctggagatccaggagaccgaggccaagtactaccgcaccctggaggacattgagaaggtgagggcagatggcggccactggaaaatggcagcggccactgtggtcactgcagggccacctatctcctgggagtgcattccggaggcagggccatagggcctctctgacaggcgaaggagacttggtggccctcccagctctgcctccaggtaccccctacccaaaaggagggtgccctctcctttcctctgaagcccctgaagtcccggcctgcgcctgtccctgctcctcctctgagcttaatcggggtgggattacggcttcagctcctgaacattgctctaaggcaggcactgagctagctcctcgcgtattccccccaccccacctagagctgctccccagcctctccacactcagcctccccatctgtaaaatggaacaaagcttccatggggggctgggagtgtcctgcacaaggcatggcccggcctagtgaccagagctgcagactccaagctccttgcccagctcttccactcttgtgcatctgagtcctctctcctgctggcctgctgagctcctagagtgctgaggatcagccttcacctcccctaccccacctgggcctcctgtaggcacctggtcaacctggccctgggacatttccctagcacttctgagtcttcattgccaactgccagtgtttactggggagaaaaaccaaccagggtggccgtgatgcctccagccgggagacctgggctgcccccttgggcccaggctggccttgctccggccgggccccctcctgctgccccaccctctggtccttggccagcggcctttctgcacgcacatctgtacaccctggcccaggtccttccagttccctcgaagccctgcccatgccctggcttctgagaatcctggctctgaggtcagcctctgccagggccctgctggcctctgtatccctccatggctaaatgctgctgcagaaagcaggagggctcctgaggtctgtctccacccagcctggggccgccacccgggcgtgtttgcttgggcgatgctctctgtgccacgtggtgaccaaggagcggtgcagcagctgggcccagaggatgcctgcagagcggctggctgccctgaccaggagccactcggggagcaggagaggagagggtggccgggcctccagagcagggtcagcagcctcacacgtcctcatgttcacttcacatcccgcctgaggctggagctggaggactctcgtccacagcctgccccaccaccggcactcctcggggtggagagcatcccttttgatgacagttttggggtcatgctcaggagcacaagctcagtgtttgagtgctgggtggggaccatggccctgtccatccagagagtccccacgggtgatggccctgcctcctgggtctcagcccctcaccgcaagccacaaccccaacgcccacctcagggcagccatagtgcccaagtccaccctgtgtgtgagtggccaccacaggactctgcccccgtcacgctgggagcgttagaatctttacccccgcaccttcctgccctgcactcacctccaaagaatggagcccgatgtggccagaacacaggctaccccagtaagcatggagcaccccagtgcctgcctcggagctgccctgggaccctcccctggcagctgtgaccttgagagggtgggcaacagcagcagggtggcagaggtggacttctctcttccagaactacatgagccccctgcggctggtgctgagcccggcggacatggcagctgtcttcattaacctggaggtaagggtcccggcccccatcgctcatgccaggctcggggccctaactcggcactggccacacatgtcctgctgtcctcagggccttggagagctgcacccctgtggctccgtggtggctcgtgctggccggaaggaggagcccccaccgctctctccagggtctttggatttaggagccagggtagcaggtttctgggctccgcttgtctgcgggtgagggcagcactgacgtgcgtggctggaggcacggatgacgctgagaatgtaaatgaagtttttgtcagcggccagagagaaacgtgtccctccacccctttgagcggaccccctcgcctgccctgcgggtgtctgaactcagtcatagaaaggcagttccccatgcaaagagtcacctagacgtggttagcagagcagggcgctggcaccaggctccggcagccgtgcatgggtgggcttcctccggggacatgctgctcctggcccttcctcctggcctggcggccacaggtgccagcagcccgtgcggtggctgtgtcctgcctccctggccgtctcattagctgcaagggtgagctctggtcacgctgccctggatgaggctggcttggaccccagagcttcctatagtctgtgcctctgacctagagttcatctgtccttgagctgtggccaggatggaggagcacagacagaaagaggcctggggcggggatgggggtcccggggtggggatgggggtcccggggtgtggcctgagcacaggagtactgcgctgtgccgccccacgctgtctgcagagcccgccccgagtcggccgctgcgtgtctgatgggctggtgcgggctgtgggcggcttccctcccacacgtactggctcttctgttgcaccatcgccatagaaccttctacctgaatcacaccctggcatgcacagagatgtggggtgcaggcccagcacccgggcccctcccctccttgagggaactacagaacaacaagggcactttaagggcggcgctcccgtctagccttgggtgggcctggccaggcactcacggctggttttcaacccaggacctgatcaaggtgcatcacagcttcctgagggccatcgacgtgtccgtgatggtggggggcagcacgctggccaaggtcttcctcgatttcaaggaaaggtgagtggctgccggctcctggggctccttggcccctccctgtctgcgggagagtttacacaagtggaactcttgtgtaagtgggactcttggggtgtcccgaggcaggggccgccccctctggaccccgtcctcccttgttgaggatgccacccaccccgagccgcagcctggttgatggagagggtgtggagcctcctgtcctgtgggagctcggcaggggcaggattggggttctggatgtttctaactggctgtgagaggtgtggccatccaagtggctcggctgtcccagcggagatctcgggcccccacttctcccttctgcacccttgtggccggttctttaaagttaggatgtggacaaggatgaaaagaggtggcacgtggagcttaaatgatgcccaggctgtcggaggctggggaggtggcgtttctggggcttagatgacgcccaggctgccggaggctggggaggtggcatttctggagcttagacgatgcccaggctgttggaggttggggaggcggcgtttctgggggttagacaatgcccaggctgtcggaggctggggagatggcgtttctgggggttagacaatgcccaggctgtcagaggctggggagatggcgtttccagccacggaagtctcgagagagccccatcaggggacggtgccaagctctctgtccctcggggatcctttggaggagcccgaaggggtctatgctaatgcttcctgaacttggctgctcactagagccactggggagcttgttacaaataccatgtccggggtccactcttggaagggtctgggtctgctctggggcctggggagttgtagaagaccccacaggtgcatcttaccacgcggccctgagcctaggcattgggcgcccgggtccatctctccctcatctctaggagggtcccctgcatcacccgccaggtggccgtcagcacagctcacacccctccctgtccaggcagccggggacaggcccagggctggattctcaggcacgttgcctgggaagccctgcaggtgcttccctgtgtgctctgtagcttcaggaaaggcgctccccccttccctgtgaggagggtcctggagcctgctctccaggggccatggcttggagggttcccggagacacgagggagcaggcagtgcttgtggtccagtggcagaggggaccaggagagctgacgaggcccagcaggtgtgagcacactggccagccccagagggttaagagtgggcagggatcgggggaggacagctccctaacctgccctcagcaaggtgttcccttcatctgtgggtgagctgatagtgcccggctggcaggtcacactggctgtcgccccagtcctcagcaggtgtggggtacagtggtccttttcagcgccttgttcatgctgtccctcggccaggaagggagggagccacggatgaggcgtggtttgcttcgaggtccgtcaaaggctgaagccctggaggaggaatggctggctgtgtggtagagtgacagggtggataacctgtcctctcccaggagcctccctccacagtcaggctgcccggcgacacccctggccctgtcccaccagcaggaccttgcatgggtggttcccgctgaggaacagcgggcatctctgccttggagcgccactgcagtgcgggcagcacgtccagtcacaggcccagcccaagagctctgtggacgggcagctccgtccctggcagcgaggcgtgtggcgagatccgtcagtcggggtctgtttggggaaggggctgtcagcgtttcatcagagctcatcaccaaatcatcgtggttctgtcccagcatccagcttttttgcccctttcctctcatttcggattcggccccaaggtcctggttcttgcttgctggctgagtcctgaagcttttatagggtgcctgctctgtatggctcctgagctctggactgaggacacgcagtgaacagagctactggcctctcgctgggtgggatggatgagaaccaagacaagatagagaagctccggggggagctgcggcgttgctggagagcccaggagacccgtgagggctgcacagcggaggacgtgtccccctgagcacagtcctgcaggggtggggcgaggcgggttggggagcagaagcttaggggaaggtgagaggcatgagcccagtagaaaaggggcggttctccagggaagggctggagggtcctgcaggggcttccaggccaaaggaaggatttagaatttttcttttattaagcgagggcacgaggaagctgctgaagggctttgtgacagggtcctggcagctcgtcgggggtgaagggtggagtagcattccggtgtggcatgatcggcactgagtggcaggagacagtcacctccctctttttgaggttatactttcatgaatgcagccttcgtcctcagacaaggcaggagctcctcttagccttgccctgtgggcctaaaagggggcatctcccacccagagggacactgggccttgggaaggagcttgcattctgcagctgtggacataagacaaagccgtgtggtttttctctgtggctgggtctggccaggctgggcctggagtccagctcctggtggcttccttgagtggggcagtgagtcatgctgcggggagtgggggcatacggggacgtgggggcaggagagctagaaagggaacgacctcggggagctggcagccctgcaggaaggccacgaactggctttcaagaggagctctctgtggagctttgcacgagcgcttttgggaggaatgcagaacagaacgagacgaaggccacgccctcctcccccagggctgggtgggatctccctgcgtatgtggagatgaaggatccgagacaggtgagcgctttggtgcaccgagacttccactcggaatcctggaacgagtgaggctgccctgtggatggttcctacccgaagcccaaggctgggtggttccagggtacggcctgcagggagagtccccggtcatggtccacctcaaaaaccccagtaggggttggcttggccacctgctctggcagggctgcctttgggaacctctgaagtcaagaagcctcagctcccgctctgtctaacccccatttcccagatggggaaacggaggccagagctggcagctcagccgtgcaccttgcttgttcctgcatccttggtccatacctgagcccatggcctgtggtcctcaatccacgctggcctgtccctgggcatcttgagaggttggggctgtgtggactggaggcagaggtgataccatgaggaaaatgggcagaggagaggcatctctggaggaggcatttgtgcaccgtgtggtgggttcagaatttgacgtactcagaaagttaaaaaacatgatcctcacacaaatacccacggagctcgggccacgggtctgtcaactcacgagcaagggaaccacataccttgtcagcagagaggggaggtcgggcaggatgctggacacggcgggccgtgccttgcaaggtgaccacactgagacctttggggccatgtcctctatcaggacagaaatcatttgcgcctgaacaactttctccaggggaggagtcagccggagtggggcgggggagggggaggctgcccctgggaggtgctccaaccagaccaggaatgcatgaagtcgtgtgtgtgtgtgtgtgtgtgtgtgtgtgtgtacacgcgtgcttgtgtgtttgtgtgcacatgcatgtgtgtgtgtgtgcatacatgtgtgcccgtgtgtgttattccaagttttggctcctttttcttaacagtagtaaatgtggttagaattaaggcctgtaaacttttgcctccttaactgacttcctccaataggcttggagtcactgtcattttctctccatttttcggggaaaagtcaaactgtgccccctggggactctgtggcccatgctgcctggtatgtggcaggtgctcagagtcctgtggtgtggacggagggtgaaggcgtctgtgtgagtgacctggcttggctgtaacaatgaccgcaaacatggtggcttgaaacaacagagatgtctctgttctggaggccagactcctagtctcactgagccaaagtccaggtgtgcccgggtcatgcttcctgcagaggcttcagggggatccttcctacgtcctgcagctgctggaggccccgggtgttcctggctggggctgcttcgttctctgtccccatctccacatggcctccccgcgtctctgtgtccttttctgaggccactctcattggagtcagggccaccttccttcagcatggcctcatctcagtccttaccttcattacatctgcatcatgaccaaataaggtcacagtgtgaggctctagtggacccactgcagccgagttctggtccgaggccctctccatcaccagctgcccttgctcagtggggctaggggtgtgcaggtgctggcatctgctctgcccctgggtcaggtgagagagggcgcgggcccctcgagtgtccttctggactccacggagagagagtgtccctctgcagaggcgtcaccctggggccctgagggccagggttgagagccatgtgcattcgctttggaatctggccctgttccccttcttgggcgacctcagaagtcacgtcacgtctctgagcctcagggcccctgtggtgacagtggtgtttctgtgaggatgcagtgagcccgggtgtgaagcccgtcccacggccagggccctttcaggctcttcatggaggtctgtctttccccagagttctcctgtttgcttcaagtgcctgccattccccccacccccaacctcctgcatcctcttatcaaatggatagaaggacctgtgtccaggcttgtggctgtggccactcacagccgtgtgtgagtgcctggtgcaggcaggctccgggctgggtgctggggtatggggatgagtgagacccattgcaggagctcagagctggtgggtgggggtcacccggggcagtctcctctttgggctcccactgaccttggacaggcctctacctgctgccctttgacctatctccttgcttttccctctggccctgctggtgcaggggttgaagtgaagaaggggcaatgatagggaagagttttgacagacgagtagaagtttgccaggtggagaaggctgccagctcagctgtgctgtggctgatgtgggtgttcccggtagagcatggtgtgaggagagtaaggctgggatctgcactccagcccctcgtccacctaaacctcgggccaaggtgacttggtgtgaaattgaaaggcggagctcacaaagctggtttggccacactagagctgctggcaccaggcatgttatccgctgggcttcagttgggagctttttccacctacatgaagacttgcctcgacagggagggactggggccatcactgggcccagctcacctgaaatgcttgaagccgagtccgcagtggtgcggggcctggtgggaagtcaggcagtgtggtgtccctcgggcccgagcgtggccccagccccagcagcagcagacatggctccatgcgggcaggacccctcgctggggactctgtctttccttctccccagcccagactcgtcctcccgcctccaggcggtcttgggaagctctgaaagccttgaggttcaccacctgccctggcttccccacctagagtcctcaggccaggtcaggggcacttttcaaaggggccacaggggtgggctgggggccttagggtttggggtgcccctggacctcctgccttgcttctggtctggtgtcatcatcagataggaggcacagccaggaggcagagcagtgcagccctaggacagccccaggaactgggctttggggtcggtgactgttggtgtgattcccttctcagctacggggctctctgagcctcagtgtccccatgggtagaacggcgacagtcacggtcccagagcttccagcccaggtcctggcaccaagtgatgcccagtgtgtgtggcgtgtcttctgcgcatggctctgaccattctctcagggtggagaaaacaccgatccggagcggggcaggtgcaggcggccgccgggagtcagtgtcttgtccgctcactttcgggctgtccggtggtctcttaaatgtccctctgttccttctctcctctcctactctaccgggggcttctgaagcttttgttcatttttttttaaaaggggaaaaccctttttctcgattgcttccagagatgataggttttcaccaacttttatatgaaaatgatcagtgtaataacagactcatttaggtggtaaccagggggcaggttcccatttaaagtggctcccagtcaacacacagcccaagcaccaggcaggaggcaggccctttgcaatgatggtgatgcctccatgcagacctcccaggtctgtggacacgggatccccccatggggacacacccctgcaggccatgtgggaccggccatgggtgctttgcttgactgtggctgggtcaggtgagcttcgagcagattcaggtcctttatcagagtcgtggactgtcagcctcgcatgccagaggtgtccctgcaggcttgtgagggaggattctcgggcggcctgaggaagtaccagtcactggaccccacgcgcagcgctgggagggtgtcagggcctctggcggccctggccgtggtgaggacagcctcatgagcatttgttgggagtaggaagtgtgtcaagatgcccgtccctgtgcctgagccagctccaaagggacatgctccctaggcagaaaatgtgttcccagccactgttctgttctcccatgtggcagagccacttggatggaaacctgtccctgcatcaagaccccaccatcaggacgcttctccccgagggccaccctccgcagaagccaggctacaggcccagctgcccgccccgagccccaggccgggtgccctacggcaaagcagctctcatgatggaaagagaaatggcccagaggccatggtgacctggtcccaagagcctgccctgggcttcccgggccaggggagcctccagacaccaacacacagccctgccagagagcatatcaccaggacgctgggtccggcccagccttgcaggccagactgtcagctcctagcaagttcacggaggcctcagtctccctgcctgaagagtggggctaatcacccccatctttacaaatgggcaaaaaagtcataaggcttgtcggcagagcacctggcagcagctgcctcagcgagtggtggctcttgtcatccttgttgtcaccaacattgtcacctggtgtggttcttctttgggactgccctgtcggtggggttatggggttttaaagatgaagtttcaggctggtaacctaagaccctgaggctccagaggccgggaaccctgggttccagtttgtagagatgtgggcccagtgcagggagagggagaaggtgtcgtggctaaagagaccagcacaaggcactgaagggggaatcagagtggccgggagagagcgatgctggggccaggaggaggcggtgggcaggacacgagggctggcttcctgggcgtcctcccaggtccgggggccacctggctgcctgcatccctgaagacggggctgtcactgctgttgtcccctgcttgtggaatccagacaccatgtggaagcaacaagggtgacccttaggggttccccacctggcacagcatgagggtgagccctgagccagtgcaggcctcggtgctcagggcctgggggcaagattctgagccctcctggggtcttctttcctggggggatgtcaggggcttctctttcctccagtgttggccctttttgggggtgggatgggaggttgagagctccagcctgcatcccagccgggacctgacctagaaccacctgggactcaggaagagcaggggcaccccctctcccagcacgccggcagccctcctgcggcccggtagcttcgggaaggggagagcagcctcctggccgttgaatgtgtccacgtgcagggagctgtcaggggaggggcctgttggttgcgcacctacagcctgctgggaaaaatggacgggctcactgcagccccgagctgctcattaaatctgtgtgcgtgtgtgcgtgtgtgtgcaccgtccaggcttctgatctacggggagtactgcagccacatggagcacgcccagaacacactgaaccagctcctggccagccgggaggacttcaggcagaaagtcgaggtaagtcctgccaggcgttggccctggccctggctccaaggttgcagcttgcaggccagagctcgttaggtaccagcctctctcttgcccatttgttgggaaggtggtgatgggggtgatgacgtaatggttttttgtagatttttcttttttgcattgtgttgggttggggagtgggttgggtggaggtcaccatcccaggccaggacacagtgagactccccatggagaaacgtccttgggactgaatctgactcagctgggggctctggctgacccctgatcctggcctctgctgactccagggagccccaggtgccatttgctgggaactgtgggaccacccacccctcatccatcctcaccccaggcccagggcgagtctctatcaactgggggctctgactgacccctgatcctggcctccgctgaccccagggagtcccgggtaacatttgctgggaactgtggggccacccacccctcatccatcctcaccccaggcccagggcaagtctctgtcaacatctagtgtttctcacgtgagcccctcccagcccctcctgttcccagctggagtttccaggctccatctggttagtacaccctggtttctgcgtggagcctggtgaagagccccctggctctagcagtggtggaggcagcgtggccccccagtagagatgcacgatgccccccaagtccagtcaatgaatgggggaatgccctggttcctgggagtggccccacagctcagtgcaagttggtgccccaccttgcttctcccagaggccagaccagagaggggttggtgaatgggggatggcctgctgccccttctccaaaggaccttctccaaaggacctggcctggcggaagagtcaaggccacatccagacaggcccagcaggcgccccgagagggtttccgtagcatcgcacgtgtctcactgcgtcccagtgtggccagtgcagacacggcagggtgggagccatgtgttgtgaagcccccccctctgcacacacctggtgcatggactggttccgggagcctggctagagaagggccaaacgtctgggcctgagttctgggcttaggtctcccctctctgtgggcgggggtacaggtgggtgggttcaggctttcctcggggagggctctcccatcgccctgtcgccctcccaggagtgcacactgaaggtccaggatggaaaatttaagctgcaagacctgctggtggtccccatgcagagggtgctcaaataccacctgctcttgaaggtgaggctctgggccccgggtgcctgcggggtcatcactgctggagtcagatgagggctggcagcttccagggggtataggttgcagcccacagacagattaagttgaatatagacaagtcagttcatgcttagctcataatcaccgctcaatgcatgtgatggccgattatcacagtaaatacacagaggaaaatgatgagtccaatcactaaagaggtcagaaaactgaaagagacagaaaagcgtcctcacaccaggaataagaaagctactgtggttggtctctgagcttcctggtggccatggcagaaatggacatggaagggcttcaggaaagccagacctgggagggaaggcggtggtttctgcccggcaccttgcgaggcccttttcccgtggaatgctggcacagcgccttgctttttgctgccttcatggcccttctcacggtcactcccttcccttatccacaaggtttgggagcgcccctgccaagaagtggggtatcccctgtggaggagtcactctctgtcctttggtgtcgggcagccaaacccagcctggctggcgggtgggggtggctttcttctgaggacttggttctgtgcacacctcctgccccaggtaggggccagggcagaggccagaacccccgagtggtaacacatgacactcttctcacccttccaggagcttctgagccattctgcggaacggcctgagaggcagcagctcaaagaagcactggaagccatgcaggtgtgtgggtaaactgaggcaggggagaagccaccgtctggcttagcccgtgttcttggactggaattgggctcattaacgagcctcagttttgactgtggacagtttcctgggacagcaggagttggggcagggcagggcagggcagtgggtgagacccacaggaggtagaggtgacgggtggagggcactgcaggtcaggtgccccctcaggtgtcccgagtcctaacctcacctgtccaacaagacctcccttgagcctcccctccccctgcttttcccccaggcattggcctccattctgggctttctggcccagtgcttctcactcccagcactgaggcttctgcttctaaaatgccacctccggtgccatctctcagctacctgcctggggagctccttcgctcctggctgtttcgagggcccccagccagccatgcctccctctctccccttgtccgggtgagctcagctcatgccactcccttgctcagaaaccttccgtggctccctctgcccatgaagcaggcatgggctcctcactctggcactcccggccttctgcaggatacttgcccctgatgtcgcagctgtgttcagcacagttccaggcaggtttgatccctcccaggctcctgcacgtgccctgcacttccccggctccgggtgttggctcaggtgcaccctcctcctcgtcacctggccacgtcctgctcatcctgccttcactgtggacagaacgttttccagggaggatcgccccccactgggttctgtcctcagggaactggcttcctcgtgggtggcactcttcctcctggacacacttgttcgtgccatctccttcccagccaggcatgtgtcagccatagtcacctgtgtccccaggccaggcacagcacctggcatgtggtaggtcccctccagctgcatctgggtggagggatgacgaccccccccacatctccctcgtcgggagcacaggacacctctgccagcccccctcagggctgcagtcctgccctctgacacctggcccctgccctctgggcagcccccctgggctttgggcccccttttcctttcccaggtacctcatttaaggagctccctctgggtgggggaggggctgtaatctgtctctgtctatagctgctgttgggctgggacgggagtggggccagtgcttggccgccggtgctaagaggttctctgagcagggcttgtgctcggggagaaatttactccaaatcctgtgggcactcgtgtgtgggcacgggaggtggtcccagagaccttcagattcccgctcggctgcactgggcagcgagcaccctgaggaatgctccaggaaagcctcctgccatgacgggctgacagaactttctcggtgtcagctctgcagcccccaagccgcccctctccaacacctgctctggcctgtctgctgtgagccacggtgtgtgagccagcgtggatgcgtcctcgggggctctgagacagtgacagcaggtgcagtgggccgtgcacccgggccctgagtgtggtcttgcgtttcatactctcagcactcggtgtctggctggcgagtggctctgagcccctcgacgggatggtttcccaggagtgtagctcacggtgctgcacaaagtactcggtgacttgcgggtgtgcgtctgcctttctgagagccaccgaacctcatcatgaaacttcagggctggggggattttagaagtcttttgatccattcccaatttatataggaagtcattcatgcagccactatgggagtcgtcgctgtacctgggcttgatttcccctagggactgagggctcactccttgtacggcagcgtctttgagaatcagcccccgtgccgctgtgggcctgaggtttgtctccaagggaattgcggttttaggtccaagctccatgagctgactgcagtcctgcctctgtatcaaagtacagacatttccctcacctgctcattcattcgggcaacttccatctgttcctatttcatgccaggcattgggccaggtgcacgcaggggccgcggtggtcacagttgtaatgtttctgcctttgggaggggggtggtcctgagctccagacttgctactggggtccttgtctctgggaatttattccttattttaaaggcaagtggacaacgacaagaaaacggaacacccctttcagacagcgtgctgcagcctccccaggaagttccctcctgcggggtgggtggggagccaatggtgaggtcttctaggaacgaggaagggcgggagggatgggaacctgctgaagacctggctctggctctggctctggccctggctggtcacttgcattttggggaattccacccgctgctctcggggggcagggccaggaccgcccacgtggccggctcccttgggttccgctgtgggccaggtctggacactgcgttttctggactgaagtgggcactgctctctggtggccagcacgaggattgcagcacggcaggcaggcgccggagtgggggtggccagacccgtggagagagggacttcctgacccctcattctgtccaggctccaaggggaggctgtggcttagagaggctggggagggggaagcttcccaagaacagggacataggtcagcccaagtctaggtggctcttatgtggcctgatgtggctcccacacacagggctgcttccctctattaggatgtttaagagggaccacgtgatggggtagaaagaagtggcaccagccaggagtttggggctcttggcatcatcactgacgaggtgtggctctcggtcagtgtgttccctttcctgcctcagtttcctcatctgtcatgcagaggtgatgtttttcagccctcctgtctcgagggcggcctccccggcaggatggaggaagaaggtccagaaacgcccggtgcctggatgctgggtggggggtgggggggggggtcccttgggggctgagctcctgcatgtatgtgcgtgcatgcacacacacgctcacacacacacaccctgcacagcacagcttgctcacacacacaaccacacagtcagacacaccccacccggcacaacctgctcacatacacacacacaataacacacacccaatcacacgcaccccactcagcataacctgctcacacaatcacacacacaatcacacacaccctacccagtacagcccactcagacacacatgttctcacacaatcactcatacacatacacaccacagcacagcccgctcacacacacacacacatgcaccccacccagcacagctcactcacacatacacacaatcacacacacataccccacccagcacagctcgctcacataccacacaccccacccagtacagcccgcttatacacacagtcacacacaccccaaccagcacaaccagctcacacacacagtcacacacaccccacccagtacagcccgcttacacacacacagtcacacacaccccacccagcacaacccgctcacacacaccccacacagtacagcccgctcacacacacatgctgtctcacacacacacaccacagcacagtccgctcacacatgctcacacacacacaccccacccagcacagctcattcacacacagtcacacaccccccacccagcacagcccgctcacatgcacacacaccccacccagtacagcctgcttacacacacagtcacacacaccccacccagcacagcccgctcacctctgcctcttgttttcaaggacttggcgatgtacatcaatgaagttaaacgggacaaggagaccttgaggaaaatcagcgaatttcagagttctatagaaaatttggtgagtgagactgactcttcaggctagggaaggtcgatgaggacgtacctataaagtcacgttcacagccccagtattgagtgagctccatgggcagccacaccatggctgcctgttgagaggctggtgcccggcaacttctgagtttgatctcagacccccagcatccacgcttccttgcccacgacagccaacccaagtgccctgtgcactgaagactgcctgtgctcggggggagggggacggggaggggaggggacaggggagggactgtattcattgcccagccccccttctcccccaagcctagacagaagaccccttcaagtccaagaggagaactgtgtctcccaggggcaggagacgccccctggttcgtggacccctggcccaccctcaccttgactctcccctccaggggcaatggacagggtttgggcccaggctcggtggggccggcagtcgcctctgctcctcggaccccatcaggcagggctgccacctcctggggctccccagagtctggccctgcagaggccaggcttgggctaccgagtcagtcacctcgtcctgcctggggagaggggatgcgccaccccaggaagcaaactccctggtctgtgctgaccggagccgacttcccgaggatctgctggttctaacctgggcttctccacctcagcactgctgacgtctggggctggatcattcttggttgtgggacctgcccctgtgcgttacaggatgtggagcagtgtacctgcctgccacccaccagacaccagtagcacccccaccccctcaagtaatgccaaccagatatgcctctggacattaccagagggtcctttgggtggcaaaattacccctggtggtgaatcacaaacattttcaccctggtgatttcactgacatgaagctggcaggggaaggtccccgatggccaggccacacccacccggtgccagcagcacaaagagaatgccctccgcgaacgtggggcacggaaaagcacctgcgatacgtcggcgatgaaagaaaaaaaaaataagcttctgaagggcattatgatactgcccccttcatctttcattttagaaagaaattaaaatgtgtgggtgcagaggaggccaaggacggccgcaccctgcaccatcagcacctggcgggtccgtgctgccgtgagctcctgcgcgaggcggtcacaaatgcgtacagtgagcaggacgtgaggagaaaagttcgttttgttttgttttttaagtttttacatagaagtaatacttgttcattaaacagcaagaacaggctgggcgcggtggtcatgcctgtaatcccagcactctgggaggctgaggtggaaggatcacttgaggtcaggagttcgagaccaacctggcaaatgtggtaaaaccctgtctctactaaaaatacaaaaattagccaggcgtgctggcgggtgcctataatcgcagctacttgggaggctgaggcaggagaatctcttgaacccgggaggcagaggttgcagtgagccacgattgcgccactgcactccagcctgggtgacgtagtgagactatctcaaaaacgacaacaacaagaataaaacagcatggccagcaggcgtcgagcatccccatgagccaggccctgtacccagtcctggctctgaatcccattgccacagggaaggtggtgagagctgagatcagaggcctggagcaagttgactgggactatgtgacaccaaagctgtccttgcagcctctggggctgagaccttggaaggagacactgagcctgtgcctcgagcacctcccaggcagggccctgttcgtgtcttgaagcattttcctccaccttttcctgtctgtgtggacactttgaaagccacgcagggaacatgtcaagagaagctctctctgaatcagaagagtcacagagacaaaaccagacagacaacgaaaatgaacctcagcgaaccacacaggggtctgagtcgaagcctcacccttggcaggaccccggccccacccgccctgcagcagataggcgctgtttgttctctcctgaacgtggggcttgggcttctggcttttccgaccgggtcccgcttggggctccacacagcggcggcctctgtgaacacaaccggcaccgtcaatcgccctttgtccccagagctgaagggagccccttggcagggctggccaggaaagggagagaagctgccaggcccagtcccttcccggtcttctgcaccctccctcgtccatcctgagcaccagctgggagccacaggggctgtttcccttcgtcccgcctctgctgcctgtggggagttcccttgggtgcacgacagtctgccctgcccgtgcggtcaggagaactggggctgctccagccccggctgacggcccctctccttcttcccagcaagtgaaactggaggaatttggaagaccaaagattgacggggaactgaaagtccggtccatagtcaaccacaccaagcaggacaggtgagcagggcgcgtgttgtgggctgggtggcgtcccgccagggtctggctctccctcccagggagccactcctaagtggctctggaagccaggccttcctgtggaaagagctgcctggcggtggctttgtgttgttcagttttaattgcttccttccttctcgtcagcgagcgggcgccacagcagtggggcttttgtgcctgtggcgggcaccaggctgggctggggcagccaaagatgagggccaggcccctcactgccaatgctcagcctccaggaacccaagacaggcccagagtggtcggatgggctctttgccaaatgactgccggagagtgtccaggcgcacggtggcccaggcttgtccagggccctccttgtgcacctactgtgtgctggggcaggggtcacagcagatctgggtcccaccctcttgaggctcccagtccagcgcgggatcaactgggagtagccgtcgggggtcagtgctgcatgggaggccagcgtgggggatgcaggagccccttgaagggctcctggcacagcctcagtcacgggggtagggagccaaggaaggcttcctggagaagcagtgtgggaacagccgagacctgaccgaggctcagcattagcctggtgagccaggtgagggcagggctcgcccggagagggagccgcgtgccagagcctcaggctcagctcctgccgcctcctcggagcagagcacacagtgctggggtgctgatcccccgctgcgctgcctggcccaggtacttgttcctgtttgacaaggtggtcatcgtctgcaagcggaagggctacagctacgagctcaaggagatcatcgagctgctgttccacaagatgaccgacgaccccatgaacaacaaggacgtcaagaaggtggggccttccgggtcccccctgctacccaggaacgtgggggtggcctggagagaggcactgggttccagaccccaggggaaggggactcgaagtcagccgctgatgctggccgggtgggttggggtgggcgtctccgctctgcaggaaggctcctctctgagtcactgcctcgccgtcgtgaccactgctcatagcaggcctgctcctcgccgggcccagcgccccccagaaaggtgggcaagaccagaatcccactccccagtgaggcgactgaggcagaggggagaggccaccccaaggcctctagtgagggtgggactttcaaccttggctttccatctggccagcctgactctagcccatgttgtcccttgtagcaagcaggctttcctctcccgtcccaccctgcggtgcttggaggagggctgtgggtaggtctggctgtggcttgtccgagactctacatgtagctggctggggcctgtggctgctggggtggggccagggctgcaggggtggggcctgtggctgctggggcggggccaggactgcagaggtgggcctgtggctgccagcgggtggggccagggctacagggacggggccgaagctgctgtggggcaggaccatggctatagggctattgctggctggctgtctggttcagtcctgcttcagctgaggcttctgcccatggcacttgagcagctaccgtgtgcagccctggtggggtggggggcgggggtcaggagcccttgttctgaaagtccagtccctggcctccagggctggcagtgtagccctcgtccagacccagcaagtgcagactggatgagctgttgagggtgaccctccctgccctcatgcccaaaacaagtaactggggcccatgaggcagtcctgccaccagcacccaacactctgggaagaaattcctttccccactgatcaccccacccccagcctgggcactggggggtgttccacctgccagggctcctggcgcctccacactgcggcacccaccacagggccgggcttagcctctcactgaccgtcttccccttcctctcctctccatgcttcctagtctcacgggaaaatggtaagcacctagcgcccaggtcctcccacctgcctcaatcatcccagcctggtgctggcacttctgcccggagccaggggacccaggggcctgaggggctgggctcagggttttcttggtccttcgtcctccactccctttcccgatgatgaaatgatttgtattcatgatgaaaggcttgcccgctaagacagtgtgaaaggaaaactccgtgatcctcagtccctggagctcggggtcagaggctggggtttcttggtctctcttcagctctccatcatcctttttgtttttctgtgttctctccctcctccctccctctttctccccttttcctctctctttccttgtttctttcctcctcccatccccgctccacgcttcccctctccatccctcccttcgttcctctttcccgccatcttttctaacccagtaggctcctatttgccaaactcttttttctggaccactttgaaagccctttgtccgagagctcggagagatggcgaggcctgtggggtggccgaaggggaggcagggaagggggcagttgtgggttgctcagtcggggatggcttcacggggggtgccccaggcccatggctgttccctgcctttttgttgttactgttctacttcagagaagtgaggtttttttagcatcacatttaggaagtgaaagtgggtggtcaggcctcgtggaggggccctgggtggggccctgcgctcatccttcctgggatcctgcccccgcttaacatgcatctacatatgcactcggtggagcatcctcgcacatgggcgcaggcaggagtgcagacctgcccaggcatgtgtgtgtgcacccacaggagagcacccacaggagagcacacacaggagagcacccacaggagagctcacacagcatgggtgcatgtgcatcatacgtgttagtacatgtgtgtacctgcagggacagatacaagtgtgtgtgtgcacatgctcacaggagcactgggcacactcatgcacaggtgcacacgcatagacacgcgtgcaggcacagatgcacacccatgcacgcaggagcacactagtatgcatgcagaggtgaaggcacaagcgcatatgtattctcacgtgagggtatgggcacacagctatacatgcatgcatacagaggcacgtgtgcacgtacagcatgggcaagagagcaggtacacacgtgagaacatgtgttcacacaggcacaggcacctgtgcacatatgcatatacacacgtgcacatgctgcacaggcgagagtacacgtggacatgtgccaggatgtctgaagccgtgtctattgcaagcatggcccctctcccccctgcagtggtcctacggcttctacctaattcaccttcaaggaaagcagggcttccagtttttctgcaaaacagaagatatgaagaggaagtggatggagcagtttgagatggccatgtgagttccagggcggcagcccccaggtccctggcagatgagttgtatggggggtggaagcccaggtggattgtgtctgtggttcctctcagaccaggggcggtgggaggcaaagttggaacgtcagggacacagacaacctccatcacccctgggacgccagcctcaagcagtgacatcctctttaacaatcagtccagagtgagagggctctccctctgccacagcctgtcccaggcaggctccgctgtcctgctggaatgagccatcccacccttgaggctgagcctggcacgcccggcccacagagcagtgaccggctgggagtggccatgatgccagaggattcctggtgaccccagtcttcagggtcttacgggctggcggcttgtcacctgtttttgaagccacagaactatttttccatgagatccaagaggactcatatcctagatatgtgaaacagagaaagatgatgaacgggttcccggaacacggaccctggagggccagcagggttgtctgtgcttgagctctgcgggcaggtgagctggggcctgcaggcaggtgcactcgcctctctgaccgtttcttctggtgaaatggagaggggaaggcctgtgttctggcctttttgggaggatcgaaagggaaccattggacacagcagggccagggcctggctcgtgagaatagatgcagccagctggtttgcacccaggctctgtgggggaggcctggggcatcttctcttcggccactcgctttccatggcctgtaattttctccccaacatcctattgtgcaaaagttcaagcgttcatggaagctgaagcgacgtgatggtgaatagccgtcttctcaccacgctgccgccatccgcgtcaccccaccccaccccagccatccaacagcgggtctgtgtcaaagtgaattgcacaccagtgcagcccccctgagtacctcagggggcccaatatttgtttagcttctgaaatttcaagcttatatccaatgaggcaaacaaatcttaagtatatgttttctgagttttaacaaatacccacacctgcccacatccaagcccagtcaggaccttagaccaccgtccccacctggaaggttctctcaggccagtgcagcagtgttaaagcttcttctctgacctgccttctacgagcagggagtctgggccctgagtctgccccatgttgcgggcagagccaggcttggagtccaggccctctcggattctgcacagcctgggtccggagcccagctggttcccaggatggccacatggtggggctcggggaatccagtgggtgtagcatctgctctctttccctcctgccaggtcaaacatcaagccagacaaagccaatgccaaccaccacagtttccagatgtacacgtttgacaagaccaccaactgcaaagcctgcaaaatgttcctcaggtgtgggaaaccccctgctacagccctcacctcgctccacgcccagcccaggcccctgagagagcttagtgttctatctgtcccatgttccctgtgggaggccctgaggggttaagggagtataccccacaagagtcaggcccgtgccaggcatggtggctcaagtctcagcactttgggaggctgaggcaggcgaatcgcttgagcccagtagttcaggaccagcctggcaacgtggcaaaactctgtctgtacaaaaaataccaaagtcagccaggcgtgttggcctgctcctgtggccccagctactcgggaggctgatgtgggagaattgaataagtcctggagattgagcctccagtgagctgtgatgtcgccactgcactccagcctgggtgacagagtgagaccctgtctccaaaaaaaaaaaaaaaaaaaacggcccagccaagcccttagagtttcagatctagccgggaggtgattgttcctgggtgcccgggatgctgtgtggggcagggaggcaggctggtggaggtaggggaaagcaggtgtcaggctgcctggtaagggagggtcctggatactcagggctatgagggatgtgtgtgctgggagacagccagccaggtgagcctgggtggggacaagggccttgaccttggcagagaggcatgaggagccgaccccagcctcgacctcacctcctgccctcccctgtgcaggggcaccttctaccagggatacatgtgtaccaagtgtggcgtcggggcacacaaggagtgcctggaagtgatacctccctgcaagttcagtgagtacccccctcacccccccaccccagtccctggccacgcctgctcacttctgccccctaccacctgggtacgggcctcgggcaccatctcccacggggcagcgaccagatgagggcaccagtgctcacgtgccccagagcagacaccagacgcctgccgcacgtcacacacttaacaggagacacagccgggatgaattccattccaagccctctctcctaatgggtacttgaggacccctccccatctcctgcatcccctgccccactccaggaggaagcttctagaatctccacccccaaacacggcacagaacattctcaacaggtgcatggaggtttctcatcacagaaacaccggtcaccctgggttctcccggcgggtgaggcctggccatcagtagctatagccatgttagtaaatggttcagacacacacacacatgcacgcatacacacatggcacttacagtggttcccttctgttcatgcccatttagggaagcttgaggctcagggaggggagaggattgagccaggctggcagtgggcagaggcagggatgcgccctggaggctcctctgaagcaccttgggtcgggggcatacctttggggttgtgccctgctcagggcagctggacagcagtgcaaagcctgagacagttctctcctgagaggtttcagacatcaggatgtcacctccatcatcagccccagaaactgaggcttgaaactttcagcaatttgtctacacttattagcagagcttctattcaacaaagagcccccggtggccccaggccgagtctctgggtcttgtctccttgagcctcctgaaggtgtcttaaggcagaaaaacaagtcaggccagcttgtcacccagagattgtcacccagagacgccattgcccagaatacattttgagctgtgattttagatcaatggttaattcaccatttactgtgagtgccagcccagtaccctaacctggggagagggccagaaggtcagcccagacccccttgtccccatcacaggcccaatgcagccccctagctgtgcacaggatcccgcagcccctggagttagtgctggaggattccgcaggcagcctgtggcctgaacgcagcttttcagctgtgcccatcaatactgccctctcgtggtcgcatgtccccagacgatggctgcagctacttagaatctttttttgctttctctgattctaaaggtaatgtttacttatcaaaaatttggaggaaaaaaaaagaaatgaaattttaaagaaagtatcacccgtgaacttacctagaaatgatgaaaggcaatgtttcggtatatttccttccaagttttctttttttgtaatctttctgttcctcccccgccccgcccccgccggattattaattactgattttccgtagaaaatttggaaaatgtagagaagtgtaaaggaggagagaaaaactactcctcctatccccaggcaaagccagctgccacgaggccccaagcactgtcctgctttctgcagacgcgcacacccgcccaccccatctctgtatggttttgaatttttcttagtatgtgtagttggaactgcaggtcttttggaagccagcattgctgtctgcattctcccatgtcctggcagcgccctggctggcaccagctccattctccccaggggcctgtgtccttgcccccctcctcatccctctgctgggggacgccgtccttgccacttgtagccatttttcccttaacagtgtccaagctgccttccctctgatccaggcttctacctttgctctggggtttggctctggaaagtgctcctttgaccattgtagccttcacccctgggctctgccgaggctggtttagctgtttgctgcccatgggggccgagatgtcccggagagatgctggcctctcctgagagcctttcctgtgggaagcccccatcaggcacagtcattgctgccgtccagctgccccccacccctgacccctgcccactgagctggaacctgttctgtggtgtctgtggatacctctgtctgcccagagctgtctgcactgtgagtgctgggtggtgtggaggtcacgtcagcgatgtgtgtgagctgttgggctccttttcctccttgcctcctctggtggtaggtggcagccaccttggcagatggctgggccctaaagggccttgggaacattggctctcctggcacctaaggtcttgtgtccttgagcgtgttggcacctgggtgtctgagctgaggatggcaagcaggtagcatgcgtaccaatgcctcctcatcacttgccccagcaggcatcactaagcggttgtggcaggtagcatgcataccaatgcttcctcatcacgtgccccagcaggcatcactaagcgattgtggaaatctcccctttgagtgccaggtaccaccccatgatccaggcagctgccgccattcaaaagaggtggcccaggcgggataacctttttgccagctcaggtctattacccagtccaagttctcccatgggccccctaaagccagagctcagaatttgctgccagaagtaactgagaggctttcacagccatgagctcggacctgtgtgtccatgatccatgtccaaaacagaccactttgtagcttggctcacttaccatcttaagctcggcccagaggctcggggcggtgtgagtgagagctgcacggggccttggcgtcggtggcctcccctctaacacctgacctgcttcctttccagcttctcctgcagatctggtaagtccccagagtgtttcccctccctctgccccacccccgccacatccctgtgtgcgcagagccagaaagacccaattgtctgcctttcaccactcatggggccacaccggcttggatgagccacttttggtcacaagatgcctctgctttccttggtgggtgtcattagagtcctcctaggggccccagcggtgtcttccgatcccagctgcccgcctcattcccttgcccagtggctgctcgcggctatgggtacagctctgggacctgcaccagccctcctgcccccgagtcccccagttggctcagagccctctgtttagctgatgtggggatggagtcacttccaggggcttcgtgtgcccctcgagctatggggtccacatgaaccagcctccatggaggatggaaacttagtcgtatttggcactgtgtgtcccagatggacaccacaaagcccaggctcagagcaggtggtcagggcaggcttcctggaggaggtgggggcccgtggtaaggagtgggagagagaagggcacagaccttccaggagtggaggtgcacagaggtgaaatatattgccagggtgggggcgtcccatagggaacagtgtccctctcctcccctgctcctgccttgacccctctatctaggaactagtggggacagggagggcggggtgcgttgatgcatgggccacagtcaaagagcagccttccctcatctctgtgttctgtccttgtcctcacaggacgcctccggagcgggaccaggtgagtcttctggacctgggccctctgctatcacccatgtcagccatcacctgggagctgagccagggcctaggtgtggtgatggccaggtctgcccagccaccagacgctccaggctcctggatgctgccatctgggccccctccctcttgcctctctggcctctatggcacctccttgggaggtggctctgtttctgataaggcagcaccaggctgtagggacaggacccagcctgcagaggagcaagggccttctagccagggagggccaccgaactgcagccagagacctgagatcaaaaggcgctgctgttctcccaccacgttctccatccccttcctgccttgctgcgggttgcttaatggaaacgtgcttctagacacagcgtaaaaagcatcgtgttctctgcaaacttgagtgcagtccaggcagtgctcagtacagcctcaccctcatcggcagaggacaaaagatgaaaaatgctgctgctgctgctgggccaggcgggagctgggctgggagagccatgggctccttgagagctacaggcagggctgggtcagagcaaggcttgtctaagagcagcctccacattccctggaggcacagccaggacccccatttcaggcccagagcacctctgtgagctctgtggccttgggcaagctgctgggcctgctgacccgtcgcccgtctctgacacgagggatcccccgtcttctgccccgcacagctgcctgtgggccacagatctgaagggtgtttggaagaaaacacaaagtgccatctgaaaataagttgctgttccatgatgacccctgaatctgtctattgcataaataattatgatatttatcaaaaagacatgaggcttatgggaaggatttagggaagggagatgcaggcgcaaggctgtgtgtgctgggggaggccgagcttggtgatggggtgggctgcgggccggggccaagtcagtcaccgagtgagctgctgagtcactgagtgagctgtcctatcctttgcaggtcccaagatggtggccatgcagaattaccatggcaacccagcccctcccgggaagcctgtgctgaccttccagacgggcgacgtgcttgagctgctgaggggcgaccctgagtctccgtggtgggaggtgggtcctggggcccgggagggtcgagggtccccggctccagctcctccctgctccctggggcagaagcataaagtcctgcacatccccaggcagaggcagagaggtgagagaccaccagggaggaggaggcacagggggcctagcaaggcctctcctgcctcagtgccccgttctgcgccatggcatgtgttcttgggaaccttagcttgggctccccgggtgtttgctttgacatggtaggcgatgcagcgtcccttcccaggagaggccctcctgccctggcacccaaggcctttctccattgtcctctgtccttcctgcctctgttgtgtctcataggccctcaggcttctgccctggccatgccatgcccaccctcctccccacccctacctcagttcaggccagcaaccttcgcatgatcgtggggtgagcgggcaggttcgctccttccccaggtgggcacagatgttgtcatcgtgatgtcgtttatggttctgagccaggaatgtgctgctctgtttccaaggcccacagagtggggacctttgtgggcgttcatcccggggacctttgtgggcgttcatccccaccttcagcagatggctgggctgtaaagggttctgggcacatttgcccttctcttgacacgctgagaccccatgtcgttgagcatgctggcacccgggcgtctgagccaaggactcagacccccagtcctcggcccctctaccaagccccagtgctcaagggagccccaagacccacaggtcagcagagcgccacggggcctcgagggcacttagcccagcaaggtagcttcccgcgggagctgacattagagccgaatgtttgttaatgttcaggttacaatgatgctgtggtcattttgtcatggtcattatcagtccatactcggtgatggatttcttgtaccagaccctacattcatgtaacaggaggttcagagggtgcaaaaggccatctgagctgtgcagagtatcagtcctgctctgtccctccccgggtatgaccagggctgccagcttcttgggggggccttgtggaggtgctttggtgctgtgccaggccttagtgctctcatgtctagggtgggaggccctgcacctccctgccctaactggctgccgggtcagctgaggttgggaaagaagacattggctctcccaccctccaggagcgggattggcatacgctgagtccgtctaaatggccccacactcccataggccaggctcggcccccttgtcctaaccatctctttcctctgccagggtcgtctggtacaaaccaggaagtcagggtatttccccagctcatctgtgaagccctgccctgtggatggaagggtgagtcctttcccacagaagcttctggagcacggtggcctgggtgctgagggttctgggagctgcctcctcacgtggacatttttggcttgttcaggacatccttgctaaatttaggctgctgtgagctgcttcctggagctggagcccagagagaagatgggtggggggctgtggggcagcacgctctcctctgtttaaagggctcagccgatcgggtgtcgtttcgttgtggttttagaaacaccaaaacaggcatttctgcagcagctgtaatggggtgaagaccagccagctgcctttcaccagatttcggggactctataagatctcttggactattgcgcagccttagagagaaaaaaaggctcccctcaaacataaggattcaaagctagactttatgctatttaaaacagaggcaatatggtatttctttcatctgagggatatggagcgaattctcggctctgtgatgaaaggcagcaggcagccttgagtaaatgagttaccccacctccaccccgaaaggacagctcagagtgagagcgtggaacctctgaaggtgcaggggtgggttcccaaccccactgcggcagccccggtgctccccgaccccagccccagtcccgtccgcctgtgtgctacctctgctgaaagggcaggtgctcagcacttagggcactttgcgtgaccaaggggaccaggcggcaggggaggacaagggtcacaaactcactaggtggcctggggcaggttccttcccttccccaggcctcagtttccccatctgcatggtgaatagggtgcgagggaagaggtagtctctgaggctgtgcccagcctgtggcccagtgaggccagggtggggggctgtagccagggagggagccctacctgctcactggagcggcagcacctgcctgagtgtggccaccaccagacccccaccccggggtttccagacctctggagcagggagcttggctgtgggtgtctcacatccactggctgaaaacttcccgcaccttcggtccttgctgtcccaggggatcaagtcagtgttagctggtggctatgccgacatctgttccatcagacccacggggcatctactcagagatgaggttgtcctggccacgacccttgggcacctcccaggccaggggcgctggggctaagtccacagacagtcccctccagggcagccaatgtggggacagggcagtcactgacaatgaccccctctgagccctgctctgtgagtggccctggggggccgttaacactcttgtgctctgccaccagccgcccatcagccggccgccatcccgggagatcgactacactgcatacccctggtgagtggatcgtgggctgcagacatgggcatctggtggcctctttgttatgggggcatgcccgccgggtctgggtggtgcctgtgagcggcccagcagggtggaggccccaggctgcctgttgccatctccagggcactgagcccagtggctcccaaatgccttctccctcctggcctataactctccaggagcctgggggagtccttctcctgtaggcagctgttaaccctctctaaaacagctcaactggctcagatatttcagggaattaaaccctttttgaattttatctgcactatataaaagtggtatatttgaggtcacaggtgtaatccacttactgacaatacagttgcttggtgggaacagtgaggctgtttgaaatcacagaagtcccaactgtcctgacagtgtggcagcagattttgggagagagcttgccttgccctctcagggtgggcttcattgcagtacaggtggcaggaagagcttcgtttcaaaatctgttcaaaattcaactgacatggatgttggcaatctccaatgtgttaccaaaaaaatccacataagcagttatgcctttactgcttttgaaatagtgaaaatatattttaggaaagaaattggatctactgaatacgctgaactcctctggcaggcccttggggtctgtagagcagaagacagcatgtgggactggctggtggccacagtcacccctctatttaacccctctcaagatctgtcctgagcctcactgtatcccactgtaggaagggtcagatgccagaccccatccacagtggtgccccgctcatagggacccagcctgttctcttgggttcattaggagatgagctctcagatgaggactgcagagtacttcatgtggcctgccacgcacggagggctgggcacccctcagacactgtcctcactgcggctctcgtttcctcccggccccctcctgtaggtttgcaggtaacatggagaggcagcagacggacaacctgctcaagtcccacgccagcgggacctacctgatcagggagcggcctgccgaggctgagcgctttgcaataagcatcaagtaagtggcggctctgggctcgaggagacccatcccccaatgccgttctgaagtggagagcaccatcctctccacgtcctgagctcgtggggttggggtggacatgtcatctgttgccaagtgaggacattattgagatgaaagcggtgctgaggggtcagggggtctctacaggtgtgctgggcagggcctgaacccctggcatgcacagatggtccatgcttacatcactcctggctgccctgtgggctgggttggacatttctgggtcatgggaaccagataagctcaggtacaagtgggtgggtgagatcctgtgtgagctcagggatttcccagcagccccacaggttgagagagtggacctgtcgtgctgctctgaggcagccaggggcctaggagggtgtctcctgtgactactgctgccttgcggctttggcacagtctgggcatcctcctgccctatgccctctccctgggagccgcctccttgtggggctgcagttaactctccaggagaccgaccctgatgggctggagcccaccaagcactgagctggtgggacattgcccacctgaaagaaattctcagaaagccttctgtgtgcctggcctgcaggaggctaagatgggccttgccgaccaggagctgggggtagggcgcacacactcatggtgcacattaaatccagggagaaacaagatgggtgctgtatgaaggcctcacagaggaccaggcagccaggccaccatttgtttaatgactgtttattacattagctgatttccagatgttaaaccaaccttgcattcctggaatgtcccactgggttgtggtgtggagtccttgctatgtgtctggtttatgtagataaatacagtcatcggccacataatgacattccagtctgtgagggaccccatatgtggtggtggtcccgtaagattataatggagctgaaatgttcccatggcctggtgacatcatagcgcagcccattactcatgtgagtgtggttatgctggtgtaaacaaacctacagtgctgccagtcatatagaagcataggacaaacaattctgcacatacatagtatgtgatcatcgtaatacatgaatgtgttactggtttatggattcactatacagtgctttttattttagagcatactccttctactcagcaaaaaaatacttaattgtaaaacagcctcaggcacgtccttcaggagacattctagaagaaggcattgttgtcttaggagtaaaaacaacaacaacaaagaaaaaaaacaggaaagcttatagaataaggatacaaagaataaaatatctttgtacagctgtgtaatatgtttgtgttttaagctaagtattattacccaagcttcaaaaagttaacaaaaattaagaagtttataaagttaatttacgattgaagaaagaatgttttaaaaataaatgtagtgtagcctcagtgtccagcgttgataaagtctacagtggtgcacagcaatgtcctaggccttcacatttactcaccactctccagctcacccagagcaacttccagtcctgcaagctccagtcatgataagcaccccatacagctgtcctgttttttatcttttctactgtgtttttaccataccttttctaggctgacctcatgttacaactgcctacagtattcagtaggtctgtagcccgggagcaataggctttgccgtccagcctaggtgtggggtgtgcagtaggctctgccgtccagcctaggtgtggggtgtgcagtaggctctgctgtccagcctaggtgtggggtgtgcagtaggctctgccgtccagcctagctgtggggtgtgcagtaggctctgccgtccagcctaggtgtggggtgtgcagtaggctctgccgtccagcctaggtgtggggtgtgcagtaggctctgccgtccagcctagttgtggggcgtgcagtaggctccatcattcagcttaggtatagggtgtgtggtaggctctgccgtccagcctacatgtggggtgtgcagtaggctctgctgtccagcctaggtgtggggtgtgcagtaggcaatgccatccagacttatataaatgcactccgtggcgttcgtacagtgatggaagcacctgcctgcatctctcaggacaggtctccctggttaaacgccgcctgactgtatgggagagagatttggtctgccagctgcttgctaaggatttctgcatccatagtcattagggacattgggctgtagttttcttgtgatgtctgtgtctggcaagggggtgggtggcattcaggggagggatatgggggctcctctgtaaggtcacatttgaattgagacgtgaggacataagggggccttgaggacagaaggaggttagtgtctggcaggggcagcagccggtgccgaggcccagacaggcttgcgctcggcacctctgaggagcaggcccgaggcctggccggccaagtggacatgcagggaaggatgtcaggagatgtcagggctgggcccggctgctccacagggaggaggagaggctcctggtactgaaaagcaaatgagcagaagcccaggacaggaggcctcagcagggctagaggccaggagaggcggggagctgagcagccaggggttccgggccccaaacgagcaaggagggcaggcaggcaggtggcaggagctgtctggggctggtggcccgaagggctggggtaggacagggctgacagggagtggccctgggggccagggacgaggggctttgctgcagcaaacacagaatgagcctggctgccaagggggccggggccgtgtggccctcacgcggtgaccgccggggccgtgtgtttgctcaggttcaatgatgaggtgaagcacatcaaggtggtggagaaggacaactggatccacatcacagaggccaagaaattcgacagcctcctggtaggtgacttctggctccggccggctcccaccccagccacaggggacaggtgcttcctcccggccctgagcgagtggccatgttttctgtgaggattgattcttcccagtgtggccaagatttagggaattggtttttaaggcactaggacagctagagctatgtcccagcctcctgaattgggacttctgacccccaaagcctgagcaaggtggttgaccctggtaaacagtgcaggggtggggtaggggcagcccaggccaccagcagccccagattcctctcatgcccatcctcctgcgagagcagaaactgacgcccagtggggcttccagctggggcctggccgggtagccccattacacatgtatggcttcaaacagcttcttctccgactcacccccaccctctgtcccagccagaatgcagttagaggcatagtccttgaaatgattttaaagttatgcctacattttcttttcttaattacaaaagttgtatatattgagaactcctgattagagcccccaggctcttagcttccccgctatggccacagaaaagcacaaggtcaagcagaaatccataatctcgggctgagcgtagtggctcatgcctgtaatcccagcactctgggaggccgaggtgggtgaatcacttgaggtcaggagttcgagaccagcctggccaacatggcaaaaccccatgtctacaaaaaatacaaaaattagccgggcatggtggcacacgcctgtagtcccccctacttgggaggctgaggcacgagaattgtttgtacccaggaggcggagattgcagtgagccgagattgcgcccttgcactccagcctgggtgacagagtaagactctgtctcaaaaaaaaaaaaaaaaaaagaaaatccataatcccatccccacctccaaaaaaacaaaagcggaaaccagcgttggcatctcagtgagtcctcaggacctctctacacacagcttgggtctggtttctattatataaataataatgctggcaatgccccagctgatttttaggcgacttttcaaggccacaaacattcaccattaatgaatcttcccctggctgatggccgcatggctctctgtcacttggagatcctgttatttctagaagcttaccccaagtgctgggtacagagtgtttccattctttcctttataaaggctgttgcagtcagtgtccgtgctggtcagtcttggcatcttttgcagattattttttctagaaacatttgggggagttgctggtaccttcgaggtactgaccacccaccatgggctggcgggatgtggggagttctgaggagtccaggaagctagtctcccccacatgaaccaagaggtgggagagggaggccaggtcactgggggaggacttcctggaggtggcagcagctgtcagtgagtgtgtacgccctgcaggagttggtggagtactaccagtgccactcactgaaggagagcttcaagcagctggacaccacactcaagtacccctacaagtcccgggaacgttcggcctccagggcctccagccggtccccaggtaacgccccggcccagccggcacaccagcactcctcggaggggtctgccctggcccacttcccagggctcagatcctgccctcacagacccagaccaggagtcccaccctggggaacacagcccccgcccctcccccagccatcgcagatgctgtcatgtggcatctcctgggccatgtgacaggcggggactctgcacctgctcagaattgctactctgtgtcttggcttcttcacccagagaccagtgggggttggaggggccaggtccaggcagagacccctgcgcatggagctgtcacaggtgggagagaaaagggcaggcccacctgttcccagatccctccctgtgcccagcccctgggcctcctctgtgagaggcagcctgtttgcaggttggactccacagctcagaacagggaaggccacacggaatcaggggcaggggcaggccccgagcatgcggcttcccgctcaggactctctccagagtcaccccacgtcctccagcctgcagggtcctgcagggccatgggtctcacacaggccgagctggacaggagaggaacagctggccttagtgagcacctgctatgtgccaggcgagggcatgagaggaggtggtcccaatttgctctcgagtacacgggtgcatagagtggttccagggtagctcaggtgtggccgagtggcacctgtgcctgggtggggcttgacaacccgtgctgccccctgcctcctttgcccccctgtagggcctctcctgccaaagggcctgccccaccccatgccccccggcctgtagctgtgcccaccgtgactgtgcgtggatgccctgctgcccgcctcacgttctctctcgcctctttgcagcttcctgtgcttcctacaacttttcttttctcagtcctcagggcctcagctttgcttctcagggcccctccgctcccttctggtcaggtaccgctgctccccagggcgtggggggaccgggcctgtggcagctgccttgggagacccagcacggagctgcccactggccccacagccctgcctgacgtggccacagttgtccgcagtctggcactgggtggaggggagaaaggggctggggaggccgggcagaggctgctgcgagcacctgaggacacgtcaggcttggccctgccattgtcaccacccaccccctgtggacacgcccaccctgatggccactttcccagccccgtccactgtcattcctccttgttcatcaagagctttgcctctggtagcagaaagcaggtggccacgaggaggagctgtgggacttgggtgcagggaggaggggttttcagtcagccttgacctcatggctttcggctgccagagtcaaagtcccttcccagcagctgtgtgtgtttcgccctcagccatggtcattgtcacctgtctatcaggattctgcatctgggccaagctggttccactgggtttctggttggatttgggggaccactggaatgatgatggtcaaagcctgggcacctgctcttgtccctaagaacatcctcattgcagggacttggatgtgctgtgtccccagacccagagggcaaggggccctgggattggaggccagtgtgtccctccagagcctttctgcttgacatccttcctctctgggtacagagcagggttctgggcaccaggggagagacccagcttggcccaagggcctcctggatcactggttgggctcctcctgcagctgtgtgatgctgcccatctccctcaacagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacgggtgagtggccccaccctgagggtgtggggctggcctcgctgcagcccctacctggtcgggctcaggcagactagcaccacacctatgtccacaccccaggccctgttccagacaccctctgcaatctccctcatcctcacagcagcccagaaggttggcattcacagggggaaaccgaggctccagatgtttaccacgaacccaaggtcacacagccagaaatcggctacagaggtctgatgcggatccaggctcctaggaaccccccgaccctgttccatttttattctgggctgccctcatagctgcactcgccaaattacttgcaagtccccaagctctgtttgcgggaagggaggtcacaggactgaggaggacacggtgtccttgctgggctcctcctgccattttctaaggccctatctatgccctggtgaggcagtagggacacagtgtgtccccaatcccttcacactttcccaagtgccaggtgggcctaagagtgccctggccaccctaagattctgcatatgtctgtggcctcttcatcccaacaccccatctggacctctagctttgacccatgtctctcagtacctatccatccaagcaccagagctccctgtgccaccaattagaaaatgcccagctttctctgtgagctgcaagctgcacagggcaggtggatggggcttcagagggccagttaaccttggctcccagtgctgacccttccattgtccagtggccggagcagctctgccttcacctatcagtctgccccttggaggccctcaagtctgacccattttttacccaactgccctatagaagtgtcaaggctactgaggcttaggtagcccacctagggggctgggaccactggttctcaaagtggtccttgtgtgattggcattaaaagtgcctgaagctgtaatttaataagcacatacctgggctctttcccagatccaggtattttctatacagcattaagttttagaacaactagtttgagtattactggataattcctgtcaatttgaccctgttaccattatgaaacgtcttttcttttctctggcatttattcttgctgtagtctccttgatctgcttttgtgacaccagctttcttgggattactgctttgtgtggcatattattttctctcatactacttaaacttttctatttccttatatttaaaatggatttcttataaatagttggggaagccagtctggtctgacagtctttggcttttaataggcatatatagcccatttacatttaatgtaattactgagctgtttgggtttaaattatctaactttattttctagttgtcacatctactccttttttcttctttcctgcctacttttgaattaatcaatatatttttaattctacttcccctgccctacattggtttgttagttacacactttttttcttaagtggtaaccttagactagaggttaccttaaatgagtacttttttactatttcccagacaatgcaaggaaggaccttgcgacttttgattgcatccattttcctcccaacttttgtgcaagcgttctcatgtatcttaattctatatatattcaaaccttagaagacattgtttttgtttttttgtttttgggatatatatatatatatatatatatatatttatttatactttaagttctagggtacatgtgcacaatgtgcaggtttgttacatatgtatacatgtgccatgttggtgtgctgcacccattaactaacctaatttacattaggtatgtctcctaatgctatccctccccctccccctccagtgtgatgttccccttcctgtgtccaagtgttctcattgttcagttcccacctatgagagagaacatgcggtgtttggttttttgtccttgtgatagtttgctgagaatgatggtttccagcttcatccatgtccctacaaaggacatgaactcatcattttttatggctgcatagtattccgtggtgtatatgtgccacattttcttaatccattctatcattgttggacatttgggttcgttccaagtctttgctgttgtgagtagtgctgcaataaacatacattggagaggatgtggagaaagaggaacacttttacactgttgatgggactgtaaactagttcaaccattgtggaagacagtgtgggaattcctcagggatctagaactagaaataccatttgacattgtttttgttttaggctgttgtgcttatttagatttaccccgtgtttacctttcccagggctccccatttcctcctgcattattgtatttccacccaacaccatttcctgctgcctgacatcccttctctttcatattttttaaagcatatctgctattaatgaattctcagtttcttttgaatctaaaaccatccttatttcactttctttttaaatattcacattgtaaaatgtttgtaacataattttgaaacaaaatttcaaacgtacaatttcaaaatttcaacttaaaagtgtcagtaacctgcccagatttaccaattgtgaatgttttgccccatttgctttatcatttgcactgtgtgtgtgtgtgtttgtctatttctctctaactcacttgagagtaaattgcagaaatcatatttctttacccctaagtatttcctaagaccaaggacattcccctttgatataatacaattatctaatccactgtccatattcaaatcttaccagtcatcccaatcatgtcttctctagctcttctctcctggtcctggatccagtccaggatcatgaattgcattgacttgctgtgatccttaactctctttaatctggaatattcctcagtctttctctgccttacatgacttttacacttttgaagagtttgagccagctatttttataggatatctctcaatttaggtttgtctgatgtttcttcatgattagattgaggttccattgggaacaccacaatggggacgttggcactttctcagtgccgtagtgtcctgttaggacatgaattatgccagtttgtctcattatttgtgacattaactttgatcatgtgtttaagattatatttgctatgttctactgtgaagttactgttgactgtaattagcaagtaatttgcagggtaatactttgaggttaggtaaatatcctgtttctcttcaaactttcatgtactagttttatcttcccttgatgaattttatctattctattatttctattatggctgaaaaatagtgattttttgactatctatagatattagttggcattctactgtaaggaaaactttcttttctcctgtacttattcatcgtcccccaggaatcagtcatttttccaaggagacctagttcctttttgtgaggagttgttttgagttcattttgaagttcatttgaagttttgagttcattttactataatctgcctaggtgtgattttctttttatttattctgcttaggatttgcagagatttttttgaacctgtggcttgatgtccatcacttttggaaatttctcagccagcatagtatctgcagactgtgtgtctgttccattttctctcttttctccttgtaggacttcattcacaaggatgttagaactttttaccatggcctcatattatttccacaattttatgtgtttttcatccttttttctctctggttttctatctagtcactttctggtgacctgtcttacagtttgtcttctcttctgctttgtctaaatccctctattggattcttcatttcattcatcgtatgtttcagttctaggatttctatttgatttccgatttaggttctctggtaaaattgtctgccttttcatccgttttcttaaacgtatgaattagagttattaatctcccctgacagatgacctcaatacctgtgggttgatttctactgtctgctttttctattggtttttgtcatttggtcctgactgaatgccaagcttgtgtattaagaaaaagctgtagttgttctgggtgatgttcttttcctcaggagggtttattttttttctgactggcagctggagggtgggcagatcatcttaaactggccaagggtggtgtttttctgggttgctcttactcccaggcaatggttccaccaggtccttctgagaactctggacttccgaagggccccccatcttcatgagcctctacttgccctcaccccaacatagacatgcacacacctgcttacacacacacacacacacacagacacgatcttaccatctttttcagattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgcaggagtggtcagcctttcgtaccaggggaggagggaatggctggattcttccgcctaagtccagcagggtctgtctgactggggtgcttggatctcagggtggcccaaccgcagcagggtctgagagatacggaggtaatggtgccatggccacctcccggctggcacagcaccctgggtttcccatgcggtgccctggaattctccaggtggcatcgggcatacaaatgggattctaattcctgccccatcacttgggtacctcttgagcccctgtttctttacatgtatattgaagataaaaatagcctcagtgcagtggcacacacctgtcattttagcactttgggaggctgaggtaggaggctgaggtgggaggatggcttgagcccaggaagttgagacccgcctgggcaacatggcgagaccctgtctctacaacattttttttttaatagttgggcatatggtggtgcacatctgtggtcccagcttctcgggagggtgaggtgggagggtcgcttgagtccaggaggtcgaggctgcagtgagctgtgattgcaccactgtactccagactggacaacagagcaagaccatgaatctaaaaaaaacaaaacaaaacagaacaaaaaaaaaaaaaacctctccattttggtgggttctgtggtgtatgatagagaaaaccaaaatagaaaatgagagatttatttctccttcccctcatggaggaccatccagaggcagcagctcctttgccttgccctggtcccagagccatcaggaaccctggctcccccctccctgatcccctggtctcaggggggctcctctttcctgattccccatcctcagaggctcctccttcccaatctcccatcttcagaggctcctcctttcccgatccgccgtcctcagaggctcctccttcccgatccttcgtcctcagaggctcctccttcctgatccgccgtcctcagaggctcctccttcctgatccctcgtcctcagaggctcctgcttcctgatcccccatcctcagagactcctctttcccgatctcccgtcctcagaggctcctccttcctgatcctccgtcctcagaggctcctccctctctgatcctgcatcctcaatggctgctccttcctgatcccccattctcaggggctccttctccctgatcccccattctcagaagctcctccttcctgatccctcatcctcagaggctcctcctccctgatctcccgtccttagcatgcccttccctccttgtggctgcctcgtggtccacggtggctgctggagctcctgccacagggccatgagagagaacagagatccccttacagctctggccaggaaacagcccattttctagaagtggaaactgaggctgagatatgtgaagtgactcatccaaggtcacacgtggcccttgcacagctcggtctgatgccagagtccacgtttctgtttgggcagcacccagttcctaagcgatgacttttctgcctctcaggccagcccctgggtctcccacccttcctgcagactggaccctggccagccttcgccccactgaggctgctgggaggcgaacccgatgggcagagtgaaaatgcccccttctccaggagcttccaaccccaggaacctctcccttgggccaagccttctcccagatgtgcaggctggaccatgcccatctgacctgccctcgcccccattcactggtacgtcagccgagtctccaggagggaccccttcccagggccggccccaccctcctcacgcagccctccctgctgctcctggccccctgggggtggcaggcaggtgtgggtgcagggcgacccctggacagctgaccgtggagtgggtgtcccaggctggtgatcagaagggtgaatcaaggagaagtgatggggccttgcgttctgagagaaaataaaatagctcccatttactgagtgttttcttctaccaggcatgggggctctgggcgagcacatccctccccttcctccgtccttgccctccctctgtccctgccctccctccatccctcccctcgctccaccctcccctagctcagtccctcccctagctccattcctcccggtgttccgtccctgccccgctccgtccctccccctcgctccgcccctcccctcgctccgcccctccccctcgctccgcccctccccctcgctccgcccctgccctcgccctgtcctggttggctcaggctgccgtgaccgctgtggctcaggccccagacccggctgcctcaactctgaaatctcctttcttacggttctgaggctggaagttggagatgcagtaagggagggcgttggttcctcctgaggcctctgcatgctcatctcagaggtctctccctcctctcatggggaccccgtcctcttggattagggcctaccctcaggacctcgtgtcacctcttccgagtccttctcagagtcacatttgcggcaagttctccacgatggctttgcagcaagaatcacttccactcactccacagtcctagcgagggcccactctgtgccttttcgatgcccgggaagaaaccaaatggaaaagccgccgccggggaagctgatatgcagggagtggggaggggtggggggagaattgaggaagctctggattgtttttctttctgctccttttctctctccccctgcttgtccctctccccctctttccctgaatgtgttgcagttttctacgggactcatacaatccctacttgacccactttgggtgttttcttttctttcttttttttaagagataaggtctcactctgtcacccaggctggagtgcagtggcccagtcctagctcactgcagcctcacggtcctggactcaagcaatcctcctgccttagcctcccaagtagctgagactacaggcacgtgccaccctgcccagctaatttttttttttaattttttgtagagatggggtcttgctacttcacccaggctggtcttgaactcctggcctcaaatgattttcccaccttggcctcccaaaaaaccaagattataggtgtgagccgtcgcacccagcctaggtgttttcttttatctattaagtgttgcaaaaaatacgaattttgtgcttgtgcttgatttttctcatttatccaatcaatttgtattgattccttacctgagatccaatgttgaacaagaccaacaaggtctcagccagtttctagtggcatatcaggctgagctaacatggaggcctctcttcctccactgccaacacagaaatccttgaaaaaaaacatgcagaaggcatagctgagctggaaagaagggcccattccagaaaaagagaaatcgaagcccgaggagatattgggagctaaccccggggcagtctccagggtcttggcctctctgggcctgggaccggttccaacactctcctggcattgggagccacagttgcagatcccccgaggccagaagccagcactgggccccctgcataaagttaagcatctcagagaatccccattgtgcagaggagactgacacgcatggatagttgagagtgtctggaaaacaaagccaaaatcacggagaaggataaatgttttaaaatattttttaaaggttacagaaatagaataaaaaggcacaccataccccacgccaaatgaaccaagaatggttaaccttggagttcaaagataaaaagtaatccactgggcatccaagcagaaagaacaagtctcttaagagaaaaaaaaccaatcaggtttgctttagacattactccagtaacactcgacattaccccagtaacgctcaatgctagaaggcaatgaacaattcacacaaggtcttcatggcaagagagacccaagagtttgatgctcaaatagttgctcatttgtcaggcagcaactaacgcattgccacatgtaaagactcaggggcggcccggcggggtagctcacgcctgtaatcccagcactttgggaggccgaggcaggtgaatcacttgaggtcaggagttcgaggccagcgtggccaacatggcaaaaccccttctctactaaaaatacaaaaattagccaggcatggtggtgggcgcctgtaatcccagctactctgaggccaaggcaggagaatcgattgaacccgggaggtggaggttgcagtgagctgagattgcaccactgcactccagcctgggcgacagagtgagactccatctgaaaaaaaaaaaaaaaaaaaagactcaggggctgttactcagggagcacttgttagaacaatgaccaggggcaaactccggctggatgactggaaagctgccccaaggattggggcagagtgtggaaccggaatctctggaaacaagtcttttttttatttgttttaatcaaacaaaagagatttctaagttttttgcgttccttaaaagtgaaggctttgtcaaacatttttgtctactctgggaaatgtacaatgattagaaaagtgcatgtcataatagtttccttttttttctttgagacagagtctcgctctgttgcccaggctggagtgcagtggcacaacctcagttcactgcagcctccgcctcccgggttcaagtgattctcttccctcagcctcctgagtagctgggattacaggcacccgccaccacgcctggctaatttttgtatttttagtagagacggggtttcaccatcttggccaggctggtcttgaactcctaacctcatgatccgaccgcctcggcctccaaaagtgctgggattacaggcgtgagccaccacccccggccatcatagtagttttccaaacttctagtagtgctccaaaacctcgaaagtactccaaaacatcatagcagtactccaaaacctcgaaaacagacagctcggaatagcttaagaagtataacctgaagattttaaaatttcagaaattagccttttataaattgtgcagaatatttatttttataaaaaaaaagattatgttttccggacacataggtatttagattacttctaccctgcaagactctcgtgaaaataaaagacttcaaatagaaaaggagaaaaaagtcaaagggaagaaaggaaaagccggtttacagcatgtgaattgcttctggacgctctggttcttgaatgggcctgtgcagcctcgtctgtgtatctgagcattccatgtcttcaataccagatttgaaagaaagaaattggagaaagcacagaaacaagtcttcaacgcggtgggagaggtgctgctgctaggcagctgtggtaagccctgcagaaggcaatcacgaatgtaaagaagtatagtgagttcttatacctgttgctttgatgtccattttgaatataagtttaactctctcacaccagaagcagggctcgtcaccctcgacacagtttacagtttttttattgttgttttcgtttccgtttttgagacggagtcttgctctgttgccaggctggagtgcagcggcacgatctcggctcaatgcaacctccgcctcctgggttcaagcgattctcctgtctcagcctcccaagtggctgggattacaggcgtccgccaccacgcccagctaatttttgtatttttagtagagatggggtttcaccatgttggccaggctggtctcgaactcctgacatctggtgatccacctgcctcagcctcccaaagtgtcagggttacaggtgtgagccgccgcgcccggccacagtttatagttctgtgcctgcagcactcccccagttcctcagtgtggtcgatccagacatctgtcttgtgccaccgcctcctggtgaccacctcgctgtggaacagctggaacagcctgctggaccgacccacccactgtgtggccatgcaggcaggccacagtgatggcctctcagtcagtcggcaaccagagaccttgaggctgcctgtcctaaccccaccaatcagaacccttgtgggaaagctgcttgggtaacaccctggaccccaataaagactttggcccacaggtgtctctctctccctttctccctctccatctttctcactcaccctctctctctctccctgtctccctctctctccccctctccccctctccccctctctccctctctctccctgtctccctctctccctttccctctctcccccaccctccctctttctccctctccctctccccactggtggtttagcatgtgtgttctggactatcccctcttatcagccccaagaggcacagccctctctctctggatctggaaggagtgcgctgctctgattccatgtgtcctgtgccgctgcctcctctgtgtccacctgagccacacgccccagcctcactctcctctgggtccagcctctcctggaaggtggatgacatggatatgacctctccagagagaggcctcaagactaaattagaggaaaacaagacaaaaagagataaagacagtggggaagggaaagaggagcgggttggggaggacagaggcactggtttcctccgtttgtcgggcttcaatgatatttcttgacttttacctggaaaatcgagtgatggaggcataagtagacttcacggcacaaatacaaacaccaagaaagataatgaattaaagttggatgaagatgagagaaaggaagggtgaggaagataaaaaaatagtaatacagtttccggccagggaaggagcaatgcgtgttgtctccagaggcttgccttctgcctccagcagtgtgtgcattcatttttctatcgctgtgtcacaaattacacacgtgggggcttaacacaacacatttattatctcatggttctgtaggtcatagaagcccagcctaggtctcgctgggctgaaatggaggtgtcagcagagttacgttccttcctggaggccccagggggaaaccattgccttcccttttccggcttctagaagctgctgcatctgttgaatcatggcgccatgctccatcttcaaagccagcatagtggcatctctctggcccctcttccaaagtcacagctgtctccctcgggttacagctgggaaggggtctccacttttcaggactcatatgattagattcactcagatgatccaggacaatctccctggatcacatcttcaaagtctcttttgcagtgaaaggtaacacattgacaggttccagactgtgacgtagtctggaacatggatatctttcgggggggccattattctgtcttttgcagtaggttacatatcctgatcaacccttctgataagacaacaaaaacactgggaacatatttgtaattccatcaatgagctggtgataaagaaaaacacatgccgaagtaaaggcaggaatccagacgggggggctggcttcctccttatgggtgtttgcccaactgggtgagcttaagggccaatctttatcacctggctgggcgtgcgagcgagacaaaacccagggcccacccaaggcaagcccctctttaaagccgggaccccaacaggcctcacccccaacatcaggaagagtagaaatacccacctccatacacacactgctgccaccaccaccaccaagggattgcaaaggaaattctctttcttgtaccttgatgtagcacaggaaattctctttcttgtaccttgatgtagcaggatgagccgcagacaaaactcctcagacaccgaattaaagaaggaagaggtttattcagccgggagcatcagcagacttgcgtcttaagagccgagctccctgaaaaagaaattcttggcctttttaaaggcttatagctagctctaaggggtccacgtgaaaaggtcgtgataaatcgaacaagcatgggaaacgtgactggggcctgcatgcatcagcgaacagaacaaagttttgcaatgctttttcatacaatgtctggaatttacagataacacaagtagtttaggttaggggttgatattattattattacttttttttaactcctagggccgggtggtggtgccaaggttgtctggctatttatcttacttctgtttatttctaattttttgctttctctctttcctcctgtcttgtgaactaggcaaagttgggggaggagggcagcagaagtagtagtggtctccttccttattgacagtgggtggaaagagaactaacctgagagcacgtgttacagattgcattgtgccccaccccccatcttgaaactcttagctctcaatacctgtaaatgtgatcgtatttggaaatagggtctttacagatgtaatcaatttaagatgaggtcattagggcagaccctaatccagtcttaccggggtccttgtagaaagggggaacttggacacagagagagacctgcacacagagagaacactgtgtgaagatggagacagagattgggatgacatatctacaagctaaggaacatcaaagattgccagcaaccaccaggcactaagggagaggcatggaacagattctcccctagagcctccagaaggaaccaaccctgccgacactcatatcttggactttgggcctccagaactatgagacaacaaattgttgttccagccatggagtgtgtggtactttgtactgcaccagtaatacgatgtgcaactctgatttgacacctaagaaggttccagcctgaaattacacttcctttggttcgaaaaacctggagctaagagtttaaagtagaatacggggatttttggctctcctgggtgcctggaaaaaggaaatgcaaatccactttcagcctcaaataatccccagaggtaatgttctaagaaatacacattaactgtcaaaaagcatagatcatccaaggaaacaagatgcaccgcacagtggcagcaaaaaccacggggtgcagaatcagatccacagaagtagaatacaaaatagttgtgtgtgatgcagaatagaaaggattggaaatacgtgtaaagagcaagaaactctgaaaataaccaagtcggttgggaaaagatcaagcagaacttctagtgctgcaaaatctcggttggaactggcaggaaattggatttggaatggatgccacatcgcatggtgtggcccaaggaagaggtgcagttggggggacatttactaggcgtgcaggaaggccaatgccactgttagacacacagtgggtttgcattccagagaaagacactgtcgcctccaccccatgactaccttcttatagcgcaaacatgagaaaatggcttgtcaggtggaggaaacaggaaacgacttgggttccagtggcttctgggagctttcagagaatgcctgctgcccagccccctaggaccttggagtgcaggggaacttgtagctccctttgctaacagaaggaagttcttggtcctgggggaagctggattttggagcagcctctctgagagaaggaaaatggcccttggtgtctcgctgtttatcacagtgagctctcagggtcaagcagcccttttgtaccacagatatttacatcataatgtatgggtttaaccttggattggacaagaaagaatcggtgaactggaaaatagttctaatgacatccttgacgatgcagagatgaaactaatgaagacggagatggaaggagaagttccaatgtacatataatttagacaaattccagaagaagaaagtaaaatggatgaggaagtagaatggataagaagcaatatttgaagagacactgggtttgtgtctgcaagtaaacttgagaggtaatctaggtcttcaacataaggactgcaactcttaggtgagtcccagtgctgaactaggcccagagacagtggactcgtggggcagggggcaggggagcatgcaacatactgagacaccagctggggcagccaagagggttctggcgtcagccctcccttaatcctaggctgcacagcttgtgggtctaaaagagacccctttcttccgcttgaggagaggacaaggaagagtggggaggactttgttttgcatcttggataccagctcagccacaacaggatagggcactggtcagagtcgtgaggtccctgttccaggccaagctcccagatgacatttctggacacaccctgggtcagaagggaacctgctactttgaagggaaggacccagtcctggaagcattctcaatcgcctgttaactgaagagcccttgggccctcaataaccagcagtgatacccaggtactataagttgagggccttgggtgagcctctgagacttgctggcttcaagtaccagcacggccacagtggggtagagcgccagatgggcccttgaggtcctcgattccaggacttgactcttggacagcgtttctggatgtgtcctgggccagaggagagcccattgccctgaacagtgagtcccaggccaggcagcattcaccacgacctgacttaagagaccttgggtcttaagggaacattggctggtagtctggcagtactcctcacggcctggggtggtggtggatggggtgaggctcctctgcctttggaaaggagagggaagagtgggaaggactgctgcttgtggtttgagtgccagctcagccacaatacagtagaacaccaggtagacttctaaactttttgacgctagtccctgactcccagatggcacctctggacccacctgaggcctaggggaccttgctgccctgaagggaaagacacaggcctagctggctttgccaccttccgattgtagagccccagggccttgagtgaacataggcaatagccatggagtttagagcagcaggccttgggcaagacccagtgctgtactggcttcaggtctgacccagtgcagtcatagtggtggtggtcacaggggtgcttttgtcactccatccccagctttaggtgactcagaacagagagagagagactctgtttgtttgggagaaagaaagggaagagaacaagagtctctgcctgataatccagagaattctcctggatcttttccaagaccatcaaggcagtacctctacgagtctgcaagaaccacagaattactaagcttggggtgccccctaaagcagatacagcttagatcacgacatccaagtattttcaaaatctggaaagccttcccaagaaggatggctacaaataagcccagacagagaagactataataaatacctaactcttcaatgcccagacgccaaaaaacatctactagcatcaaccgcatccaggaaaacatgacctcaccaaatgaactaagtataaggcaccaggaaccaattctggaaaaacagagatatgtgacctttcagacagagaattcaaaatagctgtgttgaggagacttaaagaaattcaagataaacacagagaaggagttcagaattatatcagataaatttaacaaagatactgaaataatttaaaagaatcaagcagaaattctgaagctgaaaaatgcaattggtatactgaagattgcaccaggatcctttaccatcagaattgatcaagcggaagaaagcattagtgagctcgaatacaggctatttgaaaatacacagtcagaggagacaaaaaagaataaaagcaatgaagcacccctacaggatctagaaaatagcttcaaagggggcaaatctaagagttattagccttgaagaggaggtagagaaacatataggggtagaaagttattcaaagggataatagagaacttcccaaacctaaagaaagagattgatatccaagtacaagaaggttatagaacaccaagcagatttaacccaaagaaaactacctcaaggcatttaataatcaaaatcccaaaggtcaaggacaaagaaaagatcctaaaagccacaagagaaaggaaacaaataacatacaatggagctccaatacgtctggcagcagacttttcagtagaaaccttacaggccaggagacagaggcatgacatacttaaagtggtgaaggaaaaaaaaacacaaaaaccttttaccctagtatatccagtgaaaatatccttcaaacatgaaggagaaatagactttcccagacaaacaaaagcttagggatttcaccaacaccagacctgtcctacaagaaatgctaaagggagtaatttgatcagaaggaaaagaacattaatgagcaataaatgatcacctgaaggtataaaactcactggtaatagtaaatacacagaagaacacagaatgttataacactgtaactgtggtgtgtaaactactcttatcctaagtagaaagatgaaacaatgaaccaatcagaaagaataactacaataactttccaggacatattcagtataataaaatataaatagaaacaacaaaaagttaaaaaacagggatgaagtgaaggcatagagtctttattagttttctttttgcttattcgtttatgcagatagtgttaagttgttatcaggttaaaatcatgggttataagatagtatttgcaagtcttatggtaacctcaaaccaaaaaacatacaatgggtacacaaaatataaaaagcaagaaactaaatcatatcaccagagaaaatcaccttcactagaggaagacagggaggaaagatagaagaaggagaagaccacaaaacaatcagaaaacaaaatggcaggaataagcccttacttatcaataataacactgaatgtaaatggactaaacgctccaattgaaagacatagactggctgaatggatgaacaaacaggaccattgacctgttgcctacaagaaacatacttcacctataaaaatacacagagatttaaaataaatggatggaaaaagatattccatggaaaccaaagagcaggagttgctatacttatatcagacaaaatagatttcaagacaaaaactatagtatgagacaaggtcactatataatgatgagggggtcaattcagtaagagcatactttcaaagtaattctatgaggccagtattaccttgatactgaaaccagacaaagacacatcataaaaagaaaactacaggccaatatctctgatgaatattgatataacagtcctcagtaaaatactaacgaaccaaattcaacaatacattagaaagatcattcatcacgaccaagtgggatacatcatatgcaaatggttcaacatatgcaaatcaattaacgtgatacatatcaacagaatgaagaatataaaccatatgaccatttcaattgctactgctgaaaaagcatttaatacaattcgatgtcccttcataattttaaaaaaaaattaaaaactagggatagaagggctgggcgcagtggcttacgcctgtaatcccagcactttgggaggccgaggtgggtggatcacgaggtcaggagatcaagaccatcccggctaacatggtgaaaccctgtctctactaaaaatacaaaaaattagccaggtgtggtggtgggcacctgtagtcccagctactcaggaggctgaggcaggagaatggcatgaacctgggaggcggagtttgcagtgagcggagatcgtgccactgcactccagcctgggcaacagagcgagactccatctcaaagaaaaaaaaacaacaaaaaaccaaaaaacaaacaaaaaaataactggggatagaaggaacatacctcaacataataaaagccatatacaaaagacccacagctaggattatactgaatggggaaaaactgaaaccctttcctctaaaatctggaacatgacaaggatgccactgtcatcactgttgttcaacatagtactagaagtcatagctagaacaatcagacaagagaaagatataaagggcaaccacaatggaaaggtagaagtcaaattaacttaattgtacactttaaaataacttagtgtaattggatttttggtaactcaaaggataaatacttgaggggatttataccccattctccatgatgtgcctatttcatattgcataactgtatcaaagcatctcatgtaccccataaatgtatacacttactgtgtacccacaaaaattaaaaataaaaatcttcaaaaaagagaaattctcaaaagccaaagacagagataaatttgaaagcagtgagagaaatgcaattcatcacatacaaggaaacccctaggagattatcagtgaatttctcagaagaaatctcataggccaggagagagtgggatcatatattcacagggctagaaggataaaactgtcaaccttgggaaagatgtccagaaatgaaggagagataaaggctttcccaaacaaacaaaagctgtgggagttcattatcactgccttacaagaaatgctaaagggagtttctcaagttgaaatgaaaggacagtaacaacatgaagacacaaaagtataaaaactctgtaaagataaaaatatagtcaaattgggagtactctgccactgtgtcttagtccattttgcactgctgtaacaggatgacacggaccgggtaatttataaagaacaaaaatgtatttctcacagttttggaagctggggagtccaagatcaaggcatcagcatctggtgtctggtgagggtcttcttgctacattctcacacggcagaggcagagggtagaagagcaaaaggggacaaacttcttccatcaatcccttttataatggcagagccatcatgaagtaaacaccccaaaggacacacttcccaatactgttgcactggggactaaattttaatatgaattttgtagaagacaaaaacatccaaagcatagcatattgtaatggtgatacataaattattttaactctagtataaaatttaaagaataattatagcaataatttgttaatggatacacaatatataaaagatgtaaagtatgaccccaataacataaaatgtgggagaggagaaattaaagtgtagagtttttgtatgtggctaaagtttagttgttatcagcttaaactgttataactataaaatgttgtatataaacctcctggtaaccacaaagaaaaataactgtagtagacccacaaaagataaaagggagtcaaagcataccactacaaaaaaaaaaaaatctcataaagacagtgagagaggaagataggaacaatgagactacaaaacaatcagaaaacaattaacaaaatggcagtaataagtccttacctattaataattactttaaatttaaattgattaaattatctactcagaagccactaagcagctgaatggattaaaaaacaaaacaaaacaaaatccaactatatgctgcttacaggagacttggtttagctttaaggacacagataagctgaaaaatgttattctatccaaatgagaagcaaaagagaacataagtggctacacttatatcagacaaaatagactttaaatcaaaactatcccaagagacaaagacagttgttatataatgataaatggatcaattcatcaagaggatataacaattcaaaaaatacatgcactaggctgggcacggtggctcacgcctgtaatcccagcactttgggaggtcaaggcgggcagatcacaaggtcaggagttcgagaccagactgaccaatatggtgaaaccctgtctctactaaaagaatacaaaaattagccaggtgtggtggtgcgtgcctgtagtcccagctactcaggaggctgagacagaagaatcgcttgaacctgggaggcggaggttgcagtgagccgagatcatgccacggcactccagcctgggcaacagagcaagactctgtctctctgtctctctgtctctctctctctctctctctctctctctatatatatatatacacccaacatgggagcacctaactctgtaaagcaaatattaacataactgaagggaaaatagattacaataatagtagaggacttcagcactttaaacagtggacagattatccagctggaaaatcaataagaaaacaggagacttgagcaacactacagaccaaatggccctaacagatagattcagaacattccatccaatggcagcagaacacacattcttgtcgagtgcacatggaacattctccaggaaagatcatatgttagctcacaaaacaagtcttaacacatttaagaagattgaaatcatatcaagtatcgtttccaaccacaatggtataaaactagaaatcaataacaggaggaaaagtggaaattttacacatgtgtggaaatttttttttttttttttttttattgatcattcttgggtgtttctcgcacagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaaccttttccccacctttcccccgcttctattccacaaaaccgccattgtcatcatggcccgttctcaatgagctgctgggcacacctcccagacggggtggtggccgggcagaggggctcctcacttccctgtaggggcggccgggcagaggcgcccctcacctcccggacggggcggctggtcgggcggggggctgaccccccacctccctcccggacagggcggctggccgggcagggggctgaaccccccacctccctcccggaaggggcggctgccgggcggagacgctcctcacttcccagacggggtggctgccgggtggagggtctcctcacttctcagacggggcggccgggcagagacgctcctcacctcccagacggggttgcagccgggcagaggcgctcctcacatcccagacggggcggcggggcagaggtgctccccacatctcagacgatgggcggccgggcagagacgctcctcacttcctagatgggatggcggccggacatgtgtggaaatttaacaacacagtcctgaacaaccaatgagtggaataagaaatcaaaagggaaataaaataatatcttgaggcaaatgaaaatggaaatgcaacataccaaacctcataggatgcagcaaaagtgattctaggtgggaggtttatagcaataaatgcctacgttaagaatgatctcaaataaacaacctaacttcacacctcaaggaactataaaatgaggaacaaattaaggccaaagttagcagaaggaaagaaagaaagatcagagcagaaataaatgaaatacagacttaagaaacaatagacaggatcaacaaaactaagagttgagtttttttgaaaaggttaacaaaacccacaaaccttaggctagactaaaataaaaaaagactcagataaataagaaaattataaatgaaagaggaaagattacaattgataccaaagaaataatagacaactatgccaacaaattggataacctagaaatgaataaattgctagaagcagacagccgaccaagactgaatcccaaaaaaaactagaaaatcggccagggcgtggtggctcacgtctgtaatcctagcactttgggaggccaaggcgggtggatcacctgaggtcaggagaccagcctggccagcatggtgaaaccccgtctctactaaaaatacaaaaattagccgggcatggtagtgcaggctgtaatcccagctactcaggaggctgaggaaggagaatcaattgaactcgggaggtggaggttgcagtgagctgagatcgtgccactgcactccagcctgcgtgacgggagcaagactccacttcaaaaaaacaaacacacaagaacaaaacaaacaaacaaaaaactagaaaatctgaacagaccaataatgagtaaggagattgaatcagtgatcaaacacctcctaacaaaaaatagcccaggatatctgatgccttcgctggtgaattctgccaaacatttaagaaagaattaatgctgattcttctcaaactcttccaaaaaattcaagaggaaggaacacttccaaactcattttatgaggccagaattaccctgataccaaagccagacaaggacattacaagaaaagaaaattatgggccaatatccttgatgaacagagatgcaaaaatcctcaccaaaatattagcaaaccaaattcaacagcacgttacaaagatcatgcatcctgatcaagtggattttatccttggcggaggtgacttctttgaggtgacagcccctctgctggtgtggtctggaagagaagataggagccaggctgagcctaggctgtcagtcccaaccagtgtaagatcaccccctatctgcctgctagtccccttctgagactgggtccagctccgccaggttgtaatactcacgtgtggccaccaggggcggtgtttcctgccaaggctactcttccagggcagacagcctggaggtgaccagtgactttcatccgtggtgggctgctgccctcacctgagtatctggaagggcattcagattctggggcccaaagagagcactgcacagtcctcccaccctccgttctgtgcaagacgcacagttccctggctgcccagccagcaccagcatctcctttgaaggttactcttgctcctgcagctggatggagagtcctggtcagtgctgggagtcctggtcagtgctggaagggcaaagctcccagatgccagcgggaaatgcaaaagggcaaaatgcagggtaagaactgtggccagctggagtaggagtgacccacctaagtgtgtccagtgggttttgggccccatgtggccagcttttcaagattgaagcttggaaatctggatttttacagggagtttccagggcaacacatacaaagacacaaagcacagcatgggtcatgccagggatcccctgcccttgggcaggcacatgagagccctggaaggtttggctgactagctgaggggtctaggcggtgcttgtgggtctcagaccctggtgagcccaggcttccagcttctgccctccctcttgcttctccatccttctctccaaatccccagtgcagactggggccctacgccagggctgaggtcagctccccactgtgggcaggaagtccttctgaagccccatgtcctgtgtccccatcagacggtggcagtgcctgcggccatggacacagtgccccgagatgatttcttttcttttttcttctttttgagacagagtctagctctagtctcaggctagagtgcagtggcgcaatttcggctcactgcaacctccgcctcccgggttcgcaccattctcctgcctcagcctcccaagtagctgggactacaggcgcgcaccaccacgcctggctaatatttttttaaaattttagtagagacggggtttcaccgtgttagccaggatggtcttaatctcctgacctcatgatctacctgcctcggcctcccatagtgctgggattataggcgtgagccaccgtgcccggccccgagatgattttgaagcactcctggcacctgcctggcataggctcagccgccgggatccaccatgtttccatggattccaccgcggattccatccaccatgtttctttcactcacaaacagtgttaggccatggagtggagagggtgctccggggaatgaggatctgcattccggccctcaggagcccgagcccacaacggccccaggccacaactgccaggtgggggtcacttcagcagctcattcctgggaatgcctgtgcccagatggcttcaggcctggagcaatttccacctgcctctgtgcatcggtgtcaggcagatgggggcagccacctgcttctcaggaaggaccacccttaccctgggagggcatctcttctactttgacagaggatagaaaacattctgtcttcatgaaatcacggggatattcagtggtagttttctttttcaggttcttattgaaaaaataaaatcttggcagtgtaaattcagcccttgaaaattgttctggaaatttccctggcccatgaatcacctgggtctggcacctgttggctgtgttctccctcagttttcccatctccacgatgggtagcagttgttgctgtctcatttgagatgacacgtgtgaagcctttagcacgctgcctgactcccaggaggccctcagaggtgactggggcactgccttcctcctggtcagtggtgatgttggctcttatagtttgggttgggatgctgttgctcatgtcctctttcacagggctgcacgcagagctcggtggaggagcctcctcccccaacgcctccgcttcttcctccctggacttctgccccgtcagagggcagcctgcaggcacctctctctgtcctggaagcctggccagcaagtcggggccaagggctggtgggggcctgcagagagggccagcctgagccagaggaagagtcttggggttggctcaggtatgtccaggccatgagggcagaggaacaagtctaccacagtccccactggagcggtggcggggaggctggggagggcagtgaacctggaggcagcccctcactcctgaatgtagagtcaactgtgactttgatttgcaccacagttttcttcagagtgcactaaacatagagtcatactcattttacgagaccagcattaccctgataccaaagccagataacattacaagaaagaaaattatagaccgatatccttgatgaacatagatgcaacaatcctctcaaaatattagcaaaccagctgggcgcggtggctcacacctgtaatcctaacgctttgggaggacgaggtggggggatcacttaaggtcaggagttcgaaaccagcttggccattcatggtcaaaccccgtctctactaaaaatacaaaaaattagctgggcacggtggtgcgtgcctgtaatcccagctacttgggaggctgagggaggagaatcgcttgaaccgggaaggcggaggttgcagtgagccgagatcgtgccaccgcactccagcatgggcgacagagcaagactccgtctaaaaaaaaaaaaaattagcaaaccaaattcaacagcacattaaaaagatcatgcaccgtgatcaagtagattttatccctggtggggtgacttctttgaggtggcagcccctctgttggtgtgatctagagcaggactgaaggaaatttactcagggaaatttacaaggcttctgtgaaactgacatggcagggcttccagcctcctgttccaagatgggaaaactaagtctcagcaaagggagaggtgataagaccagcccgagatcgtacaggaccctgtcttggcctccttgtccggagcctggcctctccagagctgtgactactagtccctggggggagacagcctttccacctctcccagaccggagctgggtgctaacaggccctgccggatgaaaatcctacgatactaacagacagctaacaggccgggaccggcccccagccaccaccccttgtccaaagtgcaggttcattgtgctgccctcttggcttgtaacagttttgcaacagttgcaacttgtctttgagtgcagggacaggagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccaggtaagcctcaaactggcggggccagctttccactgggcagccaggggcctaagccagtgggccctttgcctttgaggcagggactgagaatggtgtcagcacgtggtcaggcccagagcccaggccccctcctctaagaggtcctcctggattccctgctggaaggaagccagccttgtggtgtcgtgtctctccctggatctgtctgcttcgtggaccctgagcccctcgagggcaggggctgggtcttagatgtcactataggtttcccagcagtgctttgtacacattgggcattcagtaaatgtagaggatagacaagctggcaacaagacagtcggacatcctcggtgtgaataagaacacaatgatttgattggtattaattacagcagtttactatacgatcgcttccggtattggcagctggcatcattacaatattaacagactgccattgaaatgccccgtctttgatccagcgcgaggaggagatgtgactttccatcagcacctgttctgattctttgggcatccagaggtgtattctttctgggtttcctccacacccctcctctgggtgtctacttctgtctgggaaggggtaacttgccccagcccagagtcaggctgcagcatccggtctgcctcctccaccagcttgctgtgtggccccctccctgggcactgctgtccccaacagtcaatggaggctggaatccctgccctgggggctacgtgctgtgcagtagccagtggcttgggggcatctccccaaacaccagaggggtctgggagctcgggaaagcaggacgcagacagaccaggagaccctgtccctgggaagctgacccaggccttctcactcgcctctgaaggcagtgagcatcctgtccctgggggtgagcaaactggggcatgtgctgagatgacctcaccaaaggagcctccctgcagtggacgggcccctggcccaagctgctgctgaccccacctttcctgcccaccctgcctgtgcatagctccttctgggcgcggggagctcgggcggctccagcaggcaggtggtgcctgggtctactgcagcaaccctgaggcgcctgtttcagagacgaggaaatgagggttggagcggaagggtgactgccaggtcgcctacgggtaatggggcatggggttcacaaccctgctctgccgccctcagagggagctgcccacagggctggcctagaagccccaactaagctggcctagaagccgcagtggtgggcggtacgctccgcccagatcctgggcggagacatggggctggcagcgagggtggggggcgggggaggcctggagttccggccaggccactgcttgggaagcaagaaggtgaaggcacctctgctgggccaagcactcttagggccgaggggcactgcagctgacaagaggtacttggaggtacacccccagggagggacgaggctggggcctcccctatgtgggcggggctgggcctggtcagatctggctgggatctccctctgcctctggctgcagggaccatccagctgcatgagcaggaccagggttcaccatatgggcagctgcctccccgccccctgccgctcctccccacaagtctgcctaccctcaccaggcgaaggtgccaggcgctctcctcgcttgacccccaccaccccctgagcctgggaggaggagggcgttcctgggtcctctgctttgcagtgaggttaagttgttgctcgaggccccagtcctgtgacaaaacccccacccatctgtctgatcccaagcccagggctgtcctcagccctcactcctgggaagctgactcaggtacgagacagagttggagggggcaagagagtgggttaatgtggaggcagctgtttccagggaggtggcaggcaggaggggctctgggctgtccccgctggggccgctgccagcccccagtctgacagtcagaagagccctgactgaccaggcaggtggtgaaggggcacgtggcagcctccggcgccagcagctgtcgctttttgggcacagtcggaaggaggagggaggcttttgcccacagctgaccaggtgtgctgtgccatgcggcaccgtggtgggtggtgggtggtggggtgggggtgttcagccttggagggccttcctcggtgccactcaagctggctttcccctggtggggcaccacttttgggggctcctggaagactgtggaccttcaaggactgaaggtatgtacagacacatgcaggaggcatgcctccttgtccggggccacctctgcaggcaggagccaggcgggctgacacactgagggctgagaggctgaggacaagctccaacacctcctcactcccctacgccgctgcaatcagactccctgctccctcccttgggatggggcactggggcaggagatggggggcagccctgaccagcctgagagctgggatccccctcacatcccccactgtgcctaggacagggttctgggcttcgtcagggcttgggcagtgcccacagttcaggtgggacagagtgtggcagtgggtcctgagtccccctgggatggtcagaagagggggcaggagagagtccctggcactgccacatggaggccctatgaccctggtcacctcagggagcctctccgtgtgtcagactcccccgctgtgaagtagagacattatcatgtgtctataggtgttcaatgagagtgaacgaacgtgcatagctatggtccactcttgaaaaaggatgctgactttcttagataattatatcagtcattcatactgacgtaggtggcacagcacttcacatcttggatcacagccacatccctttcacttttcctgcagatcccagaaaagggcagtggaggtccacactgggcaggacaccaccccacccttccattgagggctgttgtgagacctccgttcttaacttcttagtttaaagaatttaggctgggcacagtggctcatgcctgtaatcccagcactttgggaggccgaggcaggcggatcacctgaggtcaggagttcgagaccagcctggccaacatggtgaaaccctgtctctactaaagatacaaaaattagccaggcatggtggcatgcacctataatcccagctactcgagaggctgaggtgggagaatcgcttgaacccaggaggcagaggttgcagtgagccaagatcatgccactgcactccagcctggaagacagagtgggactctttctcaaaacaaacaaacaaacaaacaacaacaacaacaacaaaacagaatttaaacatgagacacacagcaaaagagctgcaacatagagcaatttattgcaaaagaaaaagaacattttgaaagttaggtgcggatgcaccctgggagagagaggattccaggcggggggctgctcctgagtgtgaggcagcattgatgattgttggagaaaccccctttcagggagtcttccacaattattcataagtgggtggaaagagaggaagaggttactaggcagcatgtgatggctggtcctctgggtgcacatgcggtagctgtacatgtttgttcatacgtcacatgtctctttcgcatctttttttttttttttttgagacggagtttcactcttgttgcccaggctggagtgcaatggcacaatctcggcttactgcagcctccacctcccgggtttaagcaagtctcctgtctcagcctccagagtagctgggattacaggcatgcaccaccacccccggctaatgtatttttagtagagatggggtttctccatgttggtcaggctggtctcaaactcctgacctcaggtgatccgcctgcctcggcctccccaagtgctgggattacaggcatgagccacagagcccggcctcattagcatcttaaaatctccaccgaggggtgtgtttttttactattagaatgagcaaagggtcagtttgaggacaggtaaaatcaatgtgcacatgccctctccaggggaaaggccctactgcagacagctttgcttgaacgagctcagttaacacgagctcagttacagtgcaaacgtggaggctgattgtgtggattgcagtcaccacggttgctgcgtccccaggacatggtgactcctttgactgcctgtcctgcctcgcctgcacccaaggagacatccgtcttcatcagcgccttctctcctgagaaggagggctccctcttgcattctcattgttattggatttttctggctgggcagatctgggagggtttcctgaaggaggagggagtcggggtgggtcagctgggaaggagcagaggggaggaaggcctgttaacccggcttctgagcccctactctgcaatcccaggtggccccaagggagcagagccgggacaccacatccttcatcagcttccgccttagtcccaccgagctttggggctgatgagggggcaacccctcttgtctgggtttgggaggggcctgcccaggaggaggtgctggctccaggcttgggggttgggtgccccgtctcgaggctgcctgccgataccctgcggccactgctgtagcatccacgatgcctctccctcctcctggctctctgtctgggagcgcaagtgtctccatcactcaacacaaccccctccctgccctgctgtgccactaccaccgccttctctgggcactcctgcctcccaggtcccatccccaccccgcaggacctggggtctgccccagcacagacctgtggggcagcagggctgcttggcccctcaggagcatcttgagctccgaaagggctctcaaggctggcgggacggcccccgcccagccccagcctctcgctgtctgtgatctgggggtgagtgtccctgagaccggagcccctcctttccagctattggtcctctgtcctcagtcccctccccatcctccctgcccggcctcacggggcagcccactttcctcaggtctcactttggatctctgccagccacgccacccactcttctctacctccccttgtggccccgacccccacttctacccagagcttggcgctccctgtcttttctgtgggctggcagagacctatcctcaccaaggttgctcccgggcactgacagagcctgctgcataccaggcccttaatacatacacacagaatgaatgaatgaatgaatgagtgaatgaatgaatgaatgagtgaatgaatgagtgaatgaatgaatgaatgagtgaatgaatgagtgaatgaatgaatgagtgaatgaatgaatgagtgaatgaatgaatgaatgagtgaatgaatgaatgccatggggaagtggcaagaggaaggccctgggaggtaacaccatagggcccttatttccctgggtactcagcacagcccccagcgtgtcccctctgcaccccacccagctctgattctctccccagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggtagggaccgggggccaggtaggggcagggaaggataggacatagcgaggggccacagcccattgctagctgggacagttcttggttcacaacaaccagcctggggaagagaccctggggaagggtgcatggccagtttgcaggtgggcggagctgggggcactgcttgccctcccagtcgctgaagagctgtggtgggaggagggagcagatgctgcttgtgtggcctggagagtgaagctggggccagagctggaaactccaggcagctgtccagagggcagaagcccctttcctggacagagccaccaggactgagggcattccagggagtggagaaggacggacggggaccattgagggtgaagcagacctgtgtcctccatgagcaccagaggcttctacagttctcattctcctaactaaccagggggcatatattaagcacctatggtgtgcatgtcccaggacagccaaccttctgccttcaccatttcagccatgggtgtcctggcaaactggatctcctgacctgcagtgttggccagttcctgtggtgtgaacactcccaccctggccaatagcaaaagccaccagtgtgaggtcactgactgtggagttgggaagaggtttatccctgggctcctgagagctgatgcgagccggctcccacaagccactgctccaactcttgctcttgccttctcactggccccctagctgggctgtcatagcctcttccctgacgtttcgccagccacacccctggcctgccacctctcacattcagctgctggagggcatcctttgttggggagagtgcagatttaagcttcattcagtagtgggttggtgtctcggcgccccctccactcacctgctctgtgatcttggccacagaactgttggtgccacttgaacttgatctataagagaatcacgccctcctcatagggcatgacaggcttagcacggggcttggcacacagtaggtgctccaaaaatgggggcctttgctatgtcactctctgagctgcccaagggcgggacctccctcacattcatcttggtccagttattttctgctcaacaacctctccaggccccccaggtcctgcagagaaagaccttgcagagaaagacacccatggttgaatatcagggtatcccctgatattcgtctgggggaaggaggtgcagtccactccctggggagtgatggcacccaccctcccgggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcggtgtgtgctcccctgcggggggcaaggaggggggcttgggtgggtgggtgcactccctggggggtcatattggtgggtgcaccccctgtgggggggtagggtgggctccctgtgagggtggaggtacgctgggggttcatgtccgtgtgcgcatcccctgcggggggctggggtggggggctcgtgtggatgagtctgcttcctgtggggtcgggagtggggctcatgtcggtgggcacccttctgccgcgagagaaggggacacgccacagggaaggagccccggcaggtgacagatctgggttccagcccttgcgctgccccttgctggctgtgccacctggagaaagcgactttgccaggcttcattcagaattcccagacagagaatctgattggcccagcttctccctgtcccagtggtccacgcctgaggacactgattggctgttcttgggccaatcaaatgtgggggcgtggtctatctgacagtctgaaacaggatcttggcctctcttgacagctggtctgactgggaaacctctcaggcccaaagtattagacctgtggggttatttatcttatataatagacactttgtgccaggcactggtctaagttctttgtcaatgacatacactattctcacccccacttcacctgagtgagcctgaagcgactttgccccaggttggtcacacagctggcgagggtcggattggcacaggcggcctggccccggagcctgcctcagtgccctgctccttaactcttatgctgaagcggattcaagggacaggctccgggggcgtggggaccggctaaggcttctgggagaaagtgaggctggggtttgcggtggatgcccagttggggaggggagtggcccaggggtctgctccccacggactcagttaacctcccctgggtccccctagctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtactgatggccgcctggctctgggtcccctgttcccagcccactcctcctgccttagaaccctgagagcagaagggaagagaacaagagccattctctgactgctgtgtgactttgggccagtgaggacctctctgagccttctggtccactcctgccaaggggaggctatgccttcgttctgttcacagacatcaggtcgtgccgtgggtgcacccattcctctgctgcacaagcaaatcgtatcaaaagcccttcttataatttgtatctgtgtttgtctcaactccgcacatcattgtagaacaatttttttgtttgtttgtttgagacagtatctcgctctgtcgcccaggctgtagtgcagtggcatgatcactgctcactgcaagctctgcctcccgggttcatgccattctcctgcctcagcctcctgagtagctgggactacaggcacccgccaccactcccgtctaattttttgtatttttagtagagacagggtttcactgtgttagccaggatggtcttgatctcctgacctcgtgatccaccggcctcggcctcccaaagtcctgggattacaggcgtaaaccaccacccccggcctgtagaacaattttaagaagacaaataagcaaaaaagaagtcaagatcacccagcagtaactagtattgacattttagtatgttttactccaaatatttttctatgaaaatatatatgtatgcaaaatagaaccaagctgttgttattttgtgatttttttttttttaccaagcagtagactgcaaacatctttctgttaatcaaatatcttgctttttttttttaaaaaaaagtcagctactttttcacgttatgaaaagagggttccccccacaagtcaagtgaaagaacttgcccaactttcaagttctccaagtcaaggcatgggtgggtctagttttctggcgctgtggtcatccggtttccctgacagtgtcgcaggggacctgctgctggcagaaatagtgtccccagctcccctctgggaggaggggttggttggagtggggtgggaagcacccccggggagtcccgtgggattttagaagcagttcctctcaattccaggtcattgagaactgcccagtgaccggcattcgtgtgtggacggatgattttggggtgcggcgggtcgcgggtgtggagactcagcatggttccatccagacaccctgcgtggtcaactgtgcaggtgcgagtggcatttctcctgactcctgtgtggccatgctggctgctccctaaacctgctcccacctctgcagggcttctttctggggtggggagcccctgctagggcagacaggtctgcagaggcagcctgtgcacacctgagaggcagctcccaccaggtgtcagcagagctgagctgtctgtgctctgcccgcaggagtgtgggcaagtgctgtgggccggatggctggagtcaaggtcccgctggtggccatgcaccatgcctatgtcgtcaccgagcgcatcgaggggattcaggtaggtggacagccccgggttctgtgtcagtctgtggggggcacagagacctggctctgaatcccagcttgaacccaggtggtgtgacccttgtgggtcccctcactgccccaagcctcagtcacctcatctgtgaaatggggattgtaacatggggtatttccgggtggtatgaggattaaactaggtagcacaggcgtatccctgttggggctgacccccttgttcctcaggacctggcctctctttgatgcccagaacacagtccagcctgtcctgcgtggtgcaggcagcctagctttttgccatgttctgtgcccaggagtttcggggaagacccgaatgtttgcatgctctcagtgtgcctggggtgcctgtctcagagggtgctggttcctggcatgaataacctccctgagagccttctgccaagggaggttgggggcctgggttcacctcctggcacctggggctgggtgcctcctgccctctcttctctcctgtcctcaactcctccctccagggatggtggctgggagcttcctgccactttgttactgacccccctctttccatccgttcatcatgcaaccctcccttactcattcctctctctgtccagccctccatctctccatccgtctctccatccatctactcccgtatctatccatgccttctcccatttattccttcatccctccacccatcccccttcccttcatccattcctccctccactctttccctccctctattcatcttgccatctcgccatccattcttccgtcctccatctctccatctatctattcatctatttatccacatgttcatctgtccatcccttctttcatatatccttccatccacccacccacctaaacttctacccatcaatccctccctccctccctctagccactcatctctccctctgcccttccttcagcatccacccacatattaatccaaccattcacattccattgaaccctctctgcatcagacattgatgggtgagcttggtgtttcaggccctattctagaagctgtggccataacacagacagacacctagttcttgctgggtagagctggggggaggtacagacaagtacatgtgcaattccagaacatgctgataagggctctgatggggtctcaggggctataggaattcccagccctagtggaccaggggaggctccctggaggaggcagctgcatctaggtgaggctcttgagggtggcatggtggacaaggagcgtgcacagagcatggccgttcagagagccagggccagaggctgtggggcagggtcagtgtgagaacagactgcccttgtttagggtcagggccagtgagagggaagcctgggcccctgagctgggagcctcgtccctgggggctgcccattgccaccctgtgccagcctggcttccctatggtcaccggggaggtaccaggcttggctgcttcgtagaccagggtagtgaagcgggtggcgaaatggggccggaacctgggtcccagtgcgctgctgcctctgactcctgtgcgctgggcaagccacgccccactggacacaagacctcttgttcatagaatgagcctctcactgcaggtggctggtgccatgtgccgggttagggactaagagtagtcacacggtgggtgtcggagctgagtgctgaggcctcctccctggctccgggtccctggggagagcctcctcccctaggtggccgccaggggtcacgctcaggtctcagtgggttctgggagggcgggcagagctgtgtcctggggcgtcagggagggtggccacagaatgtccaccgagcccaggactgtggctccatcctccatccctaattcctcccaaggcctgcctttgaggtgcctttccagggaagaagcaaggcagagttggcctaggtccctgcagctgccccctcctgtgtatgtcaagattcaagcgaagctagggggtgttacttacaaagccagtccagatcccagcgtgcctctggtaccggagcacaggaaaagggccatcagccccagcagctctgagacctggtaggagaaaagtggagatctggggcttcgcacaaagcccctcatgttcctctgacacctggccatgtgcaggtgtctggaagttgtcccttccagaggctgcagctaggcagttggtgtgaatctgaggaaggagccaggccgctggccctgacctgcccacctgctgtggtctgacccttggatgggccacagaacaagccagggggccctctcctgggcgcatggcacctgtgcagcccatttctgtctgctcaggaagctccctgggcgtggcagcctcgtgcagcaggacgctgtctaccctgatcagacacagccacacacattggggcctgggggctccagctggcaggtgagggctcaggtctcacgtgtggttcatctttcttcttgggtggctggagggctgtgtggccccaaggacctcccttttctgaggatctgtcccaggcctgggtcctagagagctctgcccacagcttcctttgtggctagggctcatctcttccctctctgagctatcattaaagcaggtggctcgggcgctgttagggggtttcacagtcgtgctctggcgtacttttgcagtggcaaggagcggctgctccatccgtgggcagagctgtgggtaagagcctgggtgctgggtttaaacactgactcctccattacccaggctggccaagtctgtcaccgctctggttccctttcctgcaaaatgggtcataaccatccctactgcctcaggctgtgctgcaggaaggacagagtgatgcagctgggagtggtgcccggcatacagcaggtgctcatgaggtggtagctgtgtgatgacaaggacaaggacagagggttgtgaagtcgtcaccagctggcgcttcggaggaagagaacacggagggcaggagcaatcaggcagggatcagatggaagaaagaggcagatggaaggcatgggctgaggtcaggaggcagggagtcagtggcaccagggccagactggggacagccagagcaggaggctgctgcctggagagaaaggccagggctccactggacgctgatgctgaactgggcactccgctgggtgctcagaggcagcaggatctgtgcaaggggcaggtaagtccagacatggatcctgctgggacaaacatcaggggcttccctggccaccaggtgtccccactgtcctgctctatggaactctggggctggctttgtttttagagtagtagtgctagcagaggtaaggatataactactactactactactactattattattattattattattattatttgagacagggtctcactctgtttcccaggctggagtgcagtggcatgatcatagctcactgcagccttgacctcctgggctcaagcgatcctcccacctccacctcccgagtagctgggactacaggcatgtgccaccactcctggctaatttttgtatttttatagagatggggttttgctatgctgcccaggctggtctcaaactgctcaagcgatcctcctgcctcagactcctaaagtcctgggattacaggtgtgagccaccttgcccggctgtgattatttttaaacagtgctcagttactaggaacttctatgtgccacctgacaacgatcccctggtgcagatattctcattccaatgaacaggactcctgggatcctggcggagagggaggaagcatctgccagaatgtcccttctggtctctgcacatcccctttcctgctcccagagacaggacaggggtcgtatctccctgtgctcatctccagttctggggcaggtgacagagggattgagagaaggctgttcctcgggtacagaggagtccacacgccatgcctgcttgctttctaaacggtcttgtttggtttggcttgtttattggttaaatcagtggttcctctctgcaatattatgatgatgtaaacactgcttttttgtttgtttgttttgttttgttttttttgagacagagtttcactttgttgcccacactggagtacagtggcacagtgtcagctcactgcaacctccgcctcccgggttcaagcaattctcgtgcctcagcctcccatgtagctgggattaaatgtgcccgtcaccacacccggctgatttttttttgtattttagtagagacggagtttcaccatgttgccaaggctggtctcgaactcctgagctcaggcaatccacccatctcggacttccaaagtgctaggattacaggcgtgagccaccatgcttagctgattatgtaaacattgttaatacctgagcaagtagtgtccaactttttgtgtttcttggagttattaacagtttttgtcccagctgctcagtttcttttgtaactgttatgtgtgtgtgtgtaacattatcttcatgccccaaaacccatacccgttatcaatcactccccatttcccaccctgtccccagacttaggcaatcccaaatctgatttctgcctcgatggagtttcctattctggacgtttagtataaatggaatcacatgatgtctggcttctttttacggttttgtccgtgtagtacatgtatcagtatttcattcttttttgcagctgaataatactccattgtatggatacaatgcactttatccgttcacccactggtggacatttggtgtttctcatttctggttattttgaatagtgctgctgtgaacatccatatgcatgtttttgtggggacctatgttgttatttctcttgagtttaaacaagttgagcaccccaaatccgaaaatccaaaatgctccaaaatccaacactttttgagcactaacatgatgctcaaatgaaatgctcactggagtattctggattttgatttttggtttggggatgctcaacaggtaagtataatgcaaacatccaaaatcaaaaaaaaaattaaaaatgtgaaacactgctggtcccaagcatttcagataaggaatactcagtctatacactggagtggaattactgagtcatatggtaactctatttaacatttcaacgaactgtcggactattttccaaagaagctgcaccattttacattcccaccagtgaggtatacggaggggttccagctcccctccatcctcaccaagtcttgttattttttgtctttttttatgccggtcatcctagaaggtgtgaggtggtgtctcaccgtgggtttgatttgcatctccctgatgacatgatgtggggcatctcttcatgtgcttactgactatttgtgtatcttctttggagaaatggttactcagacactttgcccatttaaaaatagggttgcttatctttttattgagttgtaggagttccttaaatattctggatacaggtcctttgttacatatatgatttatgaacattttcttccattcagtgattgaaacttctattcagtggttgtcttttccctttctttttttcccccagaatccagaagtctttacatagccttttcgcttttttatggtatggtttgtagcacaagttttaaattttaataacgtccaattcatctctttttttcctcttttgtcatttgtgctcttggtgtcatatttaagaagacatttcccaacccaagactataaagatttacttctaatattttcttctgaggcttttatagttttagctcttatacttatgcctgtaatccatctcaagttaaattttgtgcatggtgtgaggtaggggtccaactgcattcttttgcatgtggctatccagttggcccagcaacattttttacaaagtctgcttcccccaaggaattgtcttagcacccttgctgaaaatcaattgactctgaagaagaaggtttatttattttattttatttttttgagacagcgtctcgctcttttgcccaggctggagtgcagtggtgtgatctctgctcactgcaagctctgcctcctgggttcatgccattctcctgcctcagcctcccgagtagctgggactacaggtgcctgctaccacgcctggctaattttttgtattttttagtagagacagggtttcaccacgttagcaaggatggtctcgatctcctgaccttgtgatccacccgccttggcctcccaaagtgctgggattacaggcgtgagccaccatgcctggcagaagaaggtttatttctcgactctcaattctaatccattgatctgtaggtctatccttacttagtacctcactgtcttgattatgtagctttgcagtaagtttggtatcaagaagtgtgaatcctccaactttgtttttccttttcaaaattgttttgggtattcttggtcccttgcatctctgtatgaactttagggtcagctatttaatttcttcaaagaaactagctgagattctgacaggcattgtgttgaagctatggatcaatttggggtgtgttgtcagcttaacaaaaataagtctttcatttcatgaacgtgagatgtccttctatttatttaggtcttctttaatttctttcgaaagtattttctagtttttagagtacaagttttgcaattcttttgtcaaatttgttcctaagcatatttattatttttgatgatattgtaaatgaaattatttcttaacttccttttcagattattcaatgctagagtatagaaatatattagttttttggctgagcccagtggctcatgcctataatcccagcactttgggaagctgaggtgggtggattgcttgaggtcaggagttcaagaccagcctggccaacatggtgaaaccctgtctctactaaaaacacaaaaattagtcaggcatggtcccagctactcggtaggctgaggcaggagaatcacttgaacccaggaggtgcaggttgcagtgagttgagatggcaccactgcactctagcctgggcgatagagcaggactctgtcagaaagaaagagagaaagagagagagagagagagagagagagagagagagagcgctagtagttttttagtggtttccttaggattttgtatatacaagaccttgttatctgcaaataggaatatttttacttcttctttttcaatctgggtgccttttattacttttgctgcctaattgctgccctggctaaaacctccaatgtaatgttgggtagaaggggtaagaatggatatctttctctaattcctgatcttggggggaaatcagccatccttcttccttgaagtatcacattccatgtgggtttttgtagatacccttcagcactttgaggaagttcccttcttccaagtttgttaagtgtttgttgaggctttaaaaaaaaaaatcattaaagatgttggattctgtcaaatgcttctcatgcatctactgggatgattacgtggtttttgtcctgtactttgttgatgtggggtattctattgattggttttcatacattataccaaacttgccttcctaggataaattccagttggccatggtgttttgttttgttttgttttgtgtttttgagacagagtgagactctgttgcccaggctggagtgcagtggtgtgatcttggcttactgcaaccttcgcttcctgggttcaagcaaattctcctgcctccactcctgagtagctgggattacaggcatgtgccacgacacccagctgatttttgtatttttagtagagttggggtttcaccatgttgccaaggctggtctcgaactcctgacctcaaatgaccctcccgccttggcctcccaaagtgctgggattacaggcatgagccaccacgtccagtctggccatggtgtatcatctctcttatatattgctggattcagtttgctattgttttgttgggggtatttgcatgtgtatatataactgtcactatttttccccagttgtgtcaagggatctgtcaaacatattgatactattgatactattttctgaatacgcacacacatcagataaaccacctaacgcccccaagtcccatttccctcccctggaggacttcctgctgccttcagatcttccgctcccttttggactgaccgctgcatggtctaagctgtcactccagggccttcttcacgcctccccgctggagccatggctttcactctttctgggtttattttcttccttttgtcacagcgtgttctctggctgtttactgcaaaggagtacgagagaagtatatgttttgtgtccatgaatgtctgaaaaagcttttattctttgcttacactcgattgatggcttgacaggatctagaattctgtgttgaaaatcatccattagacgtttgaagagtttgctccatgtcttccagcctccagcgatgcagtcccctgttgatggccctcctggccatccggtgttgtgatgtttcccacggcgtggccttggtgcaggcctctgtccagactcagggcttggtgggcactcttgggcccttccatatgaatgcgtgattttcaatcggaggactcttcttgggctgttgcttggacatttttctcgactccatttttctctgtcttctctttctggaaccgctgtaaaatggatgttgaactttcaagacggaccttctgatattcttattttttttccactcctgatttctgttttgttgtctttttcttttagcctaatcgctggatgatggccccagccttatctggcccttccattgaattttaaattttgactatcatatctcatttaaagacctctttcttcatcttagattcctttctcatagcactgtctgtcactctgatacagtttggctgtgtccccacccaaagctcaccttgaatcgtaataatccccatgtgtcaagggtggggccaggtggagataattgaatcatggggtggtttcccccatactgttctcatggtagggaataagtctcaggagatctgatggttttataaagggagttcccctgcacatgctctctctctctttcctgctgccatgtaagacatgcctttgctcctcatttgccttccaccatgattgtgaggcctccccagccatgtggaactgtgagtccattaaacctctttcctgtataaattacccagtcttgggtatgtctttattagcagcgtgagaacacactaatacaccatcttcttgtattcctgatgttcttgttgtggtttgtggttatttatttatgagacagagtttcactcttgttgcccaggctggagtgcaatggtgcaatcttggctcactgcaaccttcgcctcccaggttcaagccattctcctgtctcagactcctgagtagctgggattacagctgcccaccaccacgcccggttaattttttgtatttttagtagagatggggtttcaccatgttggccaggctgattttgaactcctgacctcaggtgattcacccatgtcggcctcccaaagtgctgggattacaggtgtgagccacagtgcctggcctgtggttttgttttatttatttatttatttattttgagacggagtcttgctctgtcacccaggctggagtgcagtggcacgatctcggctcactgcaagcaccacgttctgggttcacgcattctcctgcctcagcctcccgaatagctgggactacaggcgcccgccaccacgcccagctaattttttgtatttttagtagagacgaggtttcaccatattagtcaggatggtcttgatttcctgacctcgtgatctgcctgccttggcctcccaaagcactgggattacaggtgtgagccaccgtgcctggcctgtggttttgtttttaggagagagtgagcagcagtgtgattggaggcttggaggggaggactggagagcctctcaggaagggtgggcggcaagcctttcgcttttagagagaccctggtgtcaacatctcaagccttccctgggcctctcagtgtctcacagaagagtctccaatctgctcctggggtgggggggtggggggatggcagtccactctccccacttctggagcctctcaggacccacctctccagaggaagatccttccatacatgagcaagcgcatcaccccctgaagagggacctggggtggctctgaagattcaagaggaggcaggaggggcacactggcttgccttgctcagtctccctctcctccagccccagctaagtctcacccctcctccatccactctgcgtcctccagggttggttggaatctcccatcctctactgctgcctctgcctgttctctcatctttgtcggttatatgttttgcttccctcccttcctcccttgctctcttcctcgatccattccttcttccttcttccccttttgctgttattttatgggatttggggaaggagaggcttgaatggcagtgacccattcactgtgtgtaacttgaggccccgtgtccactctgtcctcggggtcctacaacgagaaggaccatctcgagcccgtgaccctgggtggaggtgctggcccaccacggggcatggggaaccaagtccccacccagttctggatgatgccaaggcctctctctctgccttccagaacatgcccaatgtccgtgatcatgatgcctctgtctacctccgcctccaaggggatgccttgtctgtgggtggctatgaggccaaccccatcttttgggaggaggtaagatgccagggccctgggataatgggagggagttggggctgcatctcagcatggagagggcctctttcaggaagtccatcctcctgaagctcctcagaggcacacctgagaagtggccggtcccctgaccccaccaagctcaaagccatcttgctcttaccctgacggtcctggcaggcagtcaaatacagacccagggcagctggagggctttgcctcaaaacatccacagagaaggtctgcgcagtgtggagtgatgacctcagaagggcatgagagcacacaagtcctacgtccttcagcaaatgacactgccctcccaaccagctgctgcagcggcatttcccctggcctgggctgtttcccgggcagcttctggggttagggcagccctgcagccctgttctatgtgtatatgcatttagtccacacatggaacgactgagtggctactttgggctaaaaactgctttaatttctggagaaagagggaaactaagataaaagtccctgactctgggtgcctatattttggtggagagacatacaataaacaaacaaatggctgggcacggtggctcacacctgtaatcccagcactttgggaggctgaggtgggcggaccacctgaggtcaggaatttgaggccagcctggccaacatggtgaaatcccaactctactaaaaatacaaaaattagccaggtgtggtggcgggcacctgtaatcccagctacttgggaggctgaggcaggagaatcacttgaacccgggagatggaggtggcagtgagccgagatcgcaccactttactccagcctgggtgacagagtgagactgttacaaacaaacaaacaaacaaatgaacaaggaatgaaattctggaagatgatcgcgcactgaataaaattagcaggttaaggatcagcctagagagactggagcagaaggatatcctttagatgggtggtcagggcagggtttttcagggaggggacatccaagcagagccctgcaccgcgacaacaaaccagcgtgccaggtctgggtgaagaactgccccattgaggggtgaaggccttgagctcacacaagcttgctcttcccaaagagctgcaggaaggtcagggtggcgggcccagtggtagaggtaggcaggctggcacatgccatacagggctttggggccatcgtgagctgcagggggccagaggaggcttgtgagtagggaaggggcatggtgggatctaggggagtgggtggaggcctgggctggggtggggagggggagcagacagaccttgctgatgggttggtgggtgggggagacaaacggctgggacgtgtgggtgaccaccagccctctaatgcatctgattcagcagaggctggcctggcagccatcacaaggcaggtttggcatggggatgcatggccttcttggggacaacggagatgttcccctgccctgccttggcaggtgtcagacaagtttgccttcggcctctttgacctggactgggaggtgttcacccagcacattgaaggcgccatcaacagggtccccgtgctggagaagacaggaatcaagtccacggtctgcggccctggtgagtgacagcctcggagctggggtgggcgtccatgggtcctttggtctgatgactgttagtagtgatgccccgtgagaccagcctgtgtcacacaggggacccagggctgtccccggtccctctcgctgcttggctccagcagccctgggtactaggtgtggcctttattcccctctacgggcgagaggcctgggcttcacaagggccatcatctgccccaagcacgaggccagggcctcctcctgcctcaagggtggctggtcctggcttccccacctgggcttcttcatccctagacttgacttgtccctggaattctgtgttttcatctgtaaaatgggaatagcgggccacatcccagcaccctgtgaggctgagccaggaatggaagggctgagaccttccctgatgagaggcttatacagctgtgagtcccagttctgcctccagccccagcccccaccgctcccagagagcactgccctggccaggaccccatgctgctggcctccctcctgttcttggcggcttgcacctggaggccagctcagcgggggaaggttcttgtgtcaagattcccctaactctggccctccttgctagccccaggagaacttagctggaagaggctggagcaaaaaggtgggctcagctcccagatgccccacgtgggtcatccacagcgcagctcagccccaccccaccctactggcctggggagcctggaaggctctgccccagggggcgggtgtggggctgaggctgctggcctggggagcccggaaggctctgccccagggggcgggtgtggggctgaggctgctggcctgggccctggcaaaggtgcactctctgggaagcaggaggggctgcagctgaccttggcaccccagtgtttataaccacgggactttgagccagacgtccctgagttgagtgtggggcagcccaggagctaccggtgaccccagagcaccagcattccttcatgagggcattcattctacattaagtggcacttcgtcggtggtggaggcaggcacgctcagggccagcgccctccttctggcaggggagacccaatgcaagtcactgatcacagcccgtgggtgggtgctctgacacgaggcatggggtgactgggtggccacagcctgaggacacagacgggcggccaggaggaggggcagcctagcccggccctggagggcgagtcagcgctgggcctgccgcggatacgtgatctgagcaggggagcaccaggtgggcacagacaatcccccacattggggttccagcagaatcacatggtgttccccactgcttcctggtagggggagctctggccccgcttcagggctgggagagaggttcaggaagacacagtgttgcccccagggaaacttcgtgtcagaagcctggtgagtccctctgtgcctttagtgaagggcactggaatgggtgccctctggagtaggtgcatctgtgagatggtgacggagcactgactcggcagggtggcctagggaccagaagccacaggggcggtgcagggcataggccaggcccagcagctgtagagagcatttgagtagaggtgggcggcacaaagcggggagcccagggacttccacgggccatgcagggagcggatgagggccctaaagacagggaagagtcccgacacagaagggctgtggccaccgaggagtccagccccctctgtcctggcacgctcagcatctgctcagccgtcagcaggggctacttgaatgaattcgactcctatgggagcctttggagtgaagtgcagccccggggagaagcagatagagccccaggggccggggcagcgtgcagggtaggagcacacagccgtgactcactgcccccaccccgcagcttgcgtgggtctggcagcgagaaacacaggcccggaagaatcccaggggcacagataaccccaggcgtctctctgtctctctctatctttctcttcctctcgttttaattagcctggggagccggtactccccacgaagccctattttggggaagatgtgcaggcaaggacatcttggatctggtctgtcggctggatgggagactggtggggaatcagcatttctccttgccaggcacggccaatggcctttggcctccaggaaagagcagggaagtcccaggcccccgtgacttagggagcgcctgggagggcaggcagagctctcattccaggatggtggagctcaccaaggtcagggtgggagccgcaggcctggcccctggccatgttgcctggaggtcccatgtgtcctcgggttactcaacccgcatgagtcatttgtgaaacatccaagagacccttgttccctgcagctgcccctccgctagctcttgatagcgctccccgcagattccctgtgaggttgttcagagcttctttcctgccctccctgggcctagaaatagttccagccctcccaaggtgctccctgggccatccccaaacccagcccaggttacctccccaatccccccttttttaaaggtcttgctgtgttgcccaggctgcagagcagtggtgcgattttggctccctgcagcctctacctcctgggctcaagccatcctcccttctccgcctcctgagtagctggaactacaggctcgctccaccacatccggctaattttttgatttttttgtagagatgccgtctcgctatgttgctcaggctggtcctgagctcctgggctccagacatccgcctgccttggcctcccaaagtactgggattacaggcgtgagccactgcacccggcctcagctcactctttctgccccatcgtcaccttctctggagccttccttgtctctcacccagatggctgctccggcctctgccctctgccctgataacccaggccctccacgtagggccctgcccctctagcctgcctcctccaccctcccctgcagtggccctgccaccttctgcccctcaaggagccctgcctctcctggccaggctcttagcccaggctccccgtggctctctgccccctcagctcctagcgtgggggccctgattgctctccagggagcgggacggcacttgctcctgatctgcatgcagaggatgaccccccagacttggagccatccccgtatcatcgttcacgaacgaagtgccctggggtccctcagaccagggccggccgcttcctcatctagagtctaacatggtgtggtgctggggtgccaacagtagcagctggcacctcagtgacgcgtggccctcagttcatcgtattttctttacgagaccgtctgttttttgcttatttaagtatttgctccctccctccgtcagctcctcgagggctgggacatgtcctgctcagcgctgcctcccagggccaagcccaggacatgaacgtctgtaggctggcgagcgcacagctctgtggaggttctgctatcccagttttatagactaggacgctaagccttgctcagagaggcgaagtgactcgcccaatgccacacagctaggaaggggtgaagcaggttttgaatccaggactgtggccacagagagccagggttcccctcccaccgtgtcctggcctctgtctgaggctcagctgtggccgccggagtgggacattggtctcctcccccgcagaagttgggagcctttgttggctcaacagacatttatcaagcacctgcacttgctgggctctgaccctgtgctgggcggggggaagtggagtgagaaaactggtctctgccctctcaaggtccagtgggcaggagtgacaagtctctggcagggacacagcaggacgctggtgcactgggggagccgcagcatggtctccagggtcagagaagggctccttgtcggcaggacaacggccacaagacagcgggaccccaccaggcagaacccagccaggtcgccgtcagctggttctggcagcacacgtggaggggctcagagagcacgggcaggagccagcggggaggcccccatgaggaagtggcgctgagcagggcctagaggagggagggggttgggtggaggggcccctgcagaccctgcctgatcactgctctcttggaagacctcaccccaagagtatgtgcactgcaaaagggactccaggcctctctctccttctttcagaatccttcacgcccgaccacaagcccctgatgggggaggcacctgagctccgagggttcttcctgggctgtggcttcaacagcgcaggtgagtccgggcagcagccctcctggcccccaagagggaggtcctgtcattcccagagctctgggggaggcgggcgcaggagcaccgtggcccccgacagtggtggggacaggagaggctggggagtccagccccttctgcttcccagagagtgcacctgtgccagggtccagtccagcagcagtccaatcaggaggcgtgcagcaccccaggtgtgagagcagagcttggagtgtctgtgctgtccgtggagatgggggcacatgtttggacatgggtgggggaccctggggggcagaccgcagccctgcgcttctcttcctgccaggaatgatgctgggtggtggctgtgggcaggagctggcccactggatcatccatgggcgcccggagaaggacatgcatggctatgacatcaggtaagtgcccattgggacctaagggcagggcccgccactcaggacaggtggcgtggggtaaacagcgagggctactgagaaaggagccttgcctgaaatccaggtggcttcctggaaggggcagcagtgagggaggaaggccaccagcagaaggtgggcagtgctgagggggtggctggggggcaggtccacgcccctttacagctttgaagatctcttgtcccagggtcctgcctgagcccctggacagctctggagtcatcagtgggatggcatcaccccacctcacagatggggagactgaggcctgggggcaggagggagcggggctgagctgggaaaactgtgctgagtgtgtatgccgcggcttgcagccaggcagccccggctgtcccgttcaatcgtacactgacaaagcggccaggaatgagacccagtgcaagccacttcctcgtctctaatgcagggtgatggggaggggctgtggaggttctgggagcagggagggcatttgtactggtgaggcacccagcatggggtctgcacatggaaacgctaagtcatccccagccgaggcatggactggggtgctggtggccagagccggtgacggcagcctatcccgatggccttctgccagtcagggccatctcttgcagagcacaggacagtggtgcaggcgctccccggcaaggggggaggctcctcctgtgtctcgtcctcatggcggtggcctctccgacccacacagcagggcctgtggcccgggccactccccgtgcgttgtggggtggctgtcgaggcaggacggcttggagggagcccggcctccgggtctctccagcccactctgctcccggctgctgctgctggtggacagcctccctggggaggcagtaggtgggtgggctccggagggagaaggcctggctcagctcggtgcgcccctcgcctctgctgacctagtcctttcctggcctgatgaggacattacgcccactgtggagaagaatgtctgaccccacggagacagtgacactgaggccccccagctgccacccctccatggcacccgacacagtgaagcctcctctggctgactcagagcccgtctgggcctgcgcccctgcactctcccaagcgaggaatgtcccggaaatgataaaactgtaaaggacttcaaggaagggccaattcaggcccctcctgctgcaaacagcaaaatggaggtgacttgcctgaagtcacccggcttttgaaccagagccaggtagggacccagctccctccccaggagggacagtcttcatgccctggcctcccttggggattccagctctggaacccaccaaccagggttctgtgtggcctctctgtgcctctgtatcctcggctgcaaaatggagctgcccagcctgcccagctcctgacctggggcctagtcccgcactcagcagacaggatgtttgctcatgggctggcagaggccctgaggcgacccctggcaagttgggggcaggcctgggcctccctcggtcagctgtcttccttccatcactgggactttggcgggagtgtgccatgggctgctctggggctgggagccaagggcacaggtggggagcccctgagagctggagtacagcaggaggaggagcacccaccctggagtacagcagcaggaggagcacccaccctgttggtcccagacccctgccaagcagcctggctggtggcacccagggcacacaggctaatgccgtcctcagcccagccgtcactgacgtggggcttccaaaccccttcagtgtgccagagtggacggccgccaccagcaggaccagccaccggcccccaagggctgtagcactaatgcaatgttctgccacctcgggcctgcgcccggggactgagacaagacacagaccctgaaggagagagacagagcgaggagaggaaggaggtgcctgagaaagtcgttgaaagacccagaaaagaaagtgaacagagagcgtcggcgccagaacggagctctcccctgctcagagactcctggttgctcccctcaggccagagccagaacacgcgtgggtcgtccttcatcatacacatgggagacacgcacagcgagggggcgtcccgggagaccaggcagcctgagccgtccctgggtgcggggcctgtctgggctccgggctgcgcgtgagggtcccagggctgaccgggcaccagggggcttccaggccatggcagccgccctgcgcgtgagttccttttgaaatcagataagaggctgtctctccagccccatatctgtcagctgcatggcccttggtcagtcgctcctgttctctgagcctcagtttcgccacctggaaaatgggaacaatgtaccaccctcttggagcgcactcgaggctcatgcgtgtggacgcttggcccagtacccaacagaggcagagccagagtgtgggctgggctgttttttcagggaaattccttggggaccaggtgagccagggaagagttgctctttatttaagtgaaaagggtggtctgggccggcctggtccctctgcccacttgctcacaggccgaattggcagctgggactctgtaggtcactcgctgctcctgccacccgacgtgcacctcactgctgcccccaagaatcctcccagaccttcactggctccatcaccccctccttcagctcctggtcagcatagcctggcgcaggtgtgggctgcctttgccgtggccttgccgtgtgactgtgaacacttgtgagacccttccgagcctcagtttccccctgcgtgaaagagttaatcttgggtcccatgcagaaggcagctctggggacaaagagagagggatttcctcccacagcagcactcagctctgagcctgcactggagctgggtgccataagcgacagcagctgttaatgataatatcattaataataatcctcacgtctgcacctctactccccacccatccagatcagaaaattctgcttgctagaattacgtgcagactaagaatcagccctgacaggtgtcactgaggatagaaacgcctctgatgtggctgctgaggcagccttgagtgatgagtgaggttctagcaggtggagcgtgagggggaggcggggtgctgggaaagccgggggctgacagggaggtttgtgcgtgggaggcggctgcagggccctgatgcagctgggcccgggtctcactccagccagcagttccgcactgtcggattcgggacgggtggctggtctgaggagaccagggaacaagccgcggggcactgattgctctgcccactcaggggcagcagaggcctaggccgcaggtgcagccacagagctccgtagctccatgagaaatagcatggggcccgccgggttcgtgctggacaccaccgggggctgccgtggccgcacactgtgtccccagcctcgaaggaacaaacccaaaactattgcagccacatcatctccggtcccaggcgctggattgggcagccgctccccagacacagctgggattttcccccagagactctgtacctcttgggtccctggtctgacccacagacgaggcccagctttgggatcacagacttggggaggcctgatgggacaggcggccacccttgcccccactcccctgctggcgggtggaaaggggggttccttgatgaggagggggacactggtgttctgacgcatcaccaggctaaacttcaaagacccttcacatggaccctccccagagcattctggggatctgagcccatccctcccaggggccgctccctccccagtcatgtaggggcaccccaggactccccagcactggaacctaggcagcagacagcaatgtgtggagagcgaggctggagtcccatgtccctgtgggggatgagagcctcagctgggccctctgtccacaacgcccactcactgagggccactggggtggggtggctctgggggagaaagctgagttcacccaagggtggggcgaatggagagtcaggggcccgctcaatgctgagccacaaaggggactctggtgcaggggaccggggtccaggcttaccctgggtcctaggctagcccttccctgacgggccatccccaaagcagtgacccgtccccctgtctgcggcaggcgcttccatcactcgctcacggaccacccccgctggatccgagagcgaagccatgagtcctacgccaagaactactccgtcgtcttcccccacgatgagccgctggccgggcgcaacatgaggagagacccgctgcacgaggtaacgcccctacagctcctgctggggactggcagcgagggtctgggacgtcctcagggcagcggagtgacagaaatgcaaggtgtaccccaaccgcaggtcaggtgcggtgacaaggtgtctgtcattccccaggtagtaacccggcacccccatgtgttgggcacagtgctcagggccaagaacattagggaataaagtggaaatggctccctcccacccgggggcttctgttgtagtggaggagcaggaacgcacacccaggaaccgccccctgccaactgctggcagcagcgccaacagggcaggggtcctgggggcggggtcttggtgggtgtatgcagccacgtattgggagagcagccagaacacggcgtacattggagaggggctcctgcctgtagagcctgctgcggaggctcttctgccctggtgagcttcgactcacccattcagtgaaacccactgtcaggtgcccctttctcaggtctgcccctgtgccctcccctggtcccccaaagacaaaggagctccttctctgcgctcccagccccgtctccattccttccccctctccctggccatctcgtgctggacgctttgctttctggggaacaggggctatgtcctaggcactctggttcctgagcattgaggtgctcgggggatgtttgttgaacagatggatgggcggggaggcaagagggaggctcagggagcaggtggcgtttaaactgaagaaggggcctccctcacctgagattccagtgtctggccccaagagagatcctggtattagctgtacctcctggggagaggcccagagtggtcacagggctggctcccagactgccctggccctttggcctggcttggtggaccagctatgatctcaggccacacatggccctggggtctccctagcatgcccccgggcctgtaatcagtaatcacgcccttgccagtcctgacagttcagaagcctccctgggtgaatgcagggtttgctcctctcgcagtcagctcagacgcattcctcagaactgagcagctctaccgaagaaacttggcaagggctgaagcacgcccctgccccccagggaaatcttggttcacccacgcctcgacttcccttcctagttagcagccttcttgcgacacttgacagccgcttaagtttgttctctttctttcttttataaagaggggagcctgccctcttttaatgggctcttgagatgaacagtttgcctccttagaaaggtggcccatgggatgtccccatggttcactgagaggtgggtggattttgtgccctcgattgccatcccctcagaatcccaggcaggcagggaggacatgtccatgtcattgatgaatgctgtggccttgggcgtgcctcctccttcttggggcctcgggggtggaggggagggcaagtgctgttgggacagaccctcagcgggccatctggaaccagatgctgcccccgaggccctctcagccctgcgctcggggcctcgttccagtcagagggggtggcccctgggtagggcccttccaaacccgagagtgggttttcttttttttcccaaaccaaatttatttttaaagaaacctcccactctgtttctctagtgtgttcattacattcgttgttgtgattaagtaggcagatcttaaaatgagctattttaactgctctaaagtgtacaattcagtggcattaagtgcctttgcagtgctgtgcaaccgttcccattacccagttccagaacattctcatcaccccacagggaaacaccatccccagtaaacagcccttcctcatctcctcccaccagccttggcaaccactaagctgtttcggtctctatggatttgcctgttcaggtcacttcatatgctggaatcatccaatacatgaccttttgtgtctggcttcattcctgtagcatgttttcaaggttcatcctgtgataaaatgtgtccaaatttcgttgctttttatggctgaataatattccatggtgtatgcagaccatgctttgttgatccactcatcagctgagggccacgggggttctctcccctggttagtggttgcgcatagagctcagtgaacatgcgtgaacggaatttgtttacaaccccgctctcagttctcttgtgcatacttgggagtggaattgctgggtcgtatggtgcatctttctgctagggcagccacagcaaaaggccacaagtggagaggtttcagcagaacttttttttccccacatttctggagactgggaggtccaagatcaaggtgtcagacgatgggttcctggagagggctctcctggcttgtagtcggccaccttctcactgtcctcatgcagcggggagagggccctggcgtcgcttcctcctcctataagggctccagccgtatgggattaggacccaccctgatgacctcatttaacctaaagatcccatctccaaatagagtcacgtcagggtcagggctttgacatacgaatttatgtggggatgtgattccgtccatagcagatggtaattctacagatgggggttctcagggccaaggcagatcagggcaggtggtaattctacagatgatggttatcggggccagggcagatggggcaggtgctattctgtagctgggggttctcaggatgagggcagataggggaaggtgataattctacagatggggttctcagggtgagggcagatggggcaggcggtaagtctatagatgggattcctggggcaagagcagatcagggcaggtggtaattctatagatgggggttctcagggtgagggcagatggggcaggtggtaattaattctatagatgggggttctcagggtgagggcagatggggcaggtggtaattaattctatagatgggggttctcagggtgagggcagatggggcaggtggtaattctatagatgggggttctcagggtgagggcagatggggcaggtggtaattctatagatgggggttctcagggtgagggcagatggggcaggtggtaattctacacataggggttctcagggtgaggcagtgagggtagctgcaaacactgggctggaggcctggttccaagagtcagggcctccttgctctccgcacccttgggtgtaaagtggcggatgtggctctctgccctgcgcaggggtatcaggccatgcgtgacagatgcctgttccccactcctgctcaggaactccttggacaaggctgcgtgttccaggagcggcatggctgggagcgaccgggatggtttcatccccgaggcccagctccggtgagtagtgcctgctgggctgtgctgctgggaggccctgccctgacaacccccttgcccctccacgtgccccgtccttgcccctccgtgtgccccgcctccccaggtggttccactgtcgtgatcagttattctgcacacgggaagccgagccctgccgacctgcccccaaggctcagtgcattctttgtgccgttcacgcaattcccactcctcgtcctccccactacccgtccgctgtggccaggccttccatggcctaagtgggaagggctgtaggcagagcagaaggggtgtcctgcggtggggagacagcaagaagactcccccaggttgcaggaggaatggagcgtctcctaattctgtgcatctatttttggccactccgactgttggtttatgtccgtaggagggcaggcactgggcaggttgatgcacccagggtgctcagtttcccagtggaggtttcacagtggcctggactctgggcgtcctctggggactcccagggacctgggtcctcagtgagaggaacaaaggcagtcctgctgtgaaacctgggacccagaccctcgggagcaggggacgcgaggccttaaggccagctgaggggtagcatttgatccagatttacagaaatcgaaatccccttcccggggctgcgtctcaccagtcccctctggtgcacccaccttccatccccatggcaacccacagcccaggccaggctccagagctccagggcatcgggaggggagatgagagccagagctggctaacggggccacggctctggggtcagagccttgcaggtcatcgtctcttctcctgctggcccctagggacatgccgtcctcatgaaccctgcggggaggaggggtctgggcagaccctgtcttgaagtgcaacccactgtgttccagtcagatctggccctggaagcccctctcccctgtccctgggcgaggagaggagagtcaggaacacaccccaggtcccaagatgggcggattttgcacccccacccgggagccagcctgggtgtccaggacaccttggcagggctgcagtgggtgggatgtccctgctggggaggggggtactccatgcagagatgccagcaaagcctgactcccttacaacctcacactggctcccacttgtgtgtgaagaggaggtgaggcttgggcggacggggctggcagccctgggaggttaagaattgcccacacctgcattcacagctgtgccgtgtcggcagttaggagggcaggtggcggggtggggggttgtctgcaggagcagcggccagggaggggcatggggctgtggggctgtggggtgtctgatgggggcagatcccagggaggccaaggcagtggcagaaaagctggactctggagcccacgcacctgcctggcttcgtgccactgccaggtccaggacttgtctgtgcccttgggcgagatataacttctctgcgcctcactttcctcatctgtagaaaggggcacacctggtaggagtgtaagacgcttcccgcaggggctggcccagagcaggagctgggcctgggattgccgtggctccagggagcagccctggctgaggtcctgggtaaccacctctccctgtcgttccccaccttgggtgcatccagctcctcctccagcctcctgggccctggctgggctctcagacccaccaggcaaccctgcggcctcctttgtgcctctgttttgcctggacctcatgggggccccctgcccgcgtccacaacacacgggcactcagtgcagggctctccgagggcagggccaggcctgaccccatcacagcctcagcgggaccccgctctggggagggaagcggggaggggccaaagaggcaggctgaggaccacgtcttttcttcccaggtcctcgagtacgactactacggggcttacgggagccgcgcgcacgaggactacgcctaccgcaggctgctggcagacgagtacaccttcgccttcccgccccaccacgacacggtgcgtagctggggtccaccgtgggggtccgtccttctgcctgtccctcagataagccattgcgccggccctcggctggccctgcaggggctcccctcccccaggagtctcttcgggctctgcattcacgcttttttcggctgactccattttgaggaggaatcatgcgttttcctctccccctcctccctctgtgccgagattttgccagcagccaggcctgagcggaagtggtgctgctggggatggggtgaggtgggggcggaggcaacgggctggggcccggtggggctgcaccgctctgagcctccgcctcccgctctccggagctgcgccgaggctggcatgagacgtggtgggggaagggggtcctccctcctggaagccagcgcagagtagatccaggacaagggggccgcaggctcctgggcatcaggccccgtatgggcccctccaagggacaagcagagggaaccagagccgggagggccgtggcctggagcctgcttgctgttcctctggctccaaagtgggcaggcgaggctgctcacacggggcagctggcagcccgtcgcccctgcctggggacctggctcccacgtgcagggggtggaggtgaggagtcttgggggtcttctcccccgcagcagcctgcaccacacaggggcgttctcccccgcagctgtccgggaaggagcgaggccagcgtctgccctggcctgcccagtcgtgttgtaaagtgctcacaggtggagcacagctgttgtccccgtgccaccccagggagacgcgtgacacctcactgcgaatctgacataggagcagagccaaggcctgagcccagagtctcagagcccagggacagcttaggaggcatccacgagggggttccttcctggggcctctaggccagtcgcaagtccggcttgggtagggtctgaccctgcggtcgtccgttgccttgaagggccccgcttgggttcatgctgtgctgtcagtgccttgagactcttcatggtctttgagcaaggtccccactgggtcccgcactgggttctgtagccagttctgaagggaataaaccgttcatttccaccatctccccgaaagcttgctctagtggtggaacatctgttcaaggcgtcggaagagggggctcctgcaggaaggaggaggcgtgtgtgtcatgaagcgccgcagcagcagggccggctcagtgcccgagtcccttgtcgctgcctcccagggagtgctcggggctccgtctggcacctccgcacccacagcttctaaagcctgtgggactctggccctcgaggatgtgggagctcgggggagatgccaacttggctttgtggcttcatccggcctccgcaaacgcgcctgaagccgtcctaaagcacgaaacacgtgcttgttcttggcgctggcagcttccccggcctgctagaggagcccagcgcgggaggctgctgagggttttggttggcagccccggtggcatcagcaaaggtacagcagaaaccgacaaaggggagccctgtcctgaaggacagtgatgcctggtggggctggagaagccatggagagctcaggaggcagatggtccctgtggtgtgctggtaacagcttaacaaccagctctctggggcagaggggaggaagctggctctgtagcaccggccaatttccctgatgtaaatgctttctccatggctgatttcaatccagtccgccaatgaggcatcactgaatgtggagctgggcagggatctgcctgaccagctgtcagggtcagtgcacccctgcacagcctggctggaccataactctgccactgcctggctgtgccaccatccctggcctccctgagtatgtgaggggtaatatgagttcccttgtggaaactcaaagggagtttgggaggagatgaaacagcttcccgacacacggcagctgttcaggaagctgtggttgttgctgtcatgattatttttttcctgtaacaacaatgaggtgggcacctctgctcagcagtggggggcatgttgagccctgaaggggaagaccaagtagaacatacagtgaagaatagaagattctcaaaacctcacccaggcatttgtaaacctggggaaggaaatagggagtgatgttgtttatgtgtgtgtgtgtgtgcgcgtgcgtgtgtgtgtgtgtgctttgaaaacagctttattgagatctaattcgcatactatatgatttattcatttaaaaggtacaactcagtgttttttagtgagttcacgggattgtacaaccatcaccatgatctagttttagaatgttttcatctcccagcaaaagataccccacacctcaccctatccccagcccagggcaaccctactctactttctctctctgtagatatatctagtttggacgtttcacgtaagtagaatcataaaagatgtgtgcttttgtgatcagcttcttccacttagcgtgatattctcaaggcacattcatgtcgtagtgtgtgtgtcagcacttcattccttttttttttaatttttcaaatttttatttatttatttattttttgagatggggtcttgctctgttgccccaggctggagtgcaggggtgcaattcggctcactgcaacttctgcctctcaggttcaagcgattcttctgcctcagcctcccaagtagctgggattacaggcacaggccaacatgaccaactaatttttgtatttttaatagagacgggatttcaccatgttgaccaggctggtcttgaactcctgacctcaggtgatccacctgccttggcctcccaaagtgctgggattacaggcatgagccaccatgccaggccacttcattcctttttatcccaatcatattccattgtatggacccatcatattttactcatccattgatccgttggtggacattggaattgttttcacttttgagttcttatgagcagtgctgctgtgaacatccacgtaccaggtgtcgtatgcatgtatgttataatttcttatgggtatataacgaggcctgggtcaagtggtatctctgtttaacattttgggggaacgccaactgttctccaaagtaactgtaccacattacattccccaccacagtgcgagagggttccagtgtctccacatcctcgccaacacttattattatctgactttttgattctagacatcctggtggttgtgaaatggcatttcagtgtggttttgatttgcattcctggaacaactaatgatgttgagcacattttcatgggcctgttgtccacttgcatatattctgtggagagatgtctgttcagatcctttgtcccttttaaaattgggttatttgtcttattattattattattattatttgagacagggtttcgctcttgttgcccaggctggagtgcaatggtgtgatctcggctcactgcaacctccgcctcctgggttcaagcaatgctcctgcctcagcctcctcagtagctgggattacaggtgcacaccaccacgcccagctaattttgtatttgtagtagagatggggtttctccatgttggctaggctggtctcaaactccagacctcaggtgatctgcctgcctcagcctcccaagtaattatcctgcctcagcctcctgagtagctgggattacaggcatgcaccaccacgcccagctaattttgtatttttagtagagatggggtttctccatgttggtcaggctggtctcgaactcctgacctcaggtgatccacccgcctcagcctcccaaagtgctgggattacaggcatgagccaccgcagccgactgtctttttattattgagttgcaaatttttttatagtttagttacaagtctcttatcagatctgtaatgtgcacacactctccccatcctgtggttgtcatctctcttccttgatggcattgtttgcagcttttaaaatgttgatgctgtccaattcatctctatgtttttgttttgttgcttgtgtttttggtgtcatgtctaagaacctaaccgaaggtaaaaaacatttatgttttcttctaagagttttatatcttcgcttttacacttaggtctaggatccatgaaaattaattttttttgcatggcgtgaggtcgggtccagccacgttcttttgcatgtggctacccagttggcccagcaccagttgttgaaaagattgctctacccttggaattgtcttggcacccttgttgaaaatcaattgactgtaaagatgagggcttatttctggactctcaattctattccgttgatctataggtctattcttatttagtacctcactgtcttgattatgtggctttgtattttaatagcaagtttggaatcaagaaatgtgaattctgcaattttgtttttccttttcaatattgttttgagtattattggcccctttgaatctccatatgaattttaggattggctagtcaatttctgcaaagaaaccagctgagaattttgatagggactgtgttaggtctgtagatcaatttggggtatcttgtcatttcaacaatagtaagtcttttgtttcatgaacatgggctgtctttccacttatttaggtcttctctcatttctttcaaaaaatctagattttaggatataagtttgggactttttaattaaatttattcctaagcattttattatcttgatgatattacaaatataattttttaaaacttccttttgagactgttcattgctaatatagaaatacaatagttttttgtgtgtttttatatattgaccttgtatcctgcaacctcgttgaactattttattagttctaacagttttttttcttttttttcttttttttttttagtggattccttaggatttcctatatacaagatactgttttggcaaatagggatgtttttatttcttcttttctgatctggatgccttttatttttcttttcctgcctaattgccctggctagagcctccagtgcaatgttgaatagagtggcaagaatggacccccctgtcttgttcctgatctttcatcatgaagtataatgtttgcaatgtgatttttataggtgtctttcatcagctgagggaagctcccttatagtcctagtttgttgtgcgtttttatcatgaacgggtgaattttgtcaaatacttttctgtatctgttggaggatcagatggtttttgtcctttgttctcttaatatgttgcattacatcaattgatttttgaatgttaaaccaacctcatattcctgggataaatcccattgatcatggtgtgtaatctctttcctatgttgttggatttgatttactagtattttgttgaggatttttttgtatctatatttgtaagaaatattggtctgtagttttcttataatatctttttctgcttttggcatcagggtaatgctggcctcctagagtgaattggcaagtatttcctattcatattttttggaagagtttgggaaaaatgggtattagttctttgactgtttggtaaaattcatcagggaagccatctggacctgggattgtggacaatttttcaattacgaattccatctcttttttgttttagttctattaagatttgtcatgtcttcattctgtttcagtaatttgtgtgtttctaggaatttgtccatttcgtgtctagtctgttggcatacacgtgttcggagttccctcagaatcccttttatttctgtggggtaggcatgatctcctgtctttcattcctgattttagcactttgagtcctctcattttctctgtcactctagctagaagtttgtccattttgttgatcttttcaaaacatcaactttttgttttgctgttttttcctatttttcgattcttatttctgttctaacatttcattccttctgcttgctttgggtttaattatgctctttttctggtgtctcaaagtggaagattgggctattgatttgagatcttctttcgtaatgcaagcacatacaagcagaaatttccctgtgagcatcgctttagctgcatctcataagtggttgtgtgttgtgctttcattttcatttaattcagtagcttctaattccctttgtgattcttttctttgatccattggttctttagcagtgtgttgtgtaatttccacatatttgtgaattttccaattgttcttctgctattgatttctaatttaattacatcgcggtcagaggacatcctttgtatgatttcaacctttttgaatttattgagccttattttgtggcttagcatattatctatcctggggagcatgtcctgtgcttgggaagcatgtgtcacagtgtgcacctgagctgagaagggcttggtgcgggctggaagagagggaggggaggctcagtacaggtgtgttggacacagcccccgttctccacgttcttgaggaagaagcacaccccaaaggcccccgtggcattcccacctgtctggaacttttcagatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggtatggagcctgaggttggggggcatgttcctgtcactccatgggcacagcctcaggcactgagatgagctggcaagccaccctgtcccctcgggcaccctgagcacactgctccttgccctcacctggctttgagctcccccccgtccggccccctttgccccatcccaggccccaggccctcattactttcctccacctctccctcctgccttccttctcctccctacctctgccttcctctctactcttccagaaaggatgtgtggcagctggccctcagccacgtctctcctgggactgtggggcccagtcccccccatgctctcacaggtgggattgccagaattaaatagaaacacaggatgctaagctacatttgaattttggatacataatgactcatttttaatgtaagtatgtcccaagccatatttgggacatacttgggatcttcatctgccttttcgtcacccacccacccacccacccaacagctcatgcgtccccatcttcatgagtgttctgggctgccagaacagaggatcacaaacctggtggcttaaaacaacaccaatttattgtcacggttctggaagctggaggtcaaaatgagggtgtctgtacctgacactctgcagaggacccttccttgctcttccagctgctggtggtggccgggagtcttggccttcctcggcatgcagctgcgtcactgcagtctctgcctgtgtcacaaggccttctccaggtgttctcttttttgttttgttttgttttgagacggagtctcgctctgtcgctcaggctggagtgcaatggcgcgatctcagctcactgcaacctccgcctcctgggtccaagtgattctcatgcctcagcctcctgagtagctgggattacaggcgcacaccaccatgcccaactattttttctatttttagtagagacggggtttcgccatattggccaggctggtctgaaactcctgacctcaggtgatcctcccacctcagcctcccaaagtgctgggattacaggtgtgagccaccgtgttagaaggacagcagtcagattagatgagggcccacactcatgacctcactttaacctgatcatatctgcaaagacctcatttccaaataagatcacactcccagtcctggtgaggactttcacatatcttttgtgggggacacaattcaacccctaacatcatctcttcagccagccaaccaacaaacccactccccagactcccaggcacctgctgctcacctcccattaatccagccacccactcagtcttgcatccacccatccaccagcccacacatccctgtttctccatacatctgttcccccttctgctcacccactcccatcctcccatccatctgcccaccttcccatctgtccatccatcctccatccacaaagtaatttatgccacagacatttatggagtcttctccggtaccaggcacggagctaggagccccagaatgaacggggggcatgaatcctgtccctagaaacttctcagcatggtggtggatgggtgggaggggccagtgccaaggcatttcaagaagaaagaagcttccttcccgcaagggtgacggtgatgggatgtcctgcccatggccagtcctctctgggtcattaagctgaaatggcatccctgggctgaggagctctccaggtcacctcccagtagggcatcctgtctgggggttatccagcctccgtgacaaggagctgcccctgtgagcggccctggggaaactgaggcagcacagacccggctggggcctcagcacagacccggcttccttctccctctcgcaggctccaccgtgtacacgtgcatgctcaaccaccgtgggggcaccgagagtgacctgactgtcagccgcctggcacccagccaccaggcctccccgctggcccccgcctttgaaggtatgggatgcctctgtgcacacggcgctgtgactgcggcctgctctgtggactggtggttgtggacagggcaggatggacgggatgggctgctgacggcagctctgtcattagctgttgtgcccgctgtggtcagagctgggagattagaggtctcgtttcaggctaaatgggggctttgttcaggcggcattgctggagctcccagtactcagtgattgcatctctgaacctgtccacgctgttgcggttcggagtggctgcagtgtgggcgtgctcggctcggtttcccggaacaaagcgtaccaatgctaggccgtgcctcccactcaaagcagtcagctcctttctgccactgacatccttgctgggttgacttctcaggcccgtgtgaccctctagtctggagcttggataggcccttagaagacgtccagttcagggcccacgctgatgcctgattgcctgctgcagtcccaccatgtctgcttgcataccctcagggacaggtagctcagtaccttcatcccttgtttgctcagccccaactgttacgcagagccaggacctgcctcttgtcccttcagctccctgatcctgtccctgggttcacacaggagccatctgatctctcgtcctgtaacccatccccaccagggatgaagaagcagagagggaaacattctctttctccaggaagaggcattgccacctctgggatgggacctgcacaggggaaggtgctgaccgtgcagctctctgtgctgtccccggggcaggggcacagtcagcggggagggctcagcccattcagaaaacctggcatctcctggttcttgacctgactccgtgctgctggcaaatgtagttgtttcctcactgggactcggtcagtgtcgagccccagcttgggcactgggggagagaggcaaggggagaaaggggctcattcatgatcagctcataacccgcaccttcggcagcagtcattgagcaccgactgtgtgtcaggctcagtttgaggcacggaggacccaacagtgagccaaacacaggaggttctggcccatgtggagtttgtatctctggtgggaggaaataggattaaaaaaataaaataagtggaaggtgtaggatgttagatgggtcaagaggaaaaatgaagaccggagggggtgggatattgggggccagggtgggaagacagcgctcctcactgcccagcgggtcttcggggctgggggctggcaggggctcctgggcctctgcggttctgccaaaagcagggagtagtgaggtgagccctgcggtctggaggctggtggcggagatgaggctgagagcgtgagtgaggggtcctatggggtgcgcagagctcgcccaccccttccctcctgccgttggcgacgtggaggctgagggagccatgggctgagccacagcgctcgtgcctcatggatccatgagctcgttccttcgctcgttccctcaacagtcatcacgtgagcctgcactgtgtggaagcaccaggtagccagggtcgggaggaggtgaaggaggccggtggggcttcagggaccccacagtgggctgtatgtccagacgggggcaggaagggccccgtaacacctggagggggacatgcaaggggatgggaaagagcgaggtgttagggaaggccatgtgaagccgccgagccgggatgagcaaggcttcctggaggagagggccggcctgagcttggaaggatggggaggagccactggctacaagggtgtagaggtgagaaccagtgtgacctgcccatcgctggtcgtctctgggtcattcagctgaaatggcatctctgagctgagaggagtgttgcctgtaaggagctaggcatcagcccccagtagaggggcggcccaggcacagcccatagccgcagacttagtgagtctagctagggagacagtagaggggccaaaatgaggacacaggtcaccaaaaatcctggccaggtcctgccactacctggctcagcgacctgcccccccgagcctcagtttcccccattggtggaatggagtgaggaagacgcgcctcccggggctgcgatggagaattgagtcagagtctgggggtgctgggagggctggggagcagcctccctgagcctcagtttccctggctggggaatgaggaccttgctcgtcccccctcataaggggaagctgtcaggaaagtgctttcaacgctgagccatctcccagtggtgcacaattagctttccagaggattctggtggattcctagagctgagggctggggatcggcggtgctggttgctgggaaggtttgcacttggtgggtgtggagttagcacagtgagtcacatcccccagggctctgcgggtcctggggacaccactcaacaggagaaaaccaccatgtgggctttgctttactttcaggcttcaaaactgcactgtttgagttatgaatatgcatgggcattaaatatgcgcgtgttgaatacgtgcgctacctacccatgctgcatcagatcaccacggagccgagagaatgtgatgatttacacaatgtgatcaaggtggcatacaaagcagctgtcaatctcaaaagtaattttaaatggtctttattgatctttttgtaagattacaaaaggatacatgctcctgggaaccattccaatgatactgaaaagcacaaaatcagctgcacagcccacagctccccccacacccactgccgatggtgcaagtccccggccaccctgccttctcactgctctctgccatgtcagctttgcaggccaggcctggacctgggctgactgacctctggcctcaggactggcgtcttgttttcagggaagttgatcatggatggtcagggccacaggaggccaggcccatcagctgccatctccctgggcaccagttggcctcagtagctcccatgccctcctgggagaggcctgggatggctgcagactgggggggccactcaggagccaggggcctgagagtggccgtgtgtgtgtgtgtgtgtgtgtgtgtgtgtgtgtgtgtgtgtgtgttgggggaggtgaggtagggtgtctgtctgaatagagctgaggattccatccagaaacggccccagttcaggtgtcggggaaccccttgaggactggcttgtctctttgccttcattctctgttgtgcttatggtgtcaagaggaagaagagagggagcagcctggctggggcctgcctggggccctgagaggtctctcgtccaagggtgcttccaatagccctgtggggccagatgttgtgggtctgccccttttacagatgagaaaatgggggctcagagaggtgagaagcaaggccggtgagccgcagaactgcatctgggccaggctggcctaggcctgtgtgttcccaagacaccgtcctcccagggtaggggcatccctttgaggtgtctgcagaggggtgggtggtaggggttgagaagcaggtccttctcctaacccccatggctcagaggatactctgcaaggcgtggccctgggggacccagggagggacagatacggttcctgggcactgtgaaggcacaggcccctgagagggcatttgttttctcagccgggagacccttgggccaccctctctgtccccacctcccaggccctgaaatcctgctctaagtccaggtgcctctcttccaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccaggtgagagaggactgggagcccgcccctgggtgcacctgctgcctggacccaggtcctccaacaggcccttgggcagaacagcttgtccagaatgggccattctgaatagttaagcgctctggtaaaccagagatgccattctgaataaatatcttcaaagcactggaatgcagataagccggtaacacgagtcagactgaaatttacagctgttcagtcactgaggaccccaggatcccagaggggagggcagtctctgagtcaccagtgcagtctaggaattaccgtccaccatcccaaagtgggcagaaccaggccagatttcgccctgctacctggtaatttctgtacgccaccttgatcacatgggcagaataatatcctataccgaggggtccctggctcctccggaaacaccctccatgacaaggttaaggcttatccatgcgtgcattccttctataaacacctgccgggctgtgttccccacccatgagaaaccaggaccggggaagaccctcggctgctggctcatgcacacagccacagaagagtcttgggcaaaaggacggctgagcaggtgtgcaccttggaaagacccctctgactgtgcttcggaggctgggagaagggactgggggtgggggacagggaggaaggacatcatgttagcagccaccagtggagcacctgtgacttgccaagcctgagccaacatctcccatccccacggtagccctttgaggtggtcataattgttcttatttttactgatgcagaaactgagaaacagagaggttgagacatttgcccaaggtcacacagctggtcagtgccagggctgatggggatgcgtcccccttgtgctcagaagcctgcacacgctcaccgccaccctttttcaagagttaaaaatcctctgtgagaaaacggcctagtctaggccttccattggtgaccctcccccaccaggctaaggggccaggacactcatctcggtgtgcttcctgccgccacatctgccttggggctggacagggtggctctgctggactgggcaggaggaagaggcacgagatgagggcactgcttctggggacatggaggatatcaaaggggtgatctgtctctggaaaatgatggtggcagcttcggggagaggatgggaaaggagaggaggagaggcagggaggggtgggggggagatgagtctccagcctgaaggtcgccgaggtgagcacttgacgtagcagggctgtgtcctggtgatatcctgtcagcctgggattctgccgagacctctggctggagtgcccagactctgccatggggtccgctttccctggcaccccacgctgagtcctaggccagttgctcccctctcaggctgcaagggaccgagctgttgctgtccgtccaagcatatgcactgtggtgctcaggggcacacggtagacgcgtgcttgctgaggaagggatagaatcggagagggtcgagtgctttaacactaactggcttctgccaagtgtttgacttgaggctgctcatagaaaccaacatgcattaaggagacatttgggcagaaccctgcaggaaacgagtgacccagccttggtgttctgggggaactgctcccagcagtggtaacagcaggtgcaaaggccccgtggcaggccagtgcgtatgtctgaggcacgcattgaggctgggatggagcaggccaggagccgggctcagagggcagcagggtgagatactggaggcccagcagctgctcctctgagggaggggtgctgagcagaggaggaacatggtcgggcttgggctttggtgggggggtctctgctgttgggtcagcgggcagggggccagcaggcctgtgaggagcctcaggccaggcgaggcagggatgccaggagggagtgatgagctgagtccatgcggctcacgggcgagggtttggcgttgtggtggttcccatggactgggcgaggctcatagcacccgacagtggatggggtgtgctgagagggtcgggggagggtaggggacagagacagcttccgcgtgcatgatgaagagtggagggtgctggccgcagctgccgggaaagggactgggatgcggtggaatcatgcagtccccagcctggcccacaggcagccgcgatgctgtgtgcttttcatttctcacctgggtgaccccaacctccgcatctctggggtagagggaggggtgtcaaggcctggtccttggaatcctctggcttcattgccacgccagccttggacagggagtggggatatttttagtgtgggggaggcaggtgggccgtggagggaggaggtggcagatggaccgatcaaggtgcggcccgggggcggccggtgcgcccagcctcattataagctgctccaggcggtggcgggggaggcagccagggcgggaagaggagctcgctgcctcctggtaatttcttaactttctcctccaaaatgtcctctatctttcaaaaataacccaaagtttcttagatgaataataatactggtgctgctgataaaggctgcactttcggaattgttattcaggacgtgctcagcacacctactggacaatggagtaggggctgtgtgagctgctgccccatggaactttctggaaatgctccataactgagtggtccaacacgcagccactaaaccctgtgtggctactgagcctttgaaatgtggctagtgggactgcatttttaatactagtggatgtaaactcaaatagccccctgtgctggtagaggctgggctcggtggctcatgcctgcaaccctagcactttgggaggccgaggtgataagatcgcttgagtccgggagtttgagaccagcctgagcaacatagcgagatcctatctctaaaaaaacaacaaaaaaatttttcaattagctcagcacggtggtgcacacctgtagtcgcagctacttgggagcccaaggctggaggatcgcttgagcccaggaggtcaaggctgcagcgagctgtgattgtgccactgcaagccgccctgggagacagggtgaccttgtctcaagccaaaatgaaacaaaacaaaccaaaaccaatatccttgcgtggctgggagagacggtgtcgtgcagcccagaactggccatcgctgtggtcatggttagcaccaggggctttgtgtgctttcttgctggttcctcacagtggcccgtggcatcacagatgagggactggggcttggtagggttcaggggtaagtacagggcctgggactagaaccggggcctctgactgggaagctcgtggacccctggaactgggcttcccctgaggttgctgagcccatagcctgggtcagagcccttcaaagccttggaccaggtggcagctccaggcttctgccccagggtcccttccgtgcggctgccactcaaggctgcagagagcatgtgcttgtcaggtctgaggcactggtatcactctccagggcttggcaccacgtgggtgctgagtggttacataagggtcttggccaactgtaccacagctgagcacctcaggctgacgtgggtggcggctcccagcactgtgacgattgggattagggtcagcagtacttctggacagcccaccctgcagcctcaacacctgctgggatcccagagggacagaagtgggggggcgtctcctagcaatgggggcctcaccctgctgtgccaagccagggtgttcacagtcagttctatttactgagagcctgctctgtgccaggcacattgggatagggggatgctgttggcacggagctcctgggggtggatgcattgggggtgggtacaaccaatgtgagagacaccctggcaggagactgtgggatcttggacaacgagtacctgcccaagacctagggagtcagggagggcttcctgggggaggtgacagctgagccaagagctgaaggatgacaaagggttaagtggtgacaggggaaggggtgagaatgcgaaggggcacaagagggctaggcctggaggtgggcacggtgcccaggaggtgagggcttcctgggagaccatgggtgttggctccagtgaggtctccggtacttgcgcaagtgtgagagtagatgtggtgctgggtaccacggagcagggaaagtggggagcgaatccccaccctcgcagagcttaaaagcaggggtggacccagcaagtctgtgcaaactgtccagtatggactgagtgtccagtgctcaggaacattcccgggccctcatagcactgtggcactcaggtgcagccctgccctcggtaggtgacagtcccctaggaggttgaaatggctcttagcacctgctgggtgctaagcccagctctctacctcctccaagtctgcagcctgagcgtctcacacccatgtcaggcagaggactttggggccgaggtgcccagttggagggttaggtcagggaacagagcggggtggtgtctgggaagagcactttctgcagtgggctgggaggaggccggaatctgctccaatccggctctgccttgggcaagttactctactcttctgtacagcactgaggccaccatagccagctcctctctcgggccgtggctaccaaagcagcagctgaggcccctctggcctctgaagagttggaaacctggagaggcctggggatgtggattgtggattgtggacctggtccagatgctctgttcctcctggcctgtgggcttcaagggcattctatggttagataaccactctggcctcacttccccatctaagaatcgcgagtcccgttagagctatctccaagtctggcctcccccaggggtcctgctagccctagcgttaccccgttggaaggtggctgtcttatgtatatttggaacgtacatctgtcttggtgtatttttattaatccatgtttattgtcatctgtctcatgaggacagggacttatcccactcatggcaggtccccggggcctttcctgcccaggccccacccgtgagcacttgctgactgagcgactttgctcttgcctgcagccgagccattttgcaggaggtgctggacgcagacctgagcaacgaggccttcccgttctccacccacaagctactgagagccgcagggcacctggtaggttccagctggccacgtcctctgggtcgtgggtggcagcatggtgtgaggggtgcgccgggggatctgggggctgggggctctcgggcaggttcctttgcctccctgggcctcggtccccaactgtgaaggggggacagtgggaccaggcggccctcctacaggctgttgggagcttggagaggtcatgtggatcaaagtcacagcgtcttccatccctcctcggtgcctggtgcatgccagggactcagtcccagggaaggtggccttggcctcactgcctgcatcgccacctattgtatcccctcctgaaaggcgcggggcagccctcccgaggccaagtgacctcctggaaacgggagggccgagctctgctgagcagtagctggctccggagagctccgtgtggcagcctcccagctgccattgtgggcgtgggaggaggggctgctggggtgggagcacagccagtccccaaacagcaccccacatgtcccccaccaactctagaaagcctgtatcctgggggccagagcccgtcccttctgagatggtggtagtgtccggagccagcactccatgggacctggccccaggcaggaggctccctcagagaccaggatcggggcccagattctagttctgggccagcacgaccctcttctgggctttgtttccttgttggaaaacaggcatcttggcatctgctttgacttctcgaggctgagatgaggatggtaaacacagcagcccctgtttgccgagggcttcctgtgtgccagacactgttccgagaacatcacagcacactttcccatgtaatcctcgccatagtgcgggcggctctgttacagggtctcccaacctcagcactactgacgtttggaggagatcctctctgctgtgagggccctcctgtgtgacacaggtgtgtggccgcctccctggctgccgcccactaggtgccagtggcacccaccgtcgtgacagccacaagtgtgttcagacatggccaagggtccgctgggggcaggatcgcccattgagaacctcagtgcatgaccaccctgcttgtttgcagggctgtaagccatgtagtggcagcgggggccgggcctccagagccctccagcgctcatgctggaggagatgtcgccctgcatgacggatgttacccagatggagctcagagaggctggatgggccaggctgctcagggccgcccggctaaagaaacccagaaagcccccgatatgtgtcagtgacacggatgtggccttcaggagggggtgggcgggtgcacggccgcgtttggaggcagctccctgtctctccttcctgtatgttcgtctggggtttgggtggggaaatgctaaggaaggttggggaggagcgaggtcctggcctgcagagggactggaggtcctgggggacaaatctgggttctgttagcagataaacaatctggcgatgactgtcagggaggaggcggccagaaactagggagatcccagcggctctgctctcacctcccctctccagaggctgcacaggggcaggaagcagggccggctgtgtctagcttgcttcctgcctctgtggtgcaaagctgcctgctgggaccagagagggtgggcactcagagagagcagcacagctggatccaggccacacggccttcagatggcccgactccagctccagcaggccggggtccacgcagcatccagctttgtctgcagctgggttctggtttgcagaaggggaggggggctgcgggttctcccaccttgctgaggcttggcataggtgctgcttctgtctggtttggctacaggacggggagacgaccaggtgggaacacgtcccctcccatttgaggcccagcagccttgcccccacccgcacggccactccagcaagctgctgggacttgttctcagacaggcggctccagctgcctcccctctcctggggctggccctttcctggccctggcagcctccccaagcctaggcagtggctgcctgggtcagcctctacctgtgtggcctaggagccaggccaggccaggtgcttgctgagctgacccaaaggctctgcttccgggatgacatcccccagaggaacaggccaggccaaacacagcgtggggggtgcagggggtgcaggggccgcctctccccacagtctcctgctcattggtgtaaaatcactggtgttgtaaaaagcacatcacggctgcataaaatactgctcattgctcggtttccaaccatcactgcgcatgggtttcagcacaggggctgagtgcagacctcgcttctagcagtttccaaccatcactgcgcgtgggtttcagcacaggggctgagtgcagacctcgcttctagcagtttccaaccatcactgcgcgtgggtttcagcacaggggctgagtgcagacctcgcttctagcagtttccaaccatcactgcgcatgggtttcagcacaggggctgagtgcagacctcgcttctagcagtttccaaccatcactgcgcgtgggtttcagcacaggggctgagtgcagacctcacttctaccaagcccactttgggcacgacccttgccccctcagaacaaggatgctgggtctgtgggcaggtctcgtgagctgcggcacgaagctcatctggctgggacatggtggtcagcggcatctcagaggaccgttggggacattcatagcctgccaatgagttagcgaaaacccctctaatcccatcccagagaaaccagggttgacagttgagtgtgttgcccgccatcttctttccgtcatctgtgactatctgtggattttaaaatgtaatcagggcatcccatgcagtctgtacacactgctttattctccgaatgtcgtgactgttcccctgttcctttgaacgttccccgagaaccacttggaacgccctcagctgcgtctccagtgccctgctcatgtgtttcacaccgggtccacctctctgctttggaagtggccccgggaggaacttcccttgaacaccgtcctcccagtagatgctgactgttggtctgagagagggtagagctgggcccaccaggtcggaggtatgtgcggttcatggtcccgggtcactctgtggtgtgttcttctctgtccttccgtatttctgcgcccctcgcttgcccagtgctaccctaggtctcaggcggagtgggagagaagcacaatgctttctaggctggggtccctgcgtgtgggatgggggggaggggaaacacaggggaggtgggacatgagcgtcaactggcgtgcgcgatcgtggggacacaggaaataggcggcggggaggtgctacacgcataaggaggcccagctgctgggaaacacgccgcgcaccggccgtggcagttatccatggtgtacctcccagcaccgtcagctcacgtagggccactgggactctcagtcaagcactagtgttttactaaacttaacgatccgttcccagtgctgtgcttctcgtcctctccctcactagcgctcgagagactctggagtgaactctggacatgctgcctgggagcctgctgggtgctggattggggtcccaggatggaagatgtggctccttccctcgatgggctcagaccccgagtgaggttggggcccaggaagggacctgcagccacagcccagcctgtactggaaagaggtcctaggcagggtgaggggtgaccccaggccaacgggttctcatggaaccgagagtcccgcaaagatggccacagagaactgagtgttggcaagaaccagacagggtggggcaaggccccgagtgtctcgacctcttggctagaaaaaaagtgtggcccgtgttggggggctctgccctgggactgaccccaggggcctgtggacgagccgggagcccacatcagctgcccctgctctacccactacccaccagcattctccccatccctgtgggccccatcctgacacctcccagcccccgtggcaggaccagggcggcagatgtccccggtgctgagggcaggcttccatccccacacagccccagccaggagctcgtctctgccgacagccagtggcccagggccccactccttaggaagacagacgaccttagcgcacagatttactgtcacctgggctgagtggccggctctgtggggtcattcccatgctcatgttcttggagtccgtggggtccatcggggacagactgggggtgagctggggctaaccatcttcacctagagaccctgatgcccagcactgagcgcagccccactggcttctcgtccctctccctccttgtcctcccggcagctctctggagtggccagtgtgggcctggcggccaggtctgcgtgtgtctggagtggccagtgtgggcctggcggccaggtctgcgtgtgtctggaggacgactgtggccctcaggagcttgaagttgctgggtggccggtgggtccagatcccatgagatgaggccggggactcgaggagcgtgtggaggacggagcggccaggaatcctgtcctcagtgacctctgcctcctcttgagggccctggggaggtgtgggccaggagagcagaggttctgggcccttagtgtcaatgttacagtttttgctgacctgggaggctgtccctcaaagtggccagggccacgcgctcccaggtggccccagcctgggacacagtgccctccccatttcctggccagcaagacgggtggggatacagccactggccacggccagctccccctgtagggggcctcacaggcaggtgggagatgggagttgagtcagccacagacactggggggtttgggaccaaagcatccatgttacccaaggctcggtggagctcaggccagaagcctggcttcccatcctgcccggtccttctgcgggtcgcctctctgggcctcagtgtccccacctgtagcacggagtctagcacaatgtctaaaattctttccgggcctttccataagtctgtccagacactctggattctctgaatccagggagaatttcatattctcctaaataatatcttgtgctggcttaaaaatgtgttgatgacatatccctcaacgtgaagaaacgctgggctggagcgtgggcctgagccaggtatttataggcgatcagttgggttccagccaaccagatgcaggcgaggaatgcgtgtgcctgcgcagtcagcggaacctctgggttgaaagcagttgtgagggccgatgaggacaagggccagagctgcagacccgggccccgggtgcgagagcgggcgcctgccgctgcccaaagaccctcctcaccaccagacgaattgggcgcgattcccagctgagcactgctgctgttgtgcagtgattgttctccgagaggctgggatctgacccaggctgccacgatccctggactgctagaggaggaagcagggtggggagaagttattgtccgctcagcagccagcagaccagctgtccttgctccccaaatatcttgcctcgaggccagcaagattccccgtgggtcagtgctctcccggcgtgtctcccagagctccgctcggccagacacggtgttcccagggcccctgccgaggacgggccccgccgcgaagcagcatgctgggctgggagcactccgtggggcacggtgatcaagtgattttctctgaaaattaatttcagctcaaaaggaaattgaatctcttttcctgacagcgagaagtcctagtcgcggcgctgttaggatttgattagctcaggatggagcagtcctgcacccacacacgttagataactatgacatgccagtcagagaccagctgagttccagccactgcctaaacactcgctttacagaacccgtgcagatttgctgaggcctgagacagatacccgatatcatgggcaggttccctgatgcagcacagagagactggtggccgcaggctggggcaccgtgttccctgtcacgggtcgagctgttgccacgatagtgtgaagggcctgggccccaaggggaagttggagcgagggtgtttgtggagtgggtggtgggaagcttcgacccccacccgggtttgctgcttctgtctggggcaagtgacctcaggcagaactgggtgcagagggctctgagctgggggccttggagacttcaggggcaatcggttccaggttctcatcttgcccttgtaaggaaagaaaaggtgtgagccctcccctcacccattatcaggggcatgggagacagccctgtaacaaaagactggttcacaagagaaaagcacaccagatagatttaatcagagctttatgtgacatgggagccatcagaaagggggacccagagacccagggaagacggttcctatgcttaaggtcggtgaagaatggggagccgtgtggacaggtgttggacggcaggggatgcctgtggggatggactgtggggaggctggcgaggccagctgtgcagctcccccttggcctctccgtgcagtgcttctcactcccaggcatgggacaggacccctggagcaaaggtcttatgacccacagtcagacaaggtaggcggagaacatctttatggccagctcctccccagaaaagtggggaaggcttgagttgtatttctaggtctcatggctggctttgggggagagggcctctactgtccatgacccatctggggaaagaggaattctggcttctgtgacttgctgcaggggagaaagagggcgggagacaagaggggatgaggaggtcagagagatttgggctgcaccagaggccttctggtcccctttagtcccgagtcctcatgccaggtgccctgcttgggggatcatggtctgaatcctagaacccttgccgcagatgagcctcgagcctgctggccactgtggtggaggctggtgggaatgggtaccagtgctgtgtggcccagggagggaggcctcctgcacctgcccactgaccgacacttgccacctaagtggcctgaatggaatgggacaggcaaggtggggggtcctctcatccttggggaccaatggcatcccacagaactccctccagggcctggaagggtctgacctccagaaccttccaaaaagagagggtcctcaggccaatttggagggagatagccatggtcatagtagtggcgcttgcctaagtgtgggggactcagcgggcctcagccccgccccacatgatctcattccacagagggatcctctctcatcacaacctatagtccaggagtctgagccccagcgaaggccaccagtggcaggcggctctgctggcttcaggaatcattcccctcttgtccaggccaactggctgggaacagcgcctggccactgggaagacgggcaacaggcagccctgtgggtcctgagcccttgcccccagccagggccaagcaggaaggggactctgttcccagcagggtccacgctatcacaaaggacccctgccccaaccctttatttgcagagctacatctgataataacagacatgtcactccaggggactgattagttccatgggtggagaggtcccctgtagccccacccttcatgggtttgattccaaagcacctattcctaaacaggaggcagagttcccctcaccttggtcttcctccctctcagcttgacccccacctggccaggtatctgctctggtccgaccctcaagctgcacccaggtgaggtcaggggcccaggattgaaggtgcatcccctacggattctttcaacaagaatcgtgcgtaataagctctgtctgggtctgagaacattgtcgattcacctcactcctctcacccctggaggatgtgggtttccaggctgacagttatgttcgaagctctgtgcttcgaagatactgttctacagtagattagcatctactagagccacgccaaggggtggtttcagggtttcaggcctctctctctgtcttatgtatttgcgatggagtctcactctgttgcccaggctggagtgcagtggggcgaccttggctcgctacagcctccgcctctcaggttcaaccaattctcctgcctcagcctcccaagtagctgggactaaaggtgcccatcaccacagccagctaatttttgtatttttagtagagatggggtttcgctgtgttggccaggctggtctcaaactcctggcctcaagtgatccgcccaactcggcctcccaaagtgctgggattgcaggcgtgagccactgcgcccggactctttctgtgatttccatgcagggattcactggtatttatcctgtttggtacccactgtgctttctgcagtctgactgctcatgaccgaccatcttcacttctggaacattctctgctgttatctgtttaagtaccgcctttccccccggtctctctggtatctccttgaccttctgttggacgcagactgcagcttcctgtccggcccagggccattccctcacattccccgaattcccatctctgtgtctacaccccccggcctcccctggcacctctgttcctgtggtccaggatgtcgagaaagtgccggtcacttagttcctagcctcagtttcccatgaagaaaaggagttggtttgctggctggtttgttaatttaattgtacagttcggtagtgttaagtatgttcacattgttgggaaacaaacctccagaatgtcttcattttgtgaaactgaagctctgtccccattgaggcaattccctttccctctccccagcccctgtgccctccattctgctcttgatgtctatgaatttggtgactccagggacctcatatgagtggaatcagacaggatttgtccttctgtgactggctcccttcacttagcgtgatgtgtttataatgtttttgtccgcgttgtgttatgcatccgaagttccttcctttttaaggctgaataacattccttcatgtggatagaacactttttgtctgttcatcatctgtttttggtgtgtgtttttttttttaatttcagacagggtcttagtctgtcacccaggctggagtgcagcggtgcgatctcagctcactgcctcaacctcctggtctcaagtgatcctccccccttcagccttccaagtagctgggactacaggcacatgccaccaaacccagctaattctaaaattttttttgtagagacagggcctccctatgttgcccaggctggtctcagactcctgggctcaagcagtcctcctgccttggcctccccaagtactgggattacaggtgtgagccactatgccctgcttgttcatcctctgctgatggacacttgggttgcatctacctcttggctattgtgaataaccctgtgaatatgagtgtgcaaatacctcttcgaatccctcctttcaattcctttgggtgtatacccagaagtggggttgctggatcacatggaagttgtatttttaaagttttaaagaactgccaccctgttttccacagtgcttgcaccattttccatttccactaacaatacacaagggttccagtttctccacatcctcaccaacactcgttactttctttttcttgtttttataattgtcatcctcatgggcacaaagtgataactcactgtgacttgggtttgcgtgcctctgatgggtagtgacgtggagcatcttttcctgggcctgttggccatttgcatttgcttttgagaattgtcgattcaagtcccttgcctattttttttttttttaaatggagtctcactctgttgcccaggctggagtgcagtggcacaatctcggctcactgcagcctccacctccttgattcaagtgattctcccacctcagcctcctgagtagctgggactacaggcatgcaccaccatgcccaactaattttttttttaaatatttttaatggaaacagggtttcactatgttggccagggtggtctcgagctcctgacctcagatggtcctcccaccttggtctcccaaagtgctgggattacaggcatgagccaccacacccggcccctttgcccatttttaatggtggtatttgactttttattgttaagttgtaggagttctttgttctgtctgggtagaaggcccttatcatatgtaagacttgcaaatgttctctcccatcccgtgggttgccttttcactctttgttagcgtccttcgatgcacaaatgtgcttgtgatcaatgtccttccatctgacttttgcttttgtgacctgtgcttttggtgtcctctccaggaaacccttgccatttccaactccccatgccttcttccagaggttgtacagctacagatcttacccttgtgtctttgttccatgtctagttaatttttggacaagatgtaaggtacgcgaccagcttctcgcttctgcatgtggctatcggatcctcccagcaccacttgttggagactctttccccatgagtggcctcagcgcccttgtagagatcatgtgaacacatacgtgacggttcatttgacttcactttctccaactttgctgatttcgtttaatagtttcagcaggcttttttggcatggaattttcaggatgtggaaagggtttaaacaaaacctgacataagacccttcctgctgatcttccataattctgtgactccatccacggccaggagttccatcttgcaatttggggctttcagagcccacctgagtcagagtggccaaggacgacgtgccgggaccatgtgcttggtgcacacgcacccaaccctggccgatgggtcagagcagggcactgaggccaagtgggccgacccccatgggcgctgggagacgctgttcccacccaagcccggctgactgggagcccgtgtttgttctggatgtcctcgcttggcctgtccctttccttgtgggtccccacttggaagaactggggactgatcccactccactgctttggtggagaaaaatgtaagacgcctcaacaactagtgattccgtgaacttagagaggcccctggatttccccagcctccctctctttggcaggaagcaggtgtggcccccgttttgctccttcgttcagggactgtttcttgggccaggctgtgcacggcgtacaatggagacccagacccagctgaccccatcctcgctgagctgctggagccaggaaggatgggactgctccctcccttccacccgtgaactccaaccctctccctgagctgggtgacgggtctttgtctgaacagggatccgcaattggagggccgtgcataggtgcactttaaaaattatttttcctgtttcaaaatgagattggttttgagccccgagctcctccataggctatctaaaattagaaccccgttgacaaggcaatctttgtcaggggcctacggcttgcaccagggaagcagggaaatgtcaacagtatattttctgtgtcaattttgagttttttaggaggcctgggcaaatggcaacttagagcaaatttgcgctatttccaaagcttttagaatccagcccctcggcggccatgtgattaaagtgtcaggtttataaggagctgcccctgtggttgggagagcggcctctgccctccttcccacaggcgtatcccagcgggagctgtacagggagggcctttccactcagagcagtggtggaatcagctcctccgctgtctgggatcctgcagtcagcctagctctccccattccttttgtgagctctctggtcccagggctgagcactcaggccttcccatgggagtcagtgggttcaacggtttgcctgaaggtgaggacgcagactccagttactgggtgtggacgtgccacgcacctgaaccaagtgtgtgaggaaaatcacgcctcctgtgcaagaagccccccatgctgtctgtggcctccacgcagccgagtgctagcctgttgtgcaggcgtgcgggacacaccctcccaaagacaccagctgtcctcagcggagcagggtgtgcctaggccctgctcagtgcctctgggagcctctgtgtccgcctcagcccacagacattactgaccgtgttcccaccgttgcaagggccgtggagggacgagatgaagcttagcccagagcacccgataatcggcactgtcacttctgcagggcttgagccatcgtgtctttcacagtcaggtatccacagccccacaggcctttctctcctgcctcccaccatgtccgctgcccaacgctgggcctttgcacctcacctggaaggcccgtctgcgacggcaatctcctggtctgcctgctagcctggtctggcgtcccaggcaggggtcttgctttccggccccttcctcacccagaacatggttgtgctcacggccgagctgagtcctgaagggcagaggctatggctgtcttcagagcccggtgctgggccggggctgaccagaattggtgggtgacgggctcctcggacaacgggcttggcacctggctgtccccttccctgatgcctctatccccacctggtgcagccagggtggtgtcccctgagctgggctgctgccttccccctgctcctcgcagacgtgtctcagagcttctgaaacagataaagctgggctcccaaccccatcttacagacaaggaagggtgagaagcttgccccaggtcactgctgtggactgaatggtgacccccaaaacatatatctacatcctaactcgtcagaacctgtgaatggggccttgtttggaaataggatctttgcaggtgtaattaaggtcaggatctccagatgatattatctagggctagggaaggtcctaagtccagtgacaagtgtccttagaagacagagacacaaaggggaggctgtgagggctgaggcagaaatcgcagtggtgcagccacaagccaaggggtgccgggaggtgctcgggaggtgctcgggaggaggctccctcgagagtggaagggtcgtctccggagcctgcagaggaagcgtggcttgcccacatggtgattttggattttgagcctgcagaaccgagagagagtttactgttattgttttaagccaccagttgtggtcgtttgttatgacaggtaggaaactaacccagtcctggagaagacctgaggtctgcagatagcaaacctgccatctccccttcccaaaggtgaccccctacttctcctcaaagatttccagagcagctggagggagcagctctccttggaagaccccatttcttgatggcaatctggctgggacccagggccagctgataatcctggtgacagtaggagctgccaccaggaagtggtggcctgggcctggacctcagccatcttacatggccacatctaagccatgaccttgtcccccaggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggtgagtgcagggtctggacagcacggggcgggggcgggcgcagtggggggcagtgacgctcgagacacctggaggccgagaagctgtttaccttccctgtgttgtcacccggcttccttctttccacaccatgatttcctcccctacaccccagcgcctgacatcctccatttccccaaaacctcttgctgcccagggtcttcgtgcagggccccagggacagtgttgggatctgcgacacctacacacacctgaactcagagagctgaggtgctgcctgacacctgggggtcaggcccaggctgggttggaattgagggccttggtttctctgagagctgtgaagaatggagccagggagcaggtgctgtggcctctggaagaagcccagaccctgtccagagcaaggatgaaggctcagagcgggctttgggcggttccccagcgtgttgggcacccagcttgggcgtcaggcagctcccctgggtgttgggcacccagcttgggcattgggaagctcccccttcacaagcccctccctgacgcccccacctgagggtgcagagggctgcagtgctgatgggcagtctgctcgggggagcggtcgccccagggaaccttctggagttggggatgcccctgcctcctgcccaggtgactaagcagctctgagagtgtggctaggggctggagggggtgggtttaggcagcatcctcatgcatctcctgaagggcttatccccctcagggtggcaccgaccccatggattcccttcccacaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggagtgagtatcccgctgttccacgcccacccggaagcaactgcctacagccagggcaggcaggcgcttcttggtcccccactcaaagcccctggtaccaacacttcccatgtgccagccatgctcttccagaacgcacccaacagcccactgcagataaggaaatcgaggccaaagagagaggccatctggccaggtcacatgttgttaaaggcagaaaggcagagagagtttgctcttttttttttttttttttttgagacggagtctcactctattgcccaggccggagtgcagtggcgcaatctcggctcactgcaacctccgcctcccaggttcaagtgattctcctgcctcagcctcccaagtagctgggattacaggcgtgcactaccacacccagctaatttttgtacttttagtagagatggggtttcaccatgttggccaggctggtcttgaactctcctgacctcgtgatctgcctgcctcggcctcccaaagtgctgggattacaagcgtgaggatcccaacatgctgggattcaaaccaggccagtgtaaggttgcgcacctggggcccctcccaggccagcagggcccgtggggaggtagagaaggctccacactcttcccatgcaggtctcaaaagagaaaggtgcagccaagcccaggccacccctctgtggcaggtctaggccgagggccttgggagggtgaacccagggagcctgacctcccagtcactgcaacacgacctcccatcccgttctggttcagtctccccacagccctgtgatagggggagaggggctcggctggggccgtcatccccactcacgaatggagaccacatggtgccaaggagcaggggactcacgcccagtcacacggcagaggtggaaggagagactctgcctgggggcgacctgacctcctgctctccccactgagagtggctttgagcatgctgctggagcccggcgcacgtgatccctgggctactgggagagtttggattccaggaacccgagtcccacttgggttgcagggcagtctgagaagatcaggccctgatcagaggccctcccgtggtgcccacgggggtctgaagcacaggtatccggggaagtgggcggctttgggctctgtggacatggagctgacagccagctgcaaacactgccacttctcccagatttctggagccttcaaaaggagtgtcagagtgacgaggggagggagagggaggacgagggagagggagggtgagggaggatgaggggagagggagggtgagggagagggagggtgaggggagagggagggtgaggggagagggagggtgagggagagggagggtaagggagagggagggtgagggagatggagggtgagggagagggaaggtgagggagagggaaggtgagggagagggagggtaagggagagggaaggagagagagagggagggtgagggagagggagggtgagggagagggagggtgaggggagatggagggtgagggagagggagggtaagggagagggaaggtgagggagagggagggtaaggggagagggagggtgagggagatggagggtgagggagagggaaggtgagggagagggaaggtgagggagagggagggtaagggagagggaaggagagagagagggagggtgagggagagggagggtgagggagagggagggtgaggggagatggagggtgagggagagggagggtgaggggagagggagggtgaggggagatggagggtgagggagagggagggtgagggagagggagggtaggggagagggaaggtgagggagagggagggggagggtaaggggagagggagggtgagggagagggagggtgagggagagggagggtgaggggagagggagggtgagggagagggagggtaggggagagggaaggtgagggagagggagggggagggtaaggggagagggagggtgagggagagggagggtgagggagagggagggtgaggggagagggagggtgagggagagggagggtgagggagagggagggtgagggagagggagggtgagggtgaggggagagggagggcgaggggagagggagggcgagggagagggagggtaagggagagggagggtgaagggagagggagagggagggtgaagggagagggagagggaggctgagggagaatgagggtgagggagagggagggtgagggagaatgagggagagggagagggagggtgggggagagggagggagagggagggagagggagggagagggacggtgagtggagccgtgtcgtcgtcatcctgtggcttctccctgggtgcctgtcaggctctgtctcttgtgtgacagcctgtccagctccctgaatcagctcagctcctggagagggggccccttgcagacaggtcagcatccatgggtcctttctgcttgcctgaccccgaccttctggccctccatgaagtacctgcagcctgatgtctgggtttaggagggcctcggacggcccctgtgacccagtgcgctctgctcaggggtttcctgtcaggctgcataatagctgccctgcgccgcggctctggactgttgcagttccaggacaggcgcagagaagatgctggcagtggagtcacagagaacagccctgccacactgctctgggactccgggcagttggggcctcagcgtcctcacgtggagaacagaaactagggtgacaccaaagatgtttacgaaacctccttccagcctcgtcctaatctgatggacaggtgggacccaaacagtgactccaggctgaggatgcaggaggtgccctcaacatcaccccagcccttccattcagggacccctttgcatagctgccgccgtgataacccattgcacagggagaagtctgcagactggcaacaaaatgttaccagttagccctgggtgctggcctttctttgattttagcttacttttttttttttgtcttcctgcttttaatctttaaaacttttacagtgagcattcatgtattacatgtagtaaagtcctttgaataaagtatgtattgtactataaaaaaaatgaacctggccgggcgcagtggctcaagtctgtaatcccagcactttgggaggctgaggtgggcagatcacttgaggtcaggagttcgagaccagcctggccaacatgatgaaaccccatctctattaaaaatacaaaattagccgggcatggtggtgggtgcctgtaatcccagctactccggaggctgaggcaggagaatcgtttgaacctgggaggcggaggttgtagtgagtctagattgtgccactgcaccaaaaaaaaaaaaaaaaaaaaaaccagagttgaacaacaatggaaggaaatcggaagcaggggccctcccaaatatacggggctcgcttctggaaacagcaaagtccactcctggttttgatgttttctattcatcccttttactcactcgaagcccgagccctgctgtccaggccaggtgctgggctggctctggggaccagcgtagtcctagtaggccagccctatctgcctggagccacggttgggtgtgcatcatgcagccccccattctcctccaggccgctgtggacgcgtccccaccctgcggtttctggggccccagctttctctactgcttcttccagcaaagtacccatgtttggcctggaggccatctggaggaacggccaagtggtgggccatgtccggagggctgactttgggttcgccatcgacaagaccatcgcctacggttacatccatgaccccagcggtgggccggtgagtccccttctctggccctgctaaggcagatgccgatccctcaccagctccaaaccagctccctgcactgcaccctgagtgtgccgggcatagggaggaggcacgggtgtggtccagaagaggaggagggaagagaaaggagggaggagggaagagggggaggaaggaaggaggagaaggagggggaaggaaaaaggggagagaggaaggaggaggaggagggagagggaggagggagggagaaggagaagggggaggaagaggcctcagcaggtggaggactccccagctgtgcctgggcagagccaaagctgctctctgttttctttctggaagaatccgactttggtgattccaggctttttttggttagaaggaggtgccagccagccaggctgataccttccagctcctcacaccagagacccaaacctcaggccacccacagcccaccctttgcctggggtgcaggggtggcccccagggtgaccgactagagactcagagacccatgttcctatcctctctttcctcacccccgacacccctgaccccaggcaaccccaccccctccaggtgaccctgacccctggctgcaggaggcaggaacaggctggaaagagcaggcactgcccccaggagcaagtcccaggacagctctgggtggccaggggtggtggggcagggggtgggcagcctccccagaaggggaaggggtggtctctacctccacctccttttcccatctttctggcactgcaagtagaggtgccggtgaggagggtcgtgtctctccatgggagccgatctgacgtttggcctaagccctaagtgaggccgggaggtgctggcctggctccagagccttccagcctgagcccctgatggacacgtagagggaattggggagggagcgagcacttgggagaagccatgaggaggggtaggctggagacggagcagccttagcaagagctgcagaacatgcgcaggcccagctcgcaggcccaatggggaggggacaccgccaggcctcgggcaagaccatggtcctgtggagctgtggggaagtggcagcccatggggctgagtccggcggtggagctgggaggctggggacacacttgatgccactagcctttggatctgccttttacttgctttgtgaccttggataaggatcctctcttggagcctcagtttcctcatttataaaatgtggacactcacctaccatgcagggctgtcatacaggccactgcacagagtgagtcttaatatgtggggattgtgatggcatggctcccacggtgggcagggcctcctgacacagccctggggccatggtcctgggggccacagccctggggcccagccaaaccggagtttatgggctccatgccagggtgggctggggagtggaggctcctttgccatttcttcaaagaacagtaatgctcgcctttctccggagtcagggatgggtccataaccaacgtgaccagggaagccgaggttccgaggttaaacggcatccagacaggcagccggggaaccagtcgatgcacccagagcggccggtgcacgtctcctgccccctccatcagggctgtccagagcatttgcaccatggaaatgggcaaatgctacagtcacacccacctcaccccagagctggttgttaaacattttctagcacccaagtggggtaacggaggtttctgcctaagatagggaaacctgctcattgatgggaaaggctccgagatggggaaggcgtttctgcctcgtaggtatctgttagcaaggccagatgcccgctttgagttgtgcatgcccgtggacatctgaaggccaccagctctccatgctgcctgcctgcggggggcagctcagagctctcagccctgcaggtgcacacatggctcagaagcaccactcctaaagctcctgtcgcagaaaaagcttggtttgttttttatttttttcatccagtcctgagctgctaggaacaagaaggagccctctgactcccagagcggagcccgagactccctcctgtggccctgaccttgggtttaattgctgtaaaggaagaacagcttccctgagtggcctagcctgccctcctcatagcagctgcagcaaaagtgccaggcgtcaccagctgtgccaggctggaggtgacaccctcctcctgcctaagagcacctgcacctggggctgactggctcccgagcgcttgctggggagcccgagccagggtgtgggatggggagcatgcagaggccaagctgtctagaaggctgttccagccgcccctgccccgagggattcgagccggattggcccccagcctcggcgctgctctggccgctgtgcttgcccgggtccggggaagccaccgtgttgctgctgtttcccaggcatctggaattgctggggtgggaggtgtgttgtccggtggaagtcatattggctgccagaccttggctttgccggaccccagatgcccatgtccaactcaagatcacatggacacgaactgcacctgctctggggcaatgcctgggttcagaaaggagtccctggcacagggatgagtttgcccacagggcaggtagcaagaccaagaccccctcctccagagaagcaggcagacgtgagccctgtacctaccaacagagagtgatcctcatccccacctctgctcctaggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtgaaaacagcgaagcaaataggcttcatcttttactccaggcttgactgatcggtggcgggcttccctggggcacttggctgaagagcatgaggctgtgtctgggtcaggaaagagaggtgatcgactggcattgtctgccacagcgcacatggaggcctgggaccaaggccattcttcaggatggtgcctctcggctctcaggtcggaacaggagctggaaagctcttcttaccttgctcgacctccctgttcttcaggtggcaaagcctcctgagagtcggcagcccgggaacacagaggagccgaagcagggagcgggcggggcctcagattggtgccctcctcacccacacagaagtgccagctcctgcctcagtttccccttgagcccctcgctcaccaggcccaggcaggagggacgtgctgctgggtaagagtctggtggagtccccctttctaggtgacctttgtctttgctgttgatttggacgcggttcctgcccatgccctcctccttgtctggcccttgcaggaggaccctctcttaggctctgccctgcacgctgccttgagatggggtggctcctctgcccaccttctcttccccctgataactgcctgtgtgtcagaagcagctctgcctctcctgcctgggaggggtgtgcatctctgtccatcccacgtgctcagtcccctcccttgtccccccgagcccaggttcagatcaggcccgtcagagcggcactgcgcagtcttgccaggcatgccctgcaatctgggaagagcgggaggcagatgcttgagggtatcgtggagccggggccccacagagccacacacacagcaaacagcgatctgggggcagcagtcctggcaggccccagctgccactggacgctcccaggccacgcggcccactgtggactgagctcgaacaaagctgtgggcagacgtttgggttacagatggctgtgaaaagtgggtttggccccctgagtctggggagggggctgcggctggagaccagggtgggggctgttggctttcacacgcttcaggctgaaggaacacctgcagcctccccttgctcacaggcgggcctggcttctggatgagacagctttgtgggagccaggggaggagaggaggggagccggctccccagatggcctggcctgcttcctccgggtctgcggtttggccatagacccctggattgggccggtgaccacattcatctcacggcccatccctgggggaaggctgaggatgaggggaggtcagagcccgggttccgctccaaattgtttctcgtggctgcagctggggaatgcacgcaacggcaccaccctgtcccgaggagagagaacctggctgcgctccctgtcccgaggagagagaacccagcacccctccctgtcccctgtgtgcttcccccgcccctgtggagagagaacctggcccctcggggagggcactgggcattgatgtgagcgcagcctccacaactcacctcccaagctcatcacctgcgggctccatccctgcgctgccagaggtcctggccccgccatggctcccaagtgcaccgcccggggaccacatcacaaaagacccaccttcccagaccccgagccaggtcttccagacctcaactttaaaaacaccgtttcgtagctatttttaaattttttttctggaaatattgataccatgacgctcactgtggctgagtactgcctctcaggaattctgagcaaactgttttgaaagtgcctacactggccgggcgcagtgactgacgcctgtaatcccagcactttgggaggccgaggggggcggatcacctgaggttgggagtttgagaccagcctgaccaatatggtgaagtctcatctctactaaaaacacaaaattagctgggcgtggtggcacacgcctgtaatcccagatacttgggaggctgaggtgggagaattgcttgaacccaggaagcggaggttgtggtgagccgagattatgccattgcactccagcctgggcaacaagagggaaactctgtctcaaaaacaacaaaaaaaagaaagtgcctacatcgtcaccggcagagcgctataccacagtgtgcagtgagacagccttgggccatgtgaaaagttgggggtatgaatgggacgcagaaaggttccattttgtttttttttgttgttgttgttttttttttgagacagggttttactctgttgcccaagctggagtacagtggtgtgatctcagctcactacaacctccacctcccaggtcaagcaattctcccacctcagcctcccaaatagctaggattacaaacgcgcaccaccacagcctggctaatttttgtatttttagtagagacggggtttcaccatattggccaggctggtctcgaactaccgacctcaggtgatccgcccgcctcagtctcccaaaatgctgggattacaggcgtgagccaccgcgcccagccctaattattgtattttttgtagagacaggatttcactatgttgcccaggctggtcttgaactcctgggctcaagtgatcctcgcatctcagcctcccaaagtgctgggattacaggcatgagccacagcacccgaccttgtatcattttaattaatttaaaattaatcgtaagtagccacatgaggctagcagccaccagaaagcacagccctggtgtgctctgggacccagtcgggcaggcacccctatgctggctggagcctggggtcgccccacttctctcaacactgatgggcatgagcattcctcaccccagggctctgagcacctcacagatggggggttgtgccaccctagcagtccctgccccctgggaggctggggaaccctctcctcggtgggcagatagggagacccaagcctagggaaggaaagtaactaactcagggtcacacagcaggggcaggaatagcaacctgggctgctggactcacaccccaatcattcggaaggtgggcgagcccagagtccctttggcttggggcatgtaggtcattttcaggtaacaaagcacttcccctaagcctctaaataaggaacttattttagataaaatcccccacaagggtcctggggaaattcctgtttcctaagtaagcagaggttgagcattcagacactggagtcagacctggggacacttcgagctccccggcttactctgggtgaccttggcacctaactttaggtctctgagcctcagtttcctcctccatcaatggaaacagaaactacatggcttcacgagattgccacggctgtgcatagcctcagtgtggggcaagtggcaactctcagcaaccacggggttacgcttatctgggtgtaggaggtgcgggtactgctggagcggggtaggggggacacggctgctgtctctgcaagaggaagaggataaccagcctgagagcaagagtgtgagtggggggtgaggtgggggtggggttgtcgctgtggcaggttccagagctggctaggattcccaatcactgccgctcttgggccccaggtgaggtacttatctgggagtctcagtttccctgcccgagatcggcaggctacaagtgccccccaggtgtttgggcaggaccctgggacccttctctgggctggcaattgggtgtgatcgcgggaagaggcttcttgggcctgctccgtgtctactgtcacctaggctgtaaagatgacagagggccggagtggctctccaggctggggcctggcatttcacagcgctagcgccgtgacttatggaccacaagaagctgtgatttatacaacgtgaggcagagctcctgggctcgtgacttcccttctgtgatgaagtgaagtgccttgcagaagcagcagccgcttagctgatgcgaggggactccgaggcccatccatctccctctctccccatgaggctgggcagcgttttgctgaagtggctgaacacaagtgcatctgttactgtctccagaaaccatcaaagagctgaacttgtccctgagaggcagctcagagggcaggaaggggagacccacccaggccagctgaggcagcttcaggacgctcagggggaagcacttggtaccacgcctggcacagggaggaggctcaggagcaagcttctctctcctggagcgacggcccggagtgcaaacatacccacctccagtgggtgccagcccaagtgtgagctttattggctcattagcccgcacggcatcagcctggttttacagatgagaaaagtgagggtcaggaatgtgaaatggcccgcccaaggcacactccctaagtggcagaaccacgcggaaagcacagccctgactccaccccggtctgttcagcgctggccccaccggcagagaagcaagctggtgctaataattccaccccacgtggaaccggcgcccagaagccccgctggatctttgccgcctcgtcttttggtgatagttgttgtcagggcttccctttaggtgggcgaaaatatctgtttactcaggaatggagcaatttcccaggcgagtctctaactagctaaatgcctggtcctgcctccgtcgcagggaagccgcccactgtgaaacacgagccactcagcagggaaatgtttaagcggcacccgcacccgctgcacaccgggagcagcggggcgggggcgggggcgttcccggtgattccacaccccggcccagcatggtgcctgtcccagaagccaggccacacccagtgaggcggaacagggctggcggagggctggaccctggaccactgtgcaggctgtccctgcactgagtcagccgggtttaaatggacgaggtcgtggtccactcggtccagggtaggtcaacagggcacccacaccctctcagccatgcaggggaccctgggggaagaaggctggattggaccgtggtctcaggcaggggcgtggtctggccccttcatcctgggcgtgcagggctgttccatggggatcgtcgcagagtagagtgcacagtgccggtgtgagcccacagggacagcatggaggagggggaggagtaggtcccccctcagcctttgcccccaccaatgctgacaacggtggggccagcagggcttcggccctggctggtggggcactgtggggtgggctcttccagtgtggagatgaccttgggcaggggctgcaggttccattcaccctgcaaggaagggggcaggaggtaaactgaggctggaggggcaagatgggtggctgcttccccagccacttcccagccacctcttggattcttgccctcaaactcagcttgtctcaaactgaactcactctgctcccccaagttgctttttgggggtcctcacctcagtaaatgccccctcccctggcttcccattcacctagtcaggaacctgggagtcatccaggcctctccccgcctctgtccccacccaatttaatcattcaccctagtgtagcaaccagagcccctggctgcaggctctgatattttttagctatctcttcccctcaaggctacaccaaatgccaagttttcaaccccatcagacgtccaccccacactattctcagcaagccagtattagcccttccttcccttggtgctgaggatgtttgacttagcagttaatctggctcccaaatgcttctgggaaggatcttcctggatctccaggctgcggcaccttacgcgactaactctgcataggccctggcctcctgaccacagcccagtgggcccaggataaattagatgccttcgaataccagtgggtctcagataaggaggaaaaaaccagctcgcagcttcagactggttcgtttcttaccttcccctcccctggtgctttatttttaggcaggttagtgcgccctgctcacaccacctgcatttggcattcggtacagtgtggaggtgtcaccagagagggtgcctgccctcccttccttgcctcgttattggttctctctctctccctctctctctctctctctctcctctctctctcctctctccctctccctctctccctctccctctctcctctctctcctctctctcctctctctcctctctctcctctctcctctctctctgctggctggctggctgtctaggcctatgtgtcaccacctggcacttgctctcattgtcttgtgcgagtgcttttgccagcagtttggagtgcagacccatcacccctcactggggccccccatgaggcctgcctgactgcatgccccacccgggcccatggcagcgcacctggaagcggacggctgaggacttgttgcagtgcatggagatgggcgcgaagctgtacagggccttcagtacgtcgcggttgaaggagttccagggaacagaggtgaactgctgagacacggacgcctgagggcaggtgcagacatcctcgttgttgaacctggtggggacaaggaacagccaggctggggagcagctgacgggcagggagcccagtgggcaccagcaacacctccctgcaactcgagtcctgtccctggggcaaccgtcctgccacctcctccccagccccgctgcctccgccaggccaccccagatgctgccttcaccggcaacggcctcacctctcctgtcaccttggcgggtgggtaatggctgctgcaggctgggttgaggaggctctgaagccaaatccagactcagcaggaaacgagtgaggggaggggtgagtgatgccgccacaggtctctgctcctagaacttagcctggactcctccaatctgcccagccgcctaacaggcccgaggttctgtgtcggggttccctgggggcagggagcttgtgcagggagccctcacctgttgatgaggtggaagtacttctgcaggaagccggcgtccacagcgctcttgcagagctccagctgcgtctgggggtagtagtgcacgtagttgacacacatctcctccaggatcccgaagcccccctgcaagttggaggagacccgtcagccccgggccatgccacgcagacgctgccatccagcagctttcgccgcacccacgtgtacactgcgtccactcgtctgttcactgcaccgtgccaggcatgctctggggaaccgagtccctgccctcaaggaattgccaccattggcaggagagacaggcagtgagtgagtgagtcaaccaggaaattcgtatcaggtactgatgatgctgtgaggaaaaatgaaacgggacaagcggatggggtgttattgtgcccattttatgggtacagaaactgagtctcagagcaggcaaggggatgccccgtggtggccacagcatcggtggcacagcctgagtgcacccagcgtcccggccattgtctggaagctgtccccatgacctccagcgagagcctggagccaaggactgcaagggaggccctttccactgcagccccgcaccgtccaccagtcatttctccaacgtggctctgaggggagcagggactctataagacaggaccgtgactagaggccgcgacaacctccagcctctcacggcaaccctacggcctgccatcgcatgggaggggcagggcaggcaccctctgagtccccactgccagctttaagcccctcgctgggttgctgctcttggagctggtgaccgtggagcctcagccataggaggaagaacagcagcagcttggaggagctggggctggagagagcaaagctcccccggcagcagctcagatcccagcaggtcaggggccgggacatgacgccctggccacccttgcccctccaggctccccgctgtttgtgaagctgctgtgggcctggggatttcatctggctggtggggaagaaaggcaatctttactctatggcagaacaaagggactgggcaaagcttggcgtggcacttacaccagctgccgccccctcctcccgtgcagacaaagagcatgggacagttctgcccagagacgaaacctggcacctgttggccaggacgcgtttttgccagcattgttctctgggccggattcctcctttcccagcttttctcatccatcccgcccccgtcagatcgggacgattgccctcctgtgtgagttcctgtccctccccaccctctgccaccacagacatcaaaagggaactgagtccgaccctgtgtagaatctgttctcctctttcacctggggaaggaaatcgaatttcaaaggccactgtgtcttggatcagcaggcgagggcttgtcagagtgtgagaagctcaggtccacctggggagctgccctcccctttgatcccacctggtgctgtgatgtggccactgccaagaggacgacatgggccagggaagccacagaactgcccacggggacgctggcaccgagggcctcaacctgcagaacggccatctgagatgtccgcggtgctcaccaggcctggcagccccgaacgccctgggacgtggcgtcagttccgccgccgtgaagccagattgggcagggaatatgcagtctcctcgctggatgcccggcaagaccctcccatccctggccccggggccgcgcctgcagaatggggctgatggtggggacttgcctggggtgctccacctgcagagccctctgtttgcgagcccactcagtcactgcacaggtgcttagccgagaggcggcacagtcggggttggcacctgcacccataccagccctgcctcctgttcgctgtgtggcctgagtggctggacctcactgtatctcctggtgggattgctcagaggtctcagcaaggcttggtgtggttaggatgagttattagagcagtgctgagctgtggcaagcacccgacatcagccactgctgtgatatactgagcacctcctctagagagaataaaggactgacaaagctgtcctgtctccaccctgagtttgtgatcaggaacctaggacacttgtcacctgaaatccaagggagacaggaagggtggggtaacagctgtgaggcacaagaccctgggtcaaatcccagctcagccatctatcagctgtgtgactttggtcaagtgcctgccctctctgagcctttatgtctcacctgtgaaaatacaaacactggctgggtgctatggctcatgcctgtaatcccagcatgagggattacatgaggagtttgagaccagcctggccaacatggtgaaaatccatctctactaaaaatacaaaaattagccaggcgtggtggtgggtgcctgtagtcccagctattcaggaggctgaggcaggagaatcggttgaactcgggaggtggaggttgcagcaagctgagaacacacagcctgggtgacagagcgagactccgtctcaaaaaaaaataaaatataaaataaaataaaataaaccactggcagtctgggctcagtaaacatcaggtgaatccacattggattaaaacacaaagaatagggctgtgacatggacctgagttcctggcgctgagggatgtcagggtagctgtaacccaggtctgctccacttgagccacacaattcacaggataattattggagaccaccatggttaccgaagcagctggcacggatccactggcaaggtggcccatttgccaggacagccctggcttgtgcctgggacccaggtaattgtgaacagcatcccctttggctcccggaagcagccccgctgcgtgatgcatcacgtggctgcccgtgtcctggtgctgcctgcatacccagccttgaaaatagatctctccagtgcagattctccttgaactgtctgcagtccagccaaaatgcatcctcagctgacgctcatcctgcctgacccccacccatgtctccaccctctcctcctctcctttccatcctgagaatgttcttggtcctctgggccttcccgcacgcagcccctgcacagagccttccttcacctcctcccctctcccctgggctccatgtgacagccacatttctgacaaggccctcccaggtccccgcacctctgcctcctcaacctggtttttaaagttttgttttgtaattttgcttgttgttagcagcaggtgctccaggcctgtctccctggtgcaccttgagctccacggggcaaaggtcaacctcttgtcctacagcttctccccacaccagccccgggtgctgagaagcttcttggtgtgagtgcttctcaaccttgagcaggggtcaacatccgctgggagcttgttaaaacatggattgcccgatgccaccgcctgtgtctctgactcagtgggcctggggtggcacccaggaggttgcattcatcccaagctccctggtgatgctgccactgtggttcagggagctgagaacgactggcttattgaggggacgagcccatgccctaagtgaggagtcaagacctgtcatccttcctcagatggctcaggctgaacactcgccctgggcaggtgcagggggaagcgggggtgacttaccactgtggccagctcccggtcttctgtgttgtacgtgcaggaggtgatgagcacatctccctgaggaaaagccaatgtgaccatcagcacctgccacctggcgttggcaggtgctggaggcctcgcccccataggaccacgccactgtgcatgccacggcacctctggggtacagtccctgtcgtccactacaaggagcccagcagattcatgtgcgaaggtcacaggctgagtgttcccgagcaagttataaaccatcagctcctgtgacccagtgggtcacaacagggccagggcccaggccagtgggggtgcagctggtgggccatgacacatctcaaaggacttgggcaagtccccaccgaggcctgggcttggccctctgtgggatcagggctccactgcctgccttagtgccctcatctcccccaaacactctcgggtttgtggtcggcccatcagactgaggacacgcgtcccctgggagtgtcctgtctgctccactctttccaacgtctctccatgaactcctgagtgagtctccccatgaggtagcccagcccagagccacccacaggcaccctccccctgccctggatggctctccctccccctatcactttctgtgtccctctccttctggtggcacccccagccctctcagccaccccagctggtggcagtgagtgggacagccttcccgctgggcactcaccggatggaccgacacgaccttcttcaacatgcggatctcctggggcaggcagagccgaggggtgggggagaggagacctcagagagctgcagaccagacccccggccactgtgtcctccctcaggcctccctgacctctgggggtgtccattttgccccagcctctacagtggaagccagagcccgctaagtgtggcttctggccagggagggcattagattcaaaccagaaggtggttatccaagaccaagattgatgttcccagagggccgcctgggtctcccgaatcccaccaccatctgccatgtgccagaggcctccctacgatcagacaccagacacccaagtggggagcacaggccacatgggtggggggcgggtggggctggcccaggaaaaagaagccagcctggagccatccctatggtgtcaggaaacagtagacccaggaggtcgtgtggtggcagggtgtgggggcggggcaggggtggggtgcaggttcctacctggaagtgagggctgtagtgattgtcctggttcacgatctcccactcccggccgtcccggaccagcactgtgaccacctttctcccagtcaggtgtgtgtggagctgagaggcgaagatgtggatcccggagggaggcagtgcctgtggggtcggggggctgcagtgtcagggcctgacccccgaggggaccctcccgtccatggccaggacccggtagggagcagccaccctgggcagtttgcttccctggaacacttgcattttctaggtctttctccccggccaggttagagccaccatcagaaacctcacggggaagagcgagggggccgcaacagcccccagctcccaaagaagcagcccctagtcccactcaggagcgactttctttccgagtccttcatcctctcctgagcccctgaagcctgacaggttcatcttcactcagtcaacaggcctttaaggcgagcctcccgtggacagggtgtggcaaagccaccaagctgagcagcgcgtggcctctgtgctgaagagcttgctgtccagggaaaagcaagtggcagaaggtggtacttggcaggtcccctacgtggtgggccgagcaggaccttcagctgccctgcgttgtggcttcctttcagcttcaaagcagccaaggctgcattctccctgtgctcagcatcaccccgtgctacagctgggagctgtagctacaactggaaggtggtcatccaggaccaagatggatgtgaccatggggtgctgcagctggacactctgaggctgcaggccggcctcacagaaaagatggcagccctcatctcaagaggtcttatgccatcactggggcatgagagaatcttccagagaacgaaagttttctctaacctaatgctaactttttttagatagaaaatgcatttccatggctgggcatggtggctcatgcttgtaatcccagcactttgggaggctgaggcacatggatcatttgaggtaaggagtttgagaatagtctggccaacatggtaaaaccccgcctctactaaaaatacaaaaattggccgggcatggtggcacgtgcctgtaatcccagctactcaggaggctgagacaggagaatcacttgaacccgggaggcagaggttgcagtgagccaagattgtgccattgcactgcagcctgggcaacaggagcgaaactccatcaaaaaaaaaaaaaaagaaaggaaggaagaaagaaaagagaaggaaggaaggaaggaaagaaagaaaggaaagaaaagaaagaaaaagaaaaagaaagaaaaagaaaagaaaggaaagaaaagaaggaaagaaggaaagaaaagaacacgtctttcctgaaatcgagcattttctttgtgagtcagttgtccttttgcccacccgctgccaggctctgcccagtttgttcatgcagtcagcaggtcccagagctcaaggtcccgacagccccatccctgaaggtcccagatggccgagctttttaggactcacttttgctccttccctctcgctcccaagcagcggccgccctgaccttgccgtcgcctatagctttgtgtcccttgcaatggcttgagaggccactgtgtgccaggcctgggagcccaaagggtcccaatgcccctttggcccccagaggccgaccctggcccagagatgccaggtgtcggccaggtggagggaggactatgctcttctgggcactctggtccaaagcagcactcttgtcttggcctatttcactgggatagctagactaggccagattttggctgcagaatttgtgcccctcttttatctgccaaaggagagacaagactgaacattctcattctgttacttaaggtagtggaggactctggcaaggggaggcgggtctgtattcctgaggctggagagaggcgttctcacagtcagcggtcagcggggtcgaaggccccaaggccctgcaaggggcagtgagtgctgcctggccggaagccgctcttccccatgagccctggccaaggtgccttttacatgggcccacgcttcaccagtgggcgctttagggaagtgggagagagtgtccacccccgtctgggacaaaaggagctgatttcctgccggagacaatgggtgccatgccggctgagagctccgtctcccttcagccttgaggaacctttgcttggaagactgggatgctctgggggctcacccacatgaagaacaaatcccaatcgacccatttactaggaaggaaaatccactctaaacctcattacaacgaaatctgctgtcacggccacagctttcaaagtcagacagactggtatttgaatcttcactctgcgtgactgctggcagtgtgatcccagcaagcctcagtctccccatctgtgaaatgggtacgtcaacacttactttgcaggtcactgtgagaagtaaagctaccgcacaggaggaaatgtttgtaacatatacacaaactatgaaataacatccatcatataagaagaactcctagaaaccaacagtaagaaaaacaaaccacctactggaaaaaccgagcataggaatgaacagaaaacaggaacaaatggccaagaggcagaggaaaagatcctcaagtccacaaatagaaaattcaagttaaacaacactgacatgtcttcctcccaaatgacagaaaatatttacaatattaataatccagtgggtcagtaaaaccgggcaccctctcgtcctatgtgtgggagggagcagaagatgggctttctgaggggcattttgcaagatttactcaagggaacactcacatctctgagcagcaatttcatgcctagaaatctacatgagaaaatggtttcctacatggacaaggatttcccagaagcttctttctattggtgaaaagttgagaacagcctagacactgattgatagggagacagttcagcacaggcttggaccaagatagggcaagcaaaggaggagattttagtagtcactctctgaactcaccagaagccaaggacaggacctgctgttggcgccagtctaagcgccaacctgtgcctccacccagcgtgcatagccctgaggacgggtgctccctgagatcctgtacccggcacttcactgcctcacctagtcctgccctgctcaggtgcgtggtgaaaaccccatcctgtggaatactatgcagcaataaaaaggcaaatcaccagaaaaatgcctcccatttgttgaaaaatttgttaactattcaatacaactttttaaaaacacaaaaggtttctaacacctgcaagagcttcctgaaatatacaggaaaaaggtctggaaggacacaaagagccaagaagtggctatctcagggggaggcggcagcggatgaggggagcgttctctttagctgcagtgcctgcgcttgtgagtggcaagtgcatgtgtgtgttgcttacataatgaaggcatattttaaaatgcagctcgtggaagcctggcacgtgggtgtggactagtgggagccatggttattgctggagagggaggtgcatacacacacaaatggcctctcagcagcagggttcccttgcatacagaaaagagggaggaccgcagggggattcagggtcaggggaaaccaaagctgtgcctgccacccttcgtgggccacgacctgccaggcctccactgagggacgcgggaggagggagggtgcagtgccgggcccagccccactcaccagctgggtgcacttgtccgtgcagtagccagtgaggatgaaggcggtctcccgtggtggaatggccatcactggcgtgtacaccagtcccagctccatgatccccgcgttgaagcgccgcagcttggctgtgtagtacaagcggatgcctgaggagtcgtttcgtcctgggagaaggtgggatggatggaggtgagcggtaagtggaggccctctcacttccccctgcggacagattatccctatgaccccagccaccctcagccaggaggcagggccggtcaccccccatctgctcccacctgctaggcagaccaagagctggctgtctttgtttccacacctgtggatgccaggcagctcgcaagatcaattaacgcaaacaggctacactcactgggaagaaagagctgctgtttctatgaaaactagttgaatgctatggaaagatgtgatcaacgtgagccacttaaagcctccatggaatcaggtgcgggtgagatgctgctgatagacggaaactcgtaaacaacttgagttctgtgctcagattgtttcataagtgctttgatgttcttcttccacgttcaaaggaacctaagctggaaatcagcctgcaagacggtgacaacctgcagggtgtggtctgggcaaagaagagggcatggaactcccatctgccgatggcacagaagagccctggccctgcgtcaaagctgggcaagtgtgagtgtatctctgtgttgaggttaacaagaagcattcaaggagcacatcctcccagcagcccccacttttactactttgatttatgtcctgcagacccaaggaacccacctaccaagctgacatctcaggaacaatttgagtgagaatgtggccccccaggaggagggccagcgttgcaggtctagcccccgttcatgcacaggccaggtcctgcttggtcaacagcgtgctgtgtgctctcagatgacttgctgtccctttatgagcctcagcccacactcaagggcctcttccaaaggaataacatggtgcttcttcgagtcacggagactgtgtctcctgattatggtgtggccacacctgttagttctccttgccgtttgctaattggagagtccctgaagctccctgggccagcctcccagtggtcacatgaaactgatggtcagaggtccagggggccgggcacggtggctcacgccttgtaatcccagcactttgggaggccgaggtgtgtggatcacctgaggttgggagttcgagaccagcctgaccaacatggcgaaaccctgtctctactaaaaatacaaaaattagccaggtgtggtggcacgcacctataatcccagctactcaggaggctgaggcaggagaatcgcttgaacctgggaggcggaggttgcattaagctgagatcgtgcattgcactccagcctgggtgacagagtgagatttcgtctcaaaacaaaaaaacagaggttcagggatgctggcacccactcgaacatcctcacaaccaggtgtcatccaggtagccccaccgttcctgaaactccatgcctagtgaatcagcagccaggctctgagtaccggctgggctcatggttggcggaggatctaaaggcctggccccatgcccccggatgcatggtggacatggtggacatggcggacatggcggggtggtctggaggggctgtgcagcaggaggctctgccccctgggttatgtacaggaaagggatgtcaggcggcaaggagtgtgaaattgacaaggggttttaattcacagggaagaggcttctgatgaagtttaagtaaaaaaacaaacaacaatgaaaaaaaaagatataaaattctagtcacaagaaaaaaattaatgggccagaaaagcagtcaggacagacacatagctgggtgaccagtgctcacttcaaaacttggagccgggagctggggggtggtttcatcttcttcatgcttttctgctgtccatcttctcaccagtgtacatgcattgccctttctgatcaaaccaagagggtggtacagatactaacatcttccctgggtgccaaaaatgctctaagcataacctacccctttcatggaagttttgcacagtgagaatcatcagccctatttcacagattaagaaactgaggatggagcctgaactgaagactccacacaagaccacagggctgggaagtggccaagctgaggttcaaacccagggctgtggactggggtgcagggcacttccagggggcccaaccatctccctacttgtttcctttaagatgaggccaaaacaactcctcttgcctctgccttcttccctcgacacccctacaccatccaaactcaaacggctcctgtatctccaggctgattacatcagaggataataataaaaagggtgttgcaattggttaaaattcagatggggattaaatcatgaaataattgtgggattttgatatttatagaaaagcagcccatctcaagatgggtgaagtgacaggagcgtccttatatttggcaaaggatccataaatacaaccagataatcatgaagagacagacttccctgatgcttcaggagttttcaaaaatccatttgctttcagggtttaaatgagcaataaatcccgtgtcatgctaaggcccaagctgacttatacccttctctgtgcatgtggagataactccaacagtggcggaaggtattacttatgcagccaggaaaaaaaaaaaaaaccacaggcgactgttagctgagcacagccccgtgcccacagcaagttctgtgcgtgagcctttcccagcttcacaatagctgtgggaggtgggagaacaggcagcgggtgaggtcatccacccagcgtccccaaggtggtgaggcacagcctagcacctatctcttaggccacttctgcaccttgcacaaatgaaaagaagaagcaccattcagagagagagaaaaagtgtgtgcatgtgtgtgcttctgcgtgcatatgtgtacatgtgtgcatgtgtgtgtgcgtgtgtgtgtgcattgtgtgcgtgtgtgtctatatatggtgaaagatgctggtgcaacagagagagggaagtatttttttcagtttctgagacagcatcacctggccttgccatgctaaaagctgaccctgctcactccaccctcaggtatgggtgatccaacagcagctgccccagctccccttcccgtccctgcactctggccaggccggagcgcctgtgtcctggaatatgccctgctttactaccacctccctgtttatgcacacacctctccctgtatttggaacttggcatctggcagcttcccttatgaaaattctccttgtcctttcccctgggatgcacagtgctgcgccgatggcagcccgtattatagggacgaggagggaggtgtggggccactgctgggccctggcgaagctgtgaggagtgagcccctcgaggtcctgtccctgggagcccaccacagccatggaagatggacagcggatgaggcagacgcaagggcctcgtgccaagaggagctgtacagcgggggcaccatgctgggcagacgaagggcgggatttgctcactggctcaacacagctgagtcctagggcttctgaggaggatggcagcagagccgcctaccttctatcaccagtgggttgtggtagtgaacttccaggcggagatatctggaggaccctggacccccgaaggcaaggccggcttcctctgggtagtaaaatgcctgtgtggggcaaggtgtcagacagacgggtgtgtcctgagagggccccaggtctgggcaggggcaaacccagtcaactgttggggcctgagcctcaggggtggtggagggggcgcagcaggattagagcgatgcttcctcctgacaggcagctcattacacgccccaggaacatcctgtgagactcgggtcagggagttggggagaggagctggtgcctagggctgagccttcccccaaaaccccttctctagacgggtgtaagagctggggagacccccatcgtctcagcctgtggaggcctcaacactggccccaccgccagccagccctgggaccacctgtacacaaaaccctgactccagttgggaaacagaatcaggacccactgagggcataaggtcctgcggcacttgcgtttctgtggaaaataaaaaaaaggcttgaagcatttcagacatcacagaggcgagggggccacctcaggcctggcccttctggtggcctcgtgagcccccttgggagccccttcttgaagcctctgagacggtgaagctggggaaacagaggtgtggggatgccaggggcccaggcaggagacaccatgctggggtcgcagggcacgcaccttggcacccagggcccaggcggccagcacgtggcggcagtagttgaggcggtcgggtttcatcttggagtcgcagggcccgctgaagtgggggacgctgtccatctcgggggcgcactggaagacttccatgtggtggacaagggcctcattgcccttggtgacgatgggctcgtactgtgaggaggcagccctctgagcccgggaaccggccgcccaccctcccctccccagcagccctcctccatgggcttccgaatgcccatctgtaaaatgggagggatgatccagacaatttcaggggcacttctggggttcacagccttgagggtggagccatcagcccagaaagaaatcccgtaggcagctccagagtgaaggaaatgaggttcgtacaggccaaggcagggacaggacgcagccgtcctcatgcatatggggctgtggccgggccagctcctgcagccccagtgggaggcagggcagccctgaggttagagcccgggcccaaagcgcaccttcaaggccatgcctcttcctgctgtgtgactctggacactcacataacctctctgagtgcaccttcaaggacatgccccttcttgctatgtgaccctggacactcaacctccctgggccacacttcctctgctggaaactaggggctcttatgatgaaggagggatcacctcgcccctcccccgggactagtggcatagtggacactcgacagctatcgcctttgctattctgtcttccccggacgggtgttcgagagcaagtgagttctgactcgagctgctttttcatgaagggggaggtggcctggcagacagacagcagttccagtcccaaggaaagatgcagaagtcaagatgttggtcactttggtccaggcagggaagtgggagctccaaggccctttgagggtaggggagtgagcagagtgatggggaagccaagaccacttgctgctcccctgctcaggcaggtgcctgaggttccagtgataagaggacacctggtccaaccaggactgtggacagctctccagggtcagggacaacccaggcccgggaggaaggcagggctgggcgaggacctcggccctggacccgcacgtaccttgataatgtggtgccgagagaagccctttggaagctccttaatgtagcaccagtacgtggtctcctggctggggatctggatattgggagcttggacctccatggtgcacgcgtctgagggcaactccggttcggggatattgggcttcaggagctgcaccctctgcagccccatctgcaggcccgagccgttgatggcctccagtgaccggaacggctcctccaggatcccgtagaccaagtggacagtgccgtcctgcagccgagacagggttcagctggtcgccctctcagagcccccagagttgggctcctgagaggatgccacatccctgcccacccacacctaccaggtgacacacctcactctcatctctgtgaataagggacccttgaggcttgcatggccctggctggggccaaatcccgggctgacgacccccaggatcccctatttgcaccggccatcaaatacttttctcttctaaacacattccacctacattcacttaacatccattcaaccagtgactactgggcccgccgtgagccagtgtggccggaacatttgttccctccaccaaccccaaggtcactggggactgggtgtgggggatcattggtcagttcagcagcccagcctgaggattcagtgccctctatgaagggaaggaaacaccctggggcttgctgatggtcacgctgagctgcggagccacgctatattatgtagtcaccaccagcttggcaggaggggaccaagcagccacagaaagctccatggatctacgcggtgctggaggccacaggcagactcaggaggcaagctgtggggctggcttcctcacatgctgtcatgaatggaaacggggatcgggtgtggaaagtgcctttcatagctttctgggcactccacagtgcagacccgtgtgggtggctaatttgctctttgagtttgcggaaagccgatgggccgccctgtgcaggggacgcccagaactccaggcaaaggcccctatacctggcctggggccactgggctgagcacacacaggcattggcctccccctgtgaggtgcttccagagggttctctgctcacccttgcctcgtccactgggaagcagggtaagggctcaacaacctcctggaagaacacctcttctggcaccaggtctgccccagcacaccccgaacccctgggtacatccactccccgtctccgggccttagtttcctcatctggcaaacagccagctgttctgttttcttagattccgtatttgtctatttggcatctattaatggattgcaggctcaaacagatggccagagttgtttacacctgcccttccctccaacattcacgcttgtgtgagaatcatattcccaaccctccaacccgtcccaagcccatatccttagccacctcctccacctgactgtcacacaccaggccaatattgcctcagccctaaatcaccctagggccaggaaccaggcaactagagaccaccccggccacccagagcccaccagaattgtccaaatgaagcaacttccctgccctgcctggcctttcccatggaaaccccaagaaagcctcaggcctgggctctcccctagctcctgcatctgcctcctgaccaaacccagggctctgcaggtggccctgcacggcacaggtgccccttctctccggaaatgcaatcaatctttcgatggcactggcctcccgtgtggtcactcagctacacccatgattaagacctggcactaacggccagcccaggccactgccacaccaaaggattacttacacaagacaaaagctgtcaggtgtgctagagttaaaagagttttgtcttcaagggcaaggtgggttgctttccctaagaggttggggggctcttagagcagcataagaagcctatggcttttacaatgttttatggctcccatgaactcccagagttggtcaggccatacagatcatctagttcccatctccattttacagatgggcaaagtgaggtccagaggaggggggcagttgtcccgagcctcacagcgagctggcaacagggccgggatggaaagccaggtcgcctgggctccagaatcccacctgatggttaacaggaccaggaggagagagacatccagaagcaaggtctagtccaatgggagaggcttcagcacaagccccgcatctagaaaccatgtcagctacgtgttggcaaagagctgcgtctttgagggctcaggggcaatagcagagctggaccatcctaagtgctttggccccaccactgcctctggccatcctccttggctttctctctgtcatagctggccaggcccaggccccagacttatcagggacaggaaaggtactatgacattggcacaggatggcagcatgatacacgcagcccacgccctcctgggtactcgcggccaccccttacttcaatgaggtaatccttggggtcgcaggtgccaaagggcctcttgaaaagcagggtcaggccttctggggtcctctgcacctgcagcagctggtagtcctgctggggatccaggtggatctgccccttctggtcactccaggcgtcctgcagagacaagcactgggctccaggcatgaaggagccaagccgggccaatccacaggggaagagggcattccccggcagagctccgcattcattgccagctgatctggggatgctgggcctcagtccctgtggatctgagggttctgcctggggctgtggcttcactcacaccttctatctccatttctgcctggagacagtggagatgagccccgacagtggagttggttcctcctctgcagccaggaaccagggctgtcacttgccagcaggtcacaggttctgttagccatgggcattcccgggcctggcgggcgggacactgagcttcttaagaagatgcctgaggctcccaaggcctcctcaagactgggaacaatgcctcagaccaatgctgcccacattcatgcaggcaggagagttgcggagcctcagaaaggggagagttgggaacagggtgggacatgaacaggaaaggagagagaaaccagggtgccacatctaagatggtgattgatagcaggtgcccaccctgcactggcacaaccctgagaacaagcactgctttattactttataaatacatgtaattttggatttttttttttttttttttgagatagggtctcgctatgttgcctaggctggtcctgaactcctggcctcaagcggtcctcctgccttgccctcccaaagtgctggaattacaggcatgagccaccacacccagcctgaagcaccactttaaaccctgcagcctaggcattgttcccctcaccttagtcccagccctgcttggagaaggtaaactgaggcccagggaggcattggacctgctgcattctccgaggatgcttcctgggatctggatcagtgacctctgccctccccgtctccggccgctccccttgcactgggccctaaggggcagggacacggtggcccgaggccaggtcacatggaagaccaccagggagacccactgagagacagcgaggagccttccccaacaagcaggctgcccttcgtactcaagaagggcccttcttagattccatatttgtctatttggcatctattaattgattgaaggctcaaacagatggtcagagttgtttacacctgtcctgccctccaacattcacacgtgtgtgagaatcatattcctaacattccgacccacaccaagcccatatccctagctacctcctccacctgactctcacaccccaggccaatattgccccaaccctaaaacaccctagggccaggaaccaggcaactagagaccaccccagccacccagagcccaccagaattgtccaaacgaagctgcttccctgccctgcctggcctttcccatggaaaccccaagaaagcctcgggcccttggccttaaggactttgggttgtgtttctttttaatcttacattcagggtaaaacatcttttcttcatttccttgagaaaaaagaaatctgcaaaagatactgcaaaactttccctagagaaaaaagccacacaatgcaaccccgctggggacaccgctggtttgccgagagactcattttaaacagaggcagaaagttcgcctgtgatatttcagctggaaatcaagaagatattagttgaacatattgcttagggaggaataataaggctgacatttgctttcgtaggaatttgttgtgcaaattaaccttgccagtgcacggaaaggcaaagtcacctggcttcctctggcttccctagcagccgggaaatgcaggcaggggggacgctgccccagagaggagcaaatgctcctgcactcagggtgcctcatggcagaggcttgcgaagaaccccaaactgtcagcgatggggttcagctgctcctccagacggctgacggctcagaatcagggctgtcccaggtctttcttggctggaacctgagccacagagtgtctttgtgcacaggaatctgtgcagccctatgggtcagagcagggcccttcccaggcagctccactcaccctacctgggtggccctaagcctcactagcgacacaggcaagtgcctcctggccgagtcttgggaattggagggggcaagctcagctccagaaacagcagccaccatctgccctcatgaattcacaacacccaaaaaggcagagagggactctccgccccaccagcccatggtgagaccaagatgcagagctggagccggccgctccgcacagacacagctcccccgctccagctcggcactcccagataaagcaggcacctcctgacttcagaaataaaacttttttgtcactcctttgtgtgtttctgtggagagagttgggtttcatccacaaagaagccctggtggccagtcccatgtggaaaggaaggctggagcaggacccattgtaggcggtgggctcgcccacttcggggaccccctgcagcttgtggaagggcctaaagtcccctccagtttgaagggaaacttttcccctttctccaccctgtgaaacaagagtggaggtaaatttggacggaaaggagtcaagagcccatcctaacagttttggctgagccctgtggggcttgttcaacacctatgggtaggggcagggtgtctgcacctgctcagttggtccacgggtacaagcacagtaggtcaggctggatcccatgggtgtgcaggcctcatgctgtgcccagccacgcgccaccacctggcccacatcagtgggcatgtgtgctctggggacgtggtactaggcattgtttacagggccgagggtcgtggggtctgtgctcatgcgcgtgtggggtgtggagcggcacgagtgtgtgtggtgtgtgcgtcctctgtgtatagttccattccttgggattactgggtcccatgatttggggcgggcagtcaaggaccatggaaagcatgtctttcctattttgtcctcaaactgagatccccatgatgcccaagctcggggtgcagacttggctcagagcagagtcaactcaaacactgacaggtgacagaagaactttctgggttaaggagggtgagtgcagaaagacggccagatggggtgccgggtcaggaagggtttggagagctggcagggaggagagactcaccgcaaaataggcagtgtccccatcggtccagagcaccacgagatctgcgttctcaagctcgccacggtcggacatcccaaacaggacgccagccttgagcctccgcaccaggagctggaaatggatggcctcctgggtgtagctgacattccatgagagctccagggacccctccgggtccagggggatgtgataggggagggggctctcacggggagccgagccctgcagtgcggccaccaggatgaccaggaagatggccactgctgtgctgtacatgaaggctgcctcccgcatgctggggccgggcaggctggcccagcgactgagggcgggcatggctggggtgagctctctggtcccacctggccatttatgccctggtcctgaatggggtgggtccaggcagcacgggtaatcacatttgtctagcggggaatccaattttccctcccacaagcttgcgccccaggccaagcactcagcctgctgccctcctctaattggcactaatgacacatggacgtcatcagtgggagttgaagtagacaggcggatgctgtcccttctgagatggctctgaagagctgtcccaaaagcagatgcaccctgcagccaagaggcctttcagacaccctctggccaggcaccagctgactgcctcacaggctgtctggcccagtccccagtgggatggggtctgcgtcgcctctacccacggatgagcagactgaggtccgaggagctgctccaggctgaccagtgaaggataggcccgtagccactgcaggcctggcctagcgagcagagccgtttgtacaatactagcaggtgggcccatttcaaaccaaaaataagacaatctccaaatagtccctgtgtttagacactctctccacggcctgctcttcccacttttgtctcctctcaatttttccacagcctccagctggtaccactgctgctccagaaggcgcgagagcatcatagggagtgggggacatgggcgtggggtgcattgctggggacagacggagctggagctgcacaggggataggcaggctgcagggtgcactgctgggggtgacagcctttaaggaaaagagggtgagtgacaggcctgctcccctgtctctgaagctcccaaacccacagcttcctcttgcccagagcagatctggcctgaatttgaagcctctcagggcagctggccgcagccctgcttctcccacacctgccacaggacctttgccatcatccacccgtgggcccgagggtcagtctcaccacggcacctctccctcctgtcctctcccacaagtagactgagggcagctgccttcaggacattctgcttgatccctccagctccaccccccaggctgggttgacagatctctccagctggactagaagctgtccctcctccccagcctcctccctcccttccttccttttccctcctgtttctcgtctctctggagaaacccagaatctagccttaggggcacattcatgtcataggctgacagcaacatttaggtccttaaatacccatgacagcaggtctggaggctgcttcagctctgagctctacgctgtagaaaggaatgactgtgtctttgcacgaacgtgaaatttggagaaagtgccagccttcccctggccctcgcaggcagtgctctctgccccacagtggccaggccatcctgcaaagccaagctcaggccatgagcccctccccactgattgcacccagaggggcaccgttcgcccccacccacagcccaggcaggtgaggtccaagtgcataatcacctgtgcaatagagtgtggcattggtgtgaaattgtctcccaggccaggggaaagacactcttgggagttctctggtgagccttgggaagggtctcagcctccgaaggcctggctttcccatcaggacatgccacctccgtcgcctgagagcacctcaccttcatgcctcagattagttccaaaacctcctcacctgtgccttgtaagcaggtgtctgctgcatcccggacattcactctcgggactggggagcggccacagcgagccggtgatacgaagagcctccggggtgggcaggcactggtgttcccagcacgggataacaaaagccagcagaggcagaggtgagggtcacgggctccacagcacacccagctcaggggtgagccctcccagcagcctggtggccacccaggtggctccagctagacaacaggctaaacgagcaccagctggggcccgcgttgtgggaaggggggcacctctctcccctctggggtattgaggccccaggcacccctcctgctcctccggggtcagagctctggggtcatatcctgctccgccctcctgaatgcgcagctggcgtcctcagagaagcgctttccaacccagcgcctcctccccatctacagacacaggaagttggatgacaaggacaattgatccctccagcttccttcaacccagcggttctgtggagcgagaggcagtgaagagcccctgatgctaccagcccttggacggctcaacacacctccaggcctcgctcctctcccggatacgccaaagaccaacagctgctgggagctctaaggagggacggcaggtgcggtctcgtgctcagcagtgttatgcacacatgtttatttttaacaggaatcaaagacattttctttatccaactcaaaactggctttcctctagcatttgacagaaatgattcagctgattccaaaatactgataactaagtcctagggagggacaggagacacaagtcaggccgcaccagggcttcccctgccctgcctccatcctggccagccttgggtggctgggtgtgcgatcatccctgtctcagacacaggagagtcagcctcggagaggcgagacaatgcgcctgagctcacagggtgggccagtgcctggggcaagcaccccaaagagggtgccctgagctggagggggctgcacaccttgtcagccaaggtcagaaaaattccactggagtcaagaggaagggacgctcaaatgaaaaatgcaaccgcagagaaaatctgcggagactggggccgggcgggagggagcgaatccaatcggatggccccgtggctgcgcccttccttgcattaatggattttaaaagggagcaatccgaccccagggtaaggaagcaacagtcagctctcctcctgccctcaccctcctcagaggtgacacctgcttgccaggtgctctcttggccacatgcctccctgtggtgccccgcggggggctttcctccctgctcccacccctgctgcctctgctccagtgtctgggtgcacgttgccctccagaggtggcggtgggggtggggatgggaatgggggtgggagtggggttgggggtggggtaggccggggaggtgcagggtgtcacggccacggtgtcaggaaataagccccattcctgctgctcagcgcctggcttccctccaaggcgcatcgacggctgaccttgtttagaaccaatttcagctttttaataagccctttgctttcctgaatctctctgatgccatcagcctttgcaggctgtaattccccatcgcctctgccacatgaggctggcttctgctgacgtcctaacctcaggcagtgacaaccccaagtggagcgacggtggtgcagactggagctgggtgagtgaacaggccaggccactccccagtgacaacggggcctggccacaggacagcactgtccctcgcctgtggctcaggctcttagggacctcctcttggcaggaaaaattcaactatcagtctgatggcagtgcctagacctgacttgtgatgggatggattgggagctgctgggagacggtgactctgtccatcacagagcccactccagggtggcacagtccccttggggaacttggggcagctggcctatgtccctcctcgtcctgagcataggggctgcggtatgaaagttaagaggcacattctgggctgggcacagtgactcatacctctataatcccaggactttaggaggcaaagacgggaggattgcttgaacccaggagttcgagaccagcctggggaacatagcatgacccagtctctaccaaaataaaaataaaaacaaattagccaggcatagtggcacaagactgtagtcccagctactcgggaggctgaggcgggaggatcgcttgagcccaggagtttgaggctgcaatgagccctgactacaccactgcactccagcctgaatgacagcgaacaaccctgtctcaaaacaaacaaacaaaaagcatatcctgcctgaggaggcagcggtggcaccatgcctctgcctctgctcataagcgtaggtggccgtgagagtttgaatgcttgggatatcccatggcctgaggtgtccagggcctggggcactgagtagggtggctacagtgggatcagcatgaggactgggcccagggcaggtcacagaggtgcccagagcaccactgaaagctttcctcagctactggattagaggcaccctctggccctgaagctctgtgccaaaagcaaggggccactgatcccagaaggggtcggtatcgtgagccccagtgacactcccctggaagctcccagggaagcagaacccaggagtctgtggctggctccagggctggggctgccaggcctgccaggccactcctgtgtgaccccaagcagccccactgtgagcaagtcctccactgtcactggcaggcggctggcctgggcaggacacagcctcccccgcctccatctctcctccatacacaggggtcagcgagatggggaggtggactctcacacctgcgtggcctgcacccccagctctgggctcatgctcacatactcagttttacacacacacacacacacacacacccctccaataatttggcctcaatcttggggctgaggcctgctgggccctgaggaatcttacagggaaaccctttctgggtcctgcttctccttttctccataaggatgcgtgactgctcctctctcttgagcagctcatggggggaggtgcatgtgcctgatttttgcattttcagcttttctgaagggaccacactgccaggatggtggtgggtcctgaggcagtagctccagaccacacccaagccacagcgtaactgtgggcaccagatggaaagagaggccctgaaacctgccggccatgtgacccacccggacagtccccacagccctgagccttctttcctcatctgtgaaatggccatcttgctcaggaccggcactggcgctgacttctggctacagaggctgggccctgcgtggcctgcaccagcactcagggctgctggtcttgccccccgctggctcctgccagccatgaccctcttcctgaggctgtagttcatctgtcagtaagcttggtcacctcagagatccaccaggttgacctaccattgacccagaatggggccgatgcagtgagggctagcgagacagccccgggctgccctcacccgcatccatctcgggggctgctgcacccactgacatcacagggtccaacaggcagggctctggcccaggagggtctcggagaacatgagaatccgcctccctccctggaatctctctgagcttctggcgtgtggtgtgacagacagagggatgtcccccaatggccacgtccagatccctgcaagtcgggtaggctacctggggaagggacattcagtgtgattagattaaggacccggaggtgggaggtggtcttggattggctgggtggaccccatgtcatcacaaaggtcctacgagagagagaaggagatgcattgatggggtccaaggagaggaggctgcttccaagacggagcaggggccatgagccaagggatgtggaggcctctggtagctggaaaaggtgggaacagattcccctcccagagcccccaaaaggagccagctctgcagacaccttgattttagagcttctgacctccagaactgtaaaaaaaaaaaatcgtgttgttttaagcctcagagtttttggtcatttgttacagtggccacaggaaatacaagcgccctcctctcctagtgtctgctggcaccgtcacactctggtgggacccccaagtgcagtcggagactgtgttcccttctttttgtcctgttatggttttggttctcccaaaagcagacgctgaggcaagggtctggatgtgagcaggctgtgtggaaggagagctcagagtgtgcggagacgggtgggcaggggagtgggaacactcacgaaccgtactttcataatcagtttcctccatgggcagtagggactcagttccaaggggaccctggagagactgtggaatgcaccccaaaactgtcacatcaagggtgaagaagccggggccctcaccttcccacacccatccctcactggcagaaggacgctcctggggtatcagagcccagcatgggggctgccggctggtgggccaagtccactcacacagccaagcccaccccagggtgggaggggggggcagagatgcaggaagttgtggggtaccagttgccttgggcaggcccaggagatgggggttgtggtgagaattgagggtcaatgccctttgcaccatgccatgtgcagtgggagccctgtgtgggacagctgtcaccaggttgtggtctgggctcccgagtcctgagatgccctctgagtccacaggctcgtaggagccgtgtctgcagcccacctgcctcttccctaggcgagcatgcaggcactgggcgttctcgtgagtgagggcacccaacccttccaagtcacatggaggccctgactgtcaccatttcacaacttaggatgccgaggcctagagacaagtggcactggccagggctccgtggtcatgggtggtggctgcagagtggtaggcctggaagagcgtggcgtctggcgtccatggagtctggagaggaaggctggcctgggcctcccgggcggttccatgcaggctctgctgactctcaagatgggggctatggcagcctcagagtgggcgggcagggttcgagtgagctgcctggcaaaggctacaatgccagcgaccagccctcagacccccgctcagggcttatgggccacttcaccaccaacccctggagctcgcggctgccacaccccactggacacagacctatgtggctgagaccggcgccacccagcccaggacccccggacctgccctgactccctgggccttggctgagaacaggggacttgggccccaaggtctgagtggtcagtcagccctcatcccaccccccatgcccatttcagggccaggtgttcttggaaacctgatcccagagatgctgaagggcagagcctcgcaggctcagcagggcttccactggcctcagcgcccagggccgagggggcatctgtggtcctacccgggggcaagcaatgtggaggctgaggctcaggagtgctgtcccttgacatttaggtgagtttcactgggagggacatggtccttatcccagagaagtaatcaagacaaaggcagaaagaggcaggtgcatgttcctcaacctctgtaccttgtttcctcagcttatggggacagtgacagaattacactcgcatttcctcaggctgggggctccccgagtcagtgcaggcagaggctggaccatctgtgcttagtgagggctccctccacggtggcgagctctatcattataaacatccagacaagcctgaaaaacacggcgcagaatcactccctcaaatacgactaccattaacagctcaatatgtcgtctgtcagaacagcttttcattctctgaaatttttaaaattgtttattattgatttgtcacatcatgtaaaatgtcccgccttaaccactgtaagcgtgcagttcaatggctttcagtgcatattcctattaccgtgcaaccatcaccaccatctgtcttcagaacgcttcatcttgcaaaactgaagttctgtgcccatgaaacaacagctccctattccccctcccccagccctgggcacctaccattctactttctgtctccatgattttgatgactctaagaccacatagacatagagccatacaggatttatcctttgtgtctggtctatttcactgagcatactatcctcaaggtgaatccaggttgtaacatgtgtcagagcttccttgccttttaaggctggagaagagtctattgtatgaatgatcacactagatgtatccatcatcagtagatggacagttgggttgcttcatcttttagctgttgtgaatcatgctgctgggtgtgcaaatacctctttgaatccttgttgtgaattcctttgagtgtgtacccagaaatggcattgatgcatcctgtgataattctacttttaatttttgaggagccatcactgtttgttaaatggcctgctgtacacactgtcctgccactggtgttttccacgtgcatgttggatatatgttgagtatacacgctcagtgctgcctccgcctttgacagctctcaagtatcccactgcaggcatggtctctgattgatttagccaactccctgttgataaatatgtgggtcgtttgtttcttaaactatgagtgacagcggtgcaactcttgcctttgtctgccggccctcatacacttgtacccacggctctatagcatcagtcctcagagcccgggctgtggagccaaggactttgggctccctaattgaaatcaacccacaggttcaaaaggctttggtcaagggggatgctcagacgctggctgttatgccaccagccaaaggcacaactgcctccatggaacaaatagtttctaacaggtaagtaggtttaaaccctgttgatgggccaaattagctattggaccaggcagcctccctccagctacaatcaaatgcatcacatacataaacacaaattcaatcaagcctaagccttgccatctgcttttcaaagatgagactttggaaacaagcaggtctctgtgcctgggggcttctgacattcacaaagtaagaagcaggcaacgatctgcacaccctgatccaatttcccctctgctgatcaagttatggagagacttggccccataaggccctggggaaagggcgaattaaaatgaccaggacagagatggtctgtgtcacgtaggaggtgaggaggtagcatgagctacagtgctgatgaggatatctttctgggtggcactggtcaatacctggagcaacaggatgtcttggaagtgctgggattgccaaaggcctgtttggtcccaggagaacaggtctgggtttgaagtgtctcagcatggtgggttggccaaggccactgaaatggtttggatctgtgttcctgcccaaatctcatgttgaattgtaattctcactgttggaggagggactggtggaaggtaattgaatcacgggggcaggtctttcctacgctgttctcatgatgatgaataggtctcacgagatctgacggttttataaaagggagttcccctgcacatgctctcttgcctgccgccatgtaagatgtgactttgcttctcctttgccttccgccatgattgtgaggcctcccagccacgtggaactgtgaatccatcaaacctctttttttttaaataaactacccagtctcaggtatgtctttattagcagcgtgagaacagactaacacactgtcctcgtgatagtgagtgagttctcataacatctggttgtttaaaagcatgtagcacttccctcctctctctctcctgccaccctgtgaagatatgcttgcctcccctttaccttccaccaagattgtaatcttcctgaggccttctcaaccatgctttctttacagcctatggaactgtgagtcaattaaacctcttttctttatacattacccagtatcaggtagttctttatagcggtgttagaatgaactaatacaaaaaattggtaccaaagaagtggggcattgccataaagatatctaaaaatgtggaagttactttggaactgggtaatgggcaagaggttggaacagcttggagggctcagaagaaggcaggaaaatgagggaaggtttggaacttcctagagaattgttgaatggttttgaccaaaatactgatagtgatgtggacagagatggccgggctgatgaggtctcagatggagatgaggaacttattgggaactagagtaaaggtcactctcactatgctttagcaaagagactggtggcattgtgcccctgctctagagatctgttgaactttaaacttgagagagatgatttagtgtatctagtggaagaaatctctaagcagcaaagcatccaagacataacctggctgcttctaacagcatatactcatatgtgttcacaaagagatggtctgaaattggaacttatatttaaaagggaagcacagcataaaagtttgggaaatttgcagcctaaccatgtggtagaaaagaaaaacccattttctggggaagaattcaaagttgcagaaatttgcataggtaaagaggaggcaaatgttaatagccaagactatggggaagatgcctccagggcattacagaaacctttgaggcagcccctcccatcacaggcctggaagcctaggagggaaacataatttagtgggccaggcccagggccctgctgctctgtgcagcctctggacgtggtgccctgcatcctcgctgctccagttccagctgtggctaaaagggactgaggtacaacttggccattgcttcagagggtgcaagccccaagccttggtggcttccatgtggtgttgagactatgggtgcaaagaaggcaggagttgaggcttaggaacctttgcctagatttcagaggatgtatggaaatatctggatgtccaggaagaagtctgctgcaaaagcagagccctcatggagaccctctcctagggcagtgcagaggggaattgtgggtttggagcccccacacagactccccacaggggcactgcctactggagctgtgagaagggggccatcatcctccagaccccagaatggtagatccactgacagcctgcaccatgcacctggaaaagctgcaggcactcaatgccatcctgtgaaagcagctgtgggggctttgccctgcagaatcacagggatggaggtccattccaggttcttataaatggtcacctcttgtggaattcctagtgccaatctctttgtctagtctggttgatgttgtcacccctgtggcagaaatcatctgttgccattaacagtacatcaatatggtataggagggagtctattgactgattgattgattgaaatattccaaagccttgggagtgcaccccttgcatcagtgttgtttggatgtgagacatggagtcaaaggagattattttggagctttaagatttaatgactgccacgctgggttttggacttgtatggggcctatagcccctttgttttggtcaatttctcccttttggaatgggagcatttgcccaatgcctgtacccccattgtatcatggaagtagctagcttgttttttattttacaggctcataggcagagggacttgacgtgtctcagatgagactttggacttgaaatttaagttaatgctggaatgagttaagactttgggggactgttaggaaggcatgattggttttgaaatgtgagaaagacatgagactttggaggggccaggggtggaattatatggtttggctctgtgcccccacccaaatctcatgttgaattataatcctcagtgttaggggagggacctggtgggaggtgattggatcatgggggtggatttcccccttgctgttctcatgatagtgagtgagttctcatgagatctggttgtttaaaagtgtgtagcactaacctccttcactctctctctcctgttgccacatgaagatgttcctgcttccccttcttcaccttccaccatgattgtaagtttcctgaggcctcctcagccattgctcctgtacaacctgtggaactgtgagtcaattaaacctctattctttataaactacccagttccaggtaattctttatatcagtgggagaacagactaatacagtcactgtgtggtcattgctaagagttcttggtccattccaggttcttgtaaatggtcacctcttgtggaattcctagggccaatctctttgtctagtctggttgatgttgtcacccctttggcagaaatcatctgttgccattaacagtacgtcaatatggaataggagggagtctattgactgattgatggattaaaacaaagtctttctccattgtctgggctggagtacaatggtgtgatcaaagctcactgcagcctcgacctcctgggctcaagcaatcctcctgcctgagcctcccaagtagctgggatgacaggtgtgagccactgtggctggctaattttccaaaaattttttttttatagagatagggtctcactatgttgctcaggctgactcaaactccaggcttcaagtaatcctcccacctcagcctcccaaagcactgggatgacaggtgtgagccaccacgcccagcctaaccaaaatatcaaccagcctttcccacatttgtacagaccggagctacaaggccagcatcttgaggggcaaaggggagctccaggtgaactggaggctccagtcagagagaggatgtcatatccccagctcagagaaaggcctgggagttttccactatgtttgtggcttaagcattgtattagtctgttctcatactgctataaagacacacctgagactgggtaatttataaaggaaagagatttaattgattcacagttccacgtggctggagagggctcaggaaacttacaatcatggtggatggcgagactaaagcaaaggcatgtcttacatgtcggcaggtgagagagagtgaacaagtgaagggggaagagccctttataaaaccataagatcttgggagaactcgctcactattacaagaacagtatggggtaactgcccccatgatccagtcacctcccaccaagtcccaccctggacacacggggattatggggattacaatttgagatgagatttgggtggggccacagagccaaaccatatcaagcatcctgattatcttctgttgtgtggtctcagaatgtcaagcagatccaagttttagtctcaacccaaaagcatcattcaaatgaaagaatgctacctcttggtggtgggtgctccacccagaggacctgccagtgcctcacctgtcctgaagaaggttcccttgggcatccaggtgaacacgcccttcggagtgtgttcaatgatattcttggccttcagtcaaacggcaaactaagtatatccccaacccccatcaaaatcccacagttgcagaaaaatattttaaaagaaaaaaattacaaaaagattgattgtaaaaaaagaagatcaactaaaagtctttttagtggatcagacttacgtacaaatcacagaaagacgcaaagaaacaacattggaggaaaccacaccccagaaggtgttctaagatggcagcagagatagcctgcagctccaccgtcatggccagggtgggtggacgacagtcagggtgatgagttgagttgttgcattgggaccagcaacttgaatatctgctcctccccgcaatggtgggcaacagggagcctctgagcccttaggctgagcagagtagtcactgtagcagggcagtggccagagagctactgacctcaatgaaagataggaactcccaacccaagggagtgactccctgccgctcagttggttgcatattcctccccatcttccatcagaggcacaggagcagacacagcagtggcagatgagcagggactcttaagtgcagacagacataggcacactgcctgcaggaccaagcgtgtaggaaaaacaatcccacaaaagagagacatcatctcagaaacagaaactctgatgcccagagaagcagcatagattgagtcaacagaagaagccttttaaaaataagtataattactatccttagagagataagagaggttatctattcatgaagcaagaatgggcttttatataaaagaactaattagagatcatggaaatttaaaatagacaggctgaaaagcagaaagagacagctgaggagcaaattagtaagcaggaagatcaggcgggcgctgctcgaggaactcagcttaaagggcaaagtggaggaaatgagaggggaaaggtaggagatctgggggagcttcgggtccccagcccggggagtggacatctccaaggtatggagccaccaagagggaagaaagaaagtggttagacatcccagagccacagaaggatgtcagtcttcagagtcaatgaacctgccaggtgctgcacagaccaaatgcaaacaggcccacaatagacacagtgcggctgtttcccattaaccaaaaacagagcgagggctctgatgcttccagagagagcaggagagcaagagcctgagggccaaaccgggaatgagaatgagggcgagcagagagggtctccatggaggaagaggaacgagaccctgtcacccttcatagcagcagcatcgggtgacaggagaccacggatctctcctgcaaacttgtgagaggaaacgttgtggaatctgccattccaaacccagcattctagtttgagagcgaaagaaaacattcaaacatgcaatagttctgaaattttattgctatcttcctttctgaaagaattactcaagggtatattctaaaaaaacagaaatcttggccgggcgcggtggctcatgcctgtaatcccagcactttggggggccgaggtgggcggatcacaaagtcaggagatcgagaccatcctggccaacatggtgaaaccccgtctcaactaaaaaaaaaaaaaatacaaaaaattagctgggtgtggtggtgggcacctgtagtcccagctacttgggaggctgaggcaggagaatagtgtgaacccaggaggcagagcttgcagtgagccgagatcacgccactgcactccagcctgggcgacagagagagactctgtctcaaaaaaagaacaaaaacaaaaaccaaaatcttaacccaaggaagaggaagcctagggacagaggacataagggagaggttaacacaaacctttaaaacatagagttaagtctaaagaattgtgtcactatcatagtagactcccttacccacagtttcactttctgaggtttcagttacccgaggtcaacagggatctaaagatattacatggaaaattctagaaatgaacaattcataagttttagactgtgtgccattctgagtggcgtgatgaaaccttgcaatgtccctctctatcacatcctggacatgcccagcatctccacactgtctgcgctgctggcttgttagttgcttagtagctgtcttggtgacaagaacaactgcccatagtgcagtgctcatgttcatataccccttattttactcagtaatggtcccaatcgacaagagcagtgaggctggcaatgtggatgccaaaaagaagccataaagtgctgtctttacatgaaaaggtgaaagttcttaataaggaaagaaaagaatcatatggtgaggctactaagatgtacagtaagaacatatctgttagctatgaaatagtgaaggagggccgggtgcagtggctcatgcctataatcccagcactttgggaggctgaggcgggtggatcgcttgaggccaggagtttgagaccagcctggccaacatggtgaaaccccatctctactaaaaatacaaaaaattagctgggcgtggtggcgtgtgcctgtagccccagctacttagaaggctgaggcaggagaatcacttgaaccagggaggcagaggttgcagcgagctgagatcacaccactgcactccagcctgggtgacagagcgagactccatcaaaaaaaaaaaaaaaaaaaaaaaaaaaagtgaaggaggaagaagaaattcttctccaagcttagtatctatagggcttagccctatcctaggttccaggcatccaatggggtgggaggaattaccctactgccttctttgttttatgaaatatttcaaacataagaaaaatatagagaatgatgatgagcaatattcatctgctcacctccccgatcttccatgtgtttatttgctgtatttgcctaatatttttaaatcacagattccattaagccccttctgtgcttctctaacggaaccatattttcatcaactgtctaattgggttatggtaatgggagcaaaaactttgacttaaaaaaaatgtttattgtgtatctggccaacttgctaaactcgtaattgtgctaataaatcttcactgggtttgcttgagtttaccgagtggaattttccaagtgttagtgagcagtcacagaactgcctcctctggttcaatattcttgtctttcatttccgcttctgtctcgtgggttcaccagccctcccttgctgtggctgatgtggtggctgggaggcagggctcaactgcttcctgtaaatgctccttgagtttcccacctgcgggatgcctgcggtaggtgctgttcaatccccgtcagtgggctactgagtttctccccgtgtctttaaatcatcagtggtgctgactttgattagctgctttcccagcatctgtcaagatgatcaggagtttcccaaccctctgttaatacagacctgtggttctcaaattttgtggctttaggactcttttgccttcctaaaaattattaaagacactaaaaactttatatgaagaactctacaaagttttgctgagggttaaaaaaatagaaattctaaataaataaagataaaaatcccaatccttaatgggaagaccctgtaacgtggtaaaagtaagatcccgctgtgtggattctaaggtatacaccttctgcactgaaacatccctgaaacagatacattttacaatcaagggcatatctcagcttaactggcagcattgttttccttccaagtagtaaatacaataatgatttatcttaaaagaaatgatgtctgatttaatatgcactctatatatcttagcttattcactctgtcaaccctgcaagtagcatcggtgttattattactctatattacaggtaatgaagctgagagacagtgaagtcaagcaacttgtccaacatcacacagctagggagtggcagagctgggattcaaacccaggtagtctggtcccagagcctctgccactctgctccacttccgaaagggttgaattttttaaaagtcatctagcgttcaatccagtcttaattaaagcccccaaaggtaaaagaacatggactgggatctcgaccttctagataacaagtgctccatagaactgtggtagccgcatcggtcatgcatcagtgaatggacagatgaatcgaagggtagggtggccagggccagacacggagtccgcggggaggaatgcgatgtgtggttgaatgcaggttgcacctcaatagggaggggagtgacaatgggttattcatgtgtcaaaaaaaaaaaagacaaaaacagttaaacctctagctcacatcatacccacaaaaattctagatgggttgaaaaccaaacatacaaatcagagcattggccaggcacagtggctcacgcctgtaaatcctagcactttgggaggctgaggtgggtggatcacctgaggtcaggagttcgagaccagcctggccaacatggtgaaaccccatctctaccaaaaaaagatacaaaaaattagctgggcatggtagcagatgcctgtaataccagctactcaggaggccgaggcagaagaatctcttgaacctgggaggcagaggttgtagtgaccagagactgcaccattgcactccatcctgggcaacaagagcaaaactccatctcaaaaaaagaattagagcatctatgaagactgtgaagacacagagacacaggaatgggggaaaatgggcaaactgaggtatgtgaaagcactcttacctgccggcagcaaacgccaagtcaacccttaagaggtcattttctacccagtgggttggaaggaattgtacagattggtaacatctgggatggtgaggatttggggagaaggtccctgccccacgtgggtgggaggagggtcccaggaggaaactgatgggtcattcaaacaaagacacccaagagggtttaataagtgaggttgtttacaaggaggggccagggaaggaaaggcatcggtgaaggtggataaccggtgttgttagcacactcctgtgtctgaagggatgaggaaggagaagtttctgaccccagaaggagagacctgggtcaagagatccaaccctactacacacggccccacagagagggagccaggggtgcagacagccccacaccttcctccctccctcccattggccatgcccaggaggaggctggaagtcccaggagatggttggtgacatccgtaccagacagattcctgggcaaaaaccaaccaccattcatttattgcctacgtggctcacggacacattcccacagctttccacccactcttgtgagctgcaagccatcacacagaaaggaggcagggcgtgtttctggggtggggaggctattcaaccccagaaaagtccactctggcccgagcccctgaaacccagccctgcccaccacacacagacatgaggctttccagacagagggcctccaatggaggggcatggggcagcagggagccctccccagctactccaaggggaaaactacagttcccaaatgtgacagggttccagaggacacaggacatgtgctatttgtttggtggtggtattcctaccccaacttttcatcaaaacaaaacaaagcaaacgcaagctgagagaggccaagccggcatcaggaagggcagggttcctcgtgtgtgactgtgactttcctaacgaggacggtgtccgagcaccatttccccctgcagaggcgggcggcaccccagggctttcagaacggggcccttgaggggtaccagaagctctaatagagagagcgctcactcccctcctgtaatgtgctgagctctgaccccatttcagggtgacagtggtcagccatgagaccaaggaaggcatggagggaaggggctggaaggctccgtggtgagggctggatgtgtcctggctggctgtccccgtgcctgccatgctgcctgctgtgatgctgggagcagctcagtggcagggacgggcatcagctggcttgctttggaggcactcgaccaccccgcaaagcagcctccctgcggcctgcgcatgctgatttccctccagatgttctccccaaagcctcaggcacccactgctctcacccccagcccccaaagccagagcgttgccaagggaaagaccaagaaggcagagcccttcctaaccagggaaggagggatgacctgcagggtggatcctcagaggggctccccagagagtccacagggccatcaggaggtgggcgccacagcaggggcccgagggtggaggccagcctgcaccactgtgggcagctcagcctcccagctccatcagggccatggagactgtctggccaaggcccctcccacgtccccctctcgcccacccaccactgagctctttgggatgaagttggtgagatggggactcccaagaccagcacctggtggctggagttgggagcaccaggaggaagaggagggatttgtggtacaacagcaggggtgtgagatttgagggacaaaagcagagggcagccgctgctgctgggacaggcacaggctttttctccagctctggcctgtggagcatcatgccaggtcaagacgccagatggtcatgctcaccaccatactgcacggctccacaccacacatggagaaactgaggctcagagaggctgagagaagggctgtgttcatctatctagaaatcagggggccaggatggagccccattctgccggactccagacccatatattcccacagcactgccttgggacagaggagctgagctgtatgggcacccccagatctacatccccaggccccaaatctggacctcccccccagttgtgcacctgacctggaggagatggcggcagctccactaggccatccaccctcagagggcaagacagttcctgccctgttcattcctgcatcccagcacccagtgctgagcctgcacacagtaggtgctcaataaatgtgtgagtcagtctgacttggcccctagggttaagaggctcatgttcaaatagatttaaacaaacagttgcagagaaaccagcattagaactttgatcaacgcattatatgctgcctttgaccctcccggtctcccagaagctgcaacatttgagctgtgccttgcagggtgtgtaggagtttgtgggatggagacagataggaagggcacctctggcagagggaccagcctgctaaaggcagtgaggagtgagcatttggaaacagccagtctgggtatagctggagtaacaagcctgggggcggttgtggggactcaaacggtggccgcggggtggacgccatcctgagggtgaagaggagcagccaaggggcttgtgcaggggaaggctgccctggctgagggtgctcaagacaagggtcgatgcaccggggcggggaatggggagggtgcagagagggaggctggaggctagaggcctccctcttcagcctagggcctcgtgccagggtccaagtgtcctcagggcagattggctgagtcgagctctgccccttctctagggagccagcggtgcagggaaggaggctctgggccagcgctcaccactgagctattcattatctctgcacccctggccggtcgcttgcctctggctgcctcagattccccctccgtccaatcacgatggccggtggtctcagtgtggggtttccagagcagggggaggctctgctgcctgccacctctcgtctgggtgactgccaatctcgggccagctgtgtttgcaagggacgctgcctctggctccgcagagcggcaggcagacgctttctcacgtgaacatctttcattcattcaacaaacagctgctgtgactggtgctgggagacagcagagaacaagaggcacgaagcccctgcccttgtggatgtgccattccagtgcagagaggcagggaatgagtgaccaaacagacgagactgtgccccgctccccttccccaagtctgcggcagattgtaacagggccaggcccctctcccgtttcacagcgggagactaacccggcagcagggttcatctgctcctgcaaagacccatagctgatgctctttctgcttccccaagccagccagatgaggagggaggtggcatccaggccagggcagaaggggcctggcctcctgtggctcccaccgcccctgggtgacacagcactggcctcatgtcctcgctttgccacaaccacctgcttctgcttccccacgattacccctgccattctcctttctctgctcccacgccctcctcctcctcacccccatccaaatctgccattgttaggcaggctttgggactggtggcttggatagagtctgacaggagagcaatggttaagtccaagtttttattctttgtgcccaagaggagactgtgtctgtgaggtgagtccttgggtggcagagctgccccacgggtgctccagagactgtcctgaggggaggaactgctctgcacggctgaaatgaaaggctggcatgtcagtctggcatgacattttattgtcatgtcctgacgctggcctgtgtcagtcaccgtgggtgttctcttttcatccttctattaaaatgaacagcattcagcaacctctgcaacccttgctaatagaagcagaaaagttatgggaaaattgcttcaatattaggttcccctagtccagataggcaatctccgattttcatttcttattttctagtgtaatagactaagggtcacaccccaggcataggacatggtctgggtggacttcggagtcagatgggtcctggcctcgggcagccttgggcaggtcattcactttctctgtctcgggttctttactgtaaatccggtaaaatgaatgaatcgtgcctgtctcccagggctgtcagcacagttcaacagtaataagcacaagacacatgctagctatcagccgggtggtccctgtcctgcctctgcctgcctcaggaggccctgtcccatcaacctttgaaactctcacctccctctgagctcatgatgacgaggactctttcctctgtctctgcgcccacagtatgtgagggaatgaatgaacgaatgtaggcatggcctgcatttatttgctcaagctgtgaagaagtgctttggctgagaaagtaaaacccagattaggagtactctctgttaatgtttctctggagtaaaaaatccctgcaatggaggaaggctctgaaacaataaatcctccataactcctgtctcacttcttctcactctgcagcaggatttgtcaagatgatccgtgattcacagagggagccgggagagaccccttgacgggtccccgagcgcctctcagccccatctcctcctcatccatcatctgcgatgattcttaaagaacgaacacatcaagcttgctgtcacaatgttttaaaatgttgcagtaattaaaaaccaccggtaatttcttttcacacagatgaggctgtcttttcaaaccagggcaatggaaacaccccacacgctgcacacctgagcccgcgcacgcctcccactctgtccgctggcacactctgctgcccgaccctctcaccttctcttgcacactttggtacctcgtcattctcctggtcccatctaaaagacgtccaatctaacagacccaggatgcgaggcacactctgcctattcggcatcacagagtaatcacagtgacttgcagttacccatctctcaatagtttctttttaaaaagttcatctcttctctaaatgggcttgatcttgacctgcacagatcatctggagttgagtggacacaggttcagtgaaaacggatcaaaggggctgttgctgggctcagtcaatcaactgcagaacgtcttatggctgcaggctaagaagaggaaacaattcaacgaccaaacaaaggttaatctagtaactgcggcaaggcccaggtaatttccataaatatgtggaaacagcaaccacttcaatagtttggcctggcaccaatatgaggaggagcttggaaaaccggacgtggaccccctttcagtgccctgagatccatcgagcagctgaatggaggtcggtgctgggggccagggggcacccacacagaccagtgagcagctgccccttctggaatctcacagacttctaacaccgaggggtccccgggtgccagctgtgctgcaagtggacagccagcctctgctcagacatgtctggagatggcgagctcctcccttccagagggttcccagaaagggaataggagaagctcttggccatcattctcattactctccacatcctggcagaaactttattcctcgagcactttgttctttctgcctctgtagaatgagactcagccatcaacagcagctgctcacatcctttgttcccaagaacgtcgttccctccattcgagtgtgcaggggactgtgcatgggggtgcaggtgtgattggaatgtcagggtttccccgccaccgctggttttgttttttcctctatatccagccaatgagcacctcttgtgcacatatagatcctcagagagaaagaaagcctgatgcctcttcttcatgaggctgtaagtctttgagcaatgaggctatccaactcgactccaagaaacggatgcgcacagaggtcctgcttgtatagtgtcaggctgatcttacgcaagccccatttgccctaagtggaaaatgaacctttgtaaactgccacccatgaaccaatgtgttgggaggtgttcaaccaacttggccatctgttgaatttgagttatatccacgaagctctgttgtggaatgatgctggtggtggggacagagtagctgccgttggctgaggttgccacgcgactaaacagcttattgtagtggatggagaaccagtccggcggcagaatgtcactcctcccacccccgggcctgtttttggccaacctaaaagaactgcgtgtaactaggatccttttttttgcacgcaccaggagaacttgctatttagggaatcctgatgatgaattgtttttataaagtcagaccagagactcttccttgtctttctctcccctcacccatttttattttctgaaattggtttttgcttaaaatcagggcatgcttttgcacataaataatgagtttggtggtgaccatctggcattgcgatccaaatgaaatctattcagtgtagtcacctctttgctggctgtgtgaccttggccaagtcacttcacccctttgttaccatctgtaaagcgagggcaatgcaggcatctactgtacatattgtgggtaatattcagacctctttcaaataaaatgggctccattttaaataaggtttcgtcatcacgggcatcaggaacacatctctctccacagcatgggaaagaaaccagcatgtcaagaggccaagagctacagagtctgagctggttccacagaggtttccagctgctcagatctatagctgcaggattctgcagagtttgagtaaaaagtcagcatggggagaagtggaagggcattgagctggttggtaaagacagggcttggcagtgatgttgcttttaaaattcttggcacacacttgcaactctcaaataaaaaacaagttgctcagttgtcataatggagtttttgactaaaagtgatgatttaaaggattcctgtgtcaactcctaggacatcgattggctggctggtttgtctcttcctcctggctctctctctttctgcctttctctctctctccttataaggaatttctatccgtgtttaccatccttctttctaggtggggctggttgggaaggatgtagaagttctagaagaaggggattaggagcaatggcttgggaatcaggccgatccgcctcaggtctgctgctgttgagcctaaagttttcacctgcaaagtcagggtaatgacagtatccatatctcatcggatcgctgagaagactaaatgaggcaatgctcgcactgtgtttagccttgtgtctagcacgcattaagcacataatgagtgatgtttatcatgagacaagtgcctggtgggagcaggtactactcgcagttaattaatgaatcaaacacagcccctggtcccttgggaaatgaagcaggtgatgtttaattatcctgcttggaagagaacaagatactcacagggggcagggaccagcttttcccattagttaagaggaaggaggactagcctggtttgctataagaaaactctctatggtcaaagtgacctgatcagcctggagaaactcagcaggggcccttgccaggggccccagcaggggaggcagcaggctggacatttggagcatgtctgtatggtgtgaacactcactctcttgtccatgggcaagttgctcacccatctgtgctcagcccatctgtaaaagggaaatggactccaagcactttactcttctgtttgtcctcagtattctcatgtctagaatgaagcaaggttatggttactaccaggatggagtttttttatagagaacttaaaggttgatcataatgaaagcacacatttaaggccaggcgtggcagctcacacctgtaatcccaacactttgggaggccgaggcgggcagatcacttgaggtcaggagttcgagaccagcctggccaacatgacaaaactccgtctctactaaaaatacaaaaagaacaacctgggtgtcgtgacgcatgcctgtagtcccagctactcgggaggctgaggcaggagaatcacttgaacccaggaagtggaggttgcagtgagctgagatcacgccactgcactccagcccgggtgacagagtgatatggctcaaaaaaaaaaaaaaaaaaaaaaaaaaagcacacatttatatggtgctttcccaccaggcacagctctgagtgctgtacatgttctaacacaaaagccttcctaacattcttaacaccagatttctctccgttcagggtccctgcgaccgcaggctcagctcgaggacctgcagaaacagggaaatgcctcctggggcactcctctcaggagtaggagccttgggtcagaaaggtctccctcgtatccagcccaaatctgccttgctttaacgtctagccattggtcttagctctgtgctttggggtcagggagaagggatctgctccccttccccgtggatgtgggagagatccaaaggcagccgccatgccccaaacagccactcaccaggagcagcgtaagccttgctcctcctctcagttgctccggggttgctaactcagagaagggaaataaatagtaacaaaggcgagcatttattaagtacttatggtgtgccgggcctcgaaacatcatcggatttcattctcagaccaaccctaaaggtgctggtgttaactccccattttaaagataagaaccagccgctcaaccaggataagggacttgccctactgcggataagcagcagcttcggcctgactccagatcccaacgttgtggaagccggaacgccccgagaacaggcggagagcggagggagcaccgcagggcgccggccagggtgggggcacccccaggcctccaggaggtcgcgcgtcccgggcgagagcggacgagccgtcagcaccagggacagctccccaggccgctcccggcatcccccgacgactgcgcgcgcgggccggtgacgcgcgctccccgccaggctcgggcgcgcgccctccccgccagcgcgcgccctgcgctcgggaccaggctggagccgcgcgtgcagctcgcagggagccagccggggcgtccggagtcgcggccgcagcgcggagctggcaggggtgcccgcctgggcacgcagtcgcctccccgggggcctcccgggcttctcagcgcccgcctcgcccgcccagccacaccaggcgccaccgccgtggcctgggcatgagcggccgccgctagctgcgccctgcccgggtcggacgcccgcccgccccgtcacgtgcgcccaagtcctcgcggccggggcagcgcggttcccatgcttcaaggtaagggccgagcgggccgcgggtcacggggtgtggggcagaagacgcaggctggaaagctccagctaggtgcccactcgtccagagtgcccactgcagcctgccccggctgcctcgcaccaggtcccctgacccagctggcgtcacccatcccctggcttccaccctcaaagcgcatccccgaggaggagactgagacccaggtgggcacgagggcctaagggagaggtgggggacccactttaggaaggggggcttcatttccctcggaacagtggcctgggggcagggggcagtggggagggaaagtttcccagaagagccctctggaaacctggccgccttctctccctgccaggagctaagactttttcatttgctgagctttgccttcttccagagtcggtgctgcattttcatcccatcccattcacccaacacccacgagaaaggggcattggccccatttcacagatgcagaaactgagtctccgagaggtttggtctcttgcccacgatcacagagtggggaagtggtggagatggcctcaaacacgccggcctctgtcaccaccacctcacacctttgtctgttaggaatctctgcttcattgacaggtggggggttgcctaactgacactaggtttcctcagccagaaaagaaaagactctacacaccaaaaacccaagagatattcaacatgggtcctcagggctccactgtctcaccccactcgtgtcctgtcctcccgcagccacggactgcctgggcacaagtggtcctgccagtgtgtgtcccgtagcaaccccgatggctctgagacaagaaactcaagggtcaagttcatggaaccttctgcagggtaaggggagtatccttgaggcctgagccccagcattcgtcctagcaccttccccagtaagcaggagctcaggagagccagcgggccaccctgccagccttctcccttgcatttccctcagcccctgccaactcacgctcttcagggcttctggggagagcagtaattaccaacccccaaaaagttcagggttgctgggaaagcacctttgcccatcttcccaccttctccctcttatagaattgagagtgaagtggaggtgaccagggctctacccacctgagcaggtgagaaccagcacttcctgggctgggcaagggctggttttaactcttggtgcactgactgcaagcttcctaaacagcttaggtgctggcagcttgtgaaaaaatctcaccctaaggctcgggggcccaggaaatgtggggttttgttcattcggtcttgcacttgctggcagtttgttgagcatctgcacgatgctatgaaaagacccacagggcagtctttgtatcctggatccagctgggttttggtttccctatcagctgagtttccaatggggccggcttgtctagactcagccggaaagcttggaaatggctcccgaaggatctgggggtctgggaaggatgcacaggctctcccagcctcagtgccccacttgcatggggagggagtgggagctccagggtgcattgctggactctcaggacgtgctgacaccactcagaatcctggcacacagaggtgttgcagcttctccaccctcgcctctccagcaggtagggcaaggagccccacagagctcctcctacccttgaggctggagtccccaacacacgtctgtcatgccagtaccatcagcaaacatgagcaagggcacctggggaaaggtgggcacagatggagaagtcgggactcgagttctgtccacctttttgggtgaccttgggcaagtcactttcctctctagacctcagtctcccatgtacaaaattgtggggtggatcatttcatgtcccccctctgagccattacagctctgttcatctaagccccggatggagtaggaaagctgggaggagtgcagttcctccctttttgccatggtattgagggagtgcagagcagttttgaaatcttcggactgacctgagtccaagcccccagtccgtgccaaccctactccctactcacatgatcacccccgttttgtatatttaggggctggctctatattcctgacttttctggtgctggttctgggtgaggcttcacagcatggagacccactcctgcagtgagacctctggctcctgccacgtgggcctgcctctgcagcctcatggcagcgggctccagcgaggaataattacagcactcgggaggggagagatgtattacatctcagtcaattacctctgactctaaactctcggggcaggaggggaggcagagcagcagccgagcccttgttctgtcctccactccgctcctggccctaccgccacttccctcttcagagtagcaagtcctgatctgtgtgttggtaaaatggcaatttgtgtggcagagagagtggtttccaggccagaccacgggtgcatcattccgcatccccatctgcaaaaatgagggtgctcctgccttccctgctggcacatgggacaccggggcaaccgtgagcctggccaaaaggcttttggatgccaagagcatgtggtcctggggaccaccctacagaggccagggtggggctggggggcttctctgccagctgctgccacacttggcactggtacttcttgcagtgtctcagtctttctggatctgctccagaggggatttgatgagttccgaggcctcagtgtttgccagctccctccctccgttgctgaatcctcccgcaggccttggcccaatccccgcttgctgggggttgctggagaggggaaggaatcctgttgcccctggggtgaagtgggctggtggaggtagagttgaaagcccagctttgctgctttctggctgtggaaccctgggcctgaaggtcttgggctggaaaatggagactgtgcctcctccttccctcgggcctcatcagtgaaggaggaggctggagagtcaggtggggtccggttccgccaggcttgtaagccctgctcagtggttgggctttccgccgcagtccacaggaaccaggctctgggagcccggagggacatggttcgctctgccctttagggaccctctctggctgcaccatggggaatgacttggagagggggccctgcaggcaggaagctggggaggaagggaaatgatggaggcctggaccagggtggtaagaagagggcaagtgacaagcatgttgagggctggatgtttgtgttggggtgatgggagacggcctgagactgcccaaatgtcactcctataccactcccttaagtcaggctcaggcagcgccggacgctcgggatgggccgcacgtaggcagtgaggttgcggccccggggccctgggggaggactgttgtttcagcagcagctcagtgtcagagccatcatcccactgggctggatgttaccgcctgtgctctgggcgctctcagccctcggggagccgtccgtgcctgtgggagtgggtccctgccggaccgagctagtcacctctgcccttgagctcagttttcccaggtggcagaggtggaagaaggctgcaccagctagggagctccggtggaggctgggcagggactgggacagagaccccaaaacaaaccaggctcccagggctgccacctcgtccaccacattccctggctactgagggtggcagtgtggctgagtggacaagagcacagcttctgtagctcagcagagccgtgtttccatccaagctatgcgtccctcgtgaggttactcagcctctctgggccccaggttcttcattcataaaatggcaatcattacatccgcctctgatgtgccagcttacctcccagccagcagactgggagaagagccctagcgaaaacctcttccaggccagctccaccccacgcagccccgacccgtgctcacttcctggctctgccgtaaggtggcctcggggcccacaggcctcggtctgcacctggcaagcaggcaaaccccacatcgtggggcagccttggctcctgacctcagtgttcacacacaggcaggatcatcgccacctccatctccgttcctcacgaggaggtccacagtttctgtgtgcaacaggctggccctgtctgggagctgggcctgctggcaggtcccgggtctctggagaaccgtcctctctcttttgaaatcatcctaatttgcatttgctgtatctggctgcactaccttatagacatcaatctgaaatcgtgctactccagatggggttcggggaccagcagcagcagcagcagcatccctaggaacccgtgagaaatgcaggttcccaggcccccagacctgttgtaaccggcccccaggtgattcctgtgttccgtggagtttgagactcaccgcccaccacggcagaaaagaggttctatttgcataaagcaagggtgactgtctccttcatgctccttatatatttaacttcatatattaaagggtgtttgaataaaagaaatacatgcttgcagtaagagaaaaaccaagctattcagcttttgttggttggttggttggctggttttttacaaagtaaaagcccccggtttcctgggtgtggcctgccccccagtgctcggctgtgtcagtgacgtgtgtgtcagccacactgggcaccaccgagagaccagtctgtgtgtgttgttccctgtccttttgacttaacaggtcttggttgtgtctgcatgtcgacaccctagtctgtcattgatttacctggacccatatcagtaaacagtcatgtaggccatccacaggttttattttttgtgtgtgttcattttatatacttgttcactcaagtaatcactccagggaaggatttcatagttggatgagggatgtgcagtgtgaatagaaataaataggccaggcgcagtggcccatgcctataatcccagcactttgggaggctaaggcaggcggattacttgaggtcaggagtttgagaccagcctggccaacatggtgaaaccccatctctaataaaaatacaaaaaagagagccgggcgtggtggcatgcgcctgtaatcccagctactcgggaggctgaggcatgagaattgcttgaacctggaaggcggaggttacagtgagccaagatcacaccactgcactacagcctgggtgacagagtgagactctgccccctcccccaaaaaaagaaaagaaaagaaatagcaatgcaaaagcagctgtccatggattagaagatgggtgcaaggtagcaggtgccccagattcaaaggaatgtacaccctgggctggagcaggcagggaaggcttcctggaggtggtgcttgagctaagccctgaaggattagcatggagcaggaaggagctggtgtggcacagacatgcgggctcctatcatcaccaggaggcaggaggactagtctgtcaactttggctaatgagcagtggccccgctaaagatgcccctgaatttcctcttctccctttgcgggtgggagagaacaggctgggccacttccctgtcatctcattggcttttagctttccaagctggattgtggctggggttgcttttcccacgtgctgtaggccacctctcaccccctggtctccacttggttcaccagccgtgcagaccctctgcggttcctaccaacacatccccctagcgttagctctgattattttgccaagagcgatctgaggccctggaggaaaaggccggctgcggtgggatgcgctgggtatgcattggacccacagcagtaggggaggaggcgcctgggtgcatcagtggtttctctgtagcatttgtcaagggcctcacctttgtgtttgaaatgtcatgtttacatcctgttttcaagtcctccagttggcgttggcaattgcagtctcacttgattcattagggaactttcctaaggcaacataaagatgttcattttcccaatccgaaggcgagcacctgcccaccccaggtgccctttctccctgggccaacctcttgggctggccccccctccgccctggagtccagcagactcagctgaaaggagggcccacatttagggccagaatcctatctcaggtctcccttctcaacggttcaaaactagccactgctttaagagggctgattctgggatataatgattcgattctggttcaaaggaaggcagaaaaaagcgtccaatattttactagaaaaatatcagcttctctgcaacattgtcgactgtgagcttctggtatttacttgtgtttagagtttgtttggttaaagactcattatgcagaagcctcctgccttggtgtgaacccatttacaaaattaaaaatgtagtcaactttaattttaccttcatggaacttcccacatgagagttccctctaattactgaacagatctctatttaaaaaaaaaaactgttttccaacacagagtcttgaacaatcactcgtgtggtcttttctgtcacccctgggctgagccgtcctgttcgctgctggcccttctcttcctgggagcgctcatcattgcccagctgccagaagaggaggggttagcattggtggagggaagcagggggagggaggagcagggagggacgtccacagaaccagccagatgctctgaacagtcgcaagcgtgggaccccacagctcaatcccacccggattcgaactcttccagctggtaagcgtaggcacattactaaacctctctgtgccctagtttcctggtctatgaacatgggcctggctctttcccacttgcagggtgatgagaactcatccgtcgtcatccaccggagatcccagacccaggtagaagtgtggcagatggaacttgttgttatatggcgggtcttgggcatggctggaggcagggcctgccaagtggcccctgcggcaatgctaaagctctgtgtgtgtgtgtttgggggggcggggggcagggttcaaaccctgcttaaaaccattcccagctgaggatagaacccagccccggtgcggcccgtggagccccacccaggacagaccctgccagcccccagcttccctgctggtcctccctgcagcactcctgtgtgctggctactgcctgtttctcgaaccctcagagtcccttcctccctgaggctcctcccacctacccccctcgctgcctgaaggacctcctggccagtgccaggtcccagctttagtcaagccttctgagacgcgccctgacgccatggtggtcagatggctggtggttttgtgtggctgtggctcccccagaccaagacaccccatgattagggacagagatggcgtctggtttcccatcagggtcttcactcaaaacattcaaaaccagcaaaacatcctcagggaagaagggacttgcagtgttccagaaatgggaagcaagccagcgtgtaggagcagtccggggggtagctgcgtctgacccatgtggcacccgaaattctccagttatgggggtttcagtaatcggaagggaactccagagagagtgggtctcgcctggccaggcccctgtggttaatgctgctatttgtattgacagcatgaccagtttctaaaaaatcctctcacctgcaagacagaccctttcaacagcacacctccactcgtttaaaaatggctgagcccaatctatttaaaaaggagaattaatgttaaaaaattgctccaggcagggtctttgctgaagccttggtcaaagactgctcagggcagcagagttacctgcacaagttataatagaatcactgagtcggctccaaaggcgcgccctgcccagagagctcagaggctcaggaagggggcccagtggatctttgtaacccctgtgcctagtatggggcagtgggtgttcagggctccaggaggagtgagtagagtgagggatggaagaagggttgtcagctcacaggctctgctgccctctgaggccctgctcccagagagcttgcaggcgggtagggccctcccaggggtcctcatggctggtacttgggagagaacttgggctgatgtcagggaagagcaaaatgtctggagttcagccaggaactcgaggcaatgaagctccccccctaccccctaccaagggagagttgagttaatggccttggatgaattgttatttgcgaggggaaagggggttagggagcgtctgtgattgttcactgagcttgcgattacactagttatcttccaaagtcccttccgaatcgaagaggaaaggagtctcagattctgagcagccactggttgcatgttctgatttttaagactctaaaatgtggctttaagattctgggagcctgcgactccaggagcttagaccaacctctcctcaagccccacgagtcttgggcttccacccatccttttaccctctggttttacccctgctcccaccccatcccactgcagaccccatcgaaagctccagggaacaagctgggcccagctttaaatgaactgcaggaatctagaggcccagctgcaggggccatctggggcttccctcgtaagtgccaggtgacctgggctccactaaactgagagtgggtggcaccacagggaaacaggggtactgtggcacacgcccctgccccggctgccgtgtgggccagccagtctctttgggatgggccaggctgctggactctacctttgcacctgcatgctgctcttcatccactctcagcactacacacacacacacacacacacacacacacacacacagaccacactcacacacatgcacacagaccacattcccccccacacacacacactcacacagaccacattcccacatacacatgcacacagactcacactcatgcacacatacattcacacacgcacacagacacacatacacatagaccacacacattcagaggcacacatgcacacagacacacacacatgcacacacaaactcacacacatccacacagaccacacatacatgcacacaaatgcacacaggccacacacacacattcgcatatgcacacagacacacacacatgcacacacgcacacacatatgcacatagaccacactcacacacatgcacacagaccacacccacacttgcacatgcatatgcatgcacacagacacactagcacacacatgcacacacactcgtacacagacacacattcatgcacatatacacacatgcacacagatcacatgcacacacacgcacagacaaaaacacacttgtacatgcatacagaccacacacatgcacacagacacacatgcacatgctcacacatgcacagatacacatgcacactgacacatatgcacacatatacacagacacaactaacacatgcacacttacacatacatgcatgcagatacatgcacacacacattcacacatgcacacggacacatacatgcatacacagaaacacatgcacacactcaacacatgcacacagacacatacatatgcatgcacacatacacacaccccttacacattgacacacatagacacagatacccacagacacagatacacagacacacacagatgcaaacacacagacacaggcttcagctgctgtcgggcttgcagtggggtcccgggacccaggttccctttgtggcacaatgcagcaccatgtgctgggaaggggagcccagaggaggcctgggcgagcagcaaagcttccctgaagtcacgtctgagctgagagctgagcagcagcctgacctgaccatgcaaggagtggatggcagttccgagtcgatggagcagtgtgtgcaaaggccaggaggcagaggcgaactctgtgcaggtgaggcatttaaaggcgagaatggctggagcccagaggcaggacaggaggagggtgggagacaaagctgaaagtgtggcgctcaggccaggtggaaggtgcccccagggcaggggtgcaagggccactcacagggaaggggggagggcccctgggggagggggtgctgcctgcatccagcaggggcaggctggcatccttcccctccatctgccctgggctctccctgatgagggcagggatctcaggccacctttgttctgagcagcctgagaggggccactgaaaggagccctgggggacaggcacatgaaccagcagctcaggtgttcatttgccacctgtttgctggtgcctcaggtccctgtccccagtgctccacctgtgaaataagatgaggactcctgtctctaactctcaggctgctctctctggggagatatagacccaaaaactcagccaaaactacagtgtgccaaggagcatgagtgcgttattctaattcaccactgacatcacagtcctgggaaagcggtccctctctccctccctccctccctccctctctcccaccagcagcgggtgcctggctcctgggccgaaattatctaagtgccccaactgttgggttaagaagagccccacctcctcaccccagcacacgcagcacacagctgtagccatggaaactgcctgtaaccttgtgaacagctaaaatagacattatatattttttggtttgttgttttttttttttcaaatgcacttctcttttgtttcacactcctgtgttgatgggtaaggatgcatacggttcagggttggtgtgcagaacatgcctcacaccccaccctgtgccttgttccaccccatgctcgctcagaagggcctgggcccaagggactggggtccccagggggagagcccctgaggagctgctgtctcctcaaccctgcctctaacaagacaagcccgactccacccagtcccccaggagcaaaatacctcccgccgcctggctcccagggaggcctcgaagctgggttttgtgagattgaaggctgagcagggagccccagactggccacttagatgttgtcaccatggctcaggttgggacccaaacccagtgagaaaatcagaatccacagtggtaggtccagacctgtgtgtctgagaaggagctgagctttgagccctgtcccctggacaagtctagaagaggagacagtgtaaatgctgctcttcatctccccttcattttggaagggttttttttctttttctggattgcacgttccaggttgacggccttctttttttttagcactcgaaaggcaccactccattgtctcctggctctcattgtctccagcaaggagtctgctgtcattcttaccttcgagcccttgtaggtcatgcagcccttggctctgtgtttagatttttcccttcgttgctggttttaagcaatttgattataatgttccctggtgttgttttcttcttgtttcttgtgtttgtggtttgttgagctttttggatctgtgggtttataatatcatccaatttggaaatttttcagccaatatttatttattctaattgttttttgcaccagctccaacttctttggagattccagttatacgtatattagaccccttgaacttctccacacctcactgagttctgtttgtttttttcgtttattgatgtttttctctctatttcactttggatcccttctattgctctctgcaagttcactaatgttttcttctgtaatatctagtctgaggttaattccatccactgcatttttcatcttaggcattgtcatgttttcatctctagaagttcggttggttctttttcctatcttctatgtctctacttcatatgctcaagttttcctctggtgttttgaacatataagctacagttaataactattttaatacccttgtctcctaattctatcatctgtgccacttcggggttagttccaatgaattgattttctgttcactgtggtttgtatttttctgcttctttccatgccaggtaatttgttactggatgccagatattttgaattccacttcattgttatattgcaatacatatttgtgatgtctgttctgggatgcagctcagttattgggaaatagtttgatcctttcaggccttgcttttaagctttgttaggcaagtctagagcagctctacccagtgcttcatgaattagaaccttccctgattggtgggaagaggaactatttctggacctgtgagagcttcaaatattgttccctggaatcctatcagctagttctttctctggcctcaggtagttttgctcacatttgagtcactgttcagccagctactcatgggggaccctctgcagagccctgtggctccacggtcccccacggagcagcaggctcctccccagttctgtgtcctgtgacctccggctactttggcctccttgggctatcatctctctctgcaactcagggagagcagcgggctgcacctgagctccctgcaccatagcctgggattccagctggagggagctggggccaccacagggccctccttgtctctcccccatggcttgaggagtgctttccttcatcactggtgtcaccttcaagcaggagggcaagcctgggccccattaccccatcttggctgaaactctggctaatgctgctttgcacgacaagggtgagccacccccgcccccgcccaccagttatggggagacttctactgtcatctccattttatcaaactgaaacatggaggaacgaagaaacttagccaaggtgatgcacagcccagattcaagtggcagccaccgtgctgctcccagacaggagcatggcaaactcgggggctccccgcacagccgcccgggccagaagcctctggtttcccaggactcctccctgctccccatcaaaccaccaacaagccctattggtgctccctcccactcatccccccatccccttctctccagcccaccacctcctccctcttgatgaccatgacagcctctgaacggcttcctcccactctgcctccacacccaccccaccatgcctgccttgcacccgcagccacagagccactaccaaaagcagaaccagtccagttactctcctggccagcccccttctgacccttgccctgaacacattcacttctcattcggctgagagtcaccaggtgcccaccatgggcccaggacaccattccaggcaccagaataaagagaccgagcccctgtcctcagcaactcaaattccagagggaagaaacagacagtaaatgaacatataatatgccaagtatggggtaaaggtacaaaccaggcaggttaagggggtggagagcaaccatggagcaggggatatttttgatatgtggcctggaagctgtaaagtgggggaagccactgtgggaagggtggaatgggaacgggtggacatggggaaggaaggggaacctgaggcctgaccctgggccccttcacacttagaggtcaggagagtaggagaagccagccaaggagggagggggagatcggggagagcacaatgccccagaagccaagggctacagccccttgtcctcaaagtgtggtccgaggatgccgcaccagcagcaccagatgcttgttaaaaatgcacagtcctggccgggtgcagtggctcacgcctgtaatcccagcactttgggaggccgaggcaggaggatcatcacttgaggtcaagagttggaggacagcctggccaacatggcaaaacctcgtctctactaaaaccacaaaaattagccgggtgtgctggcatgcacctgtagtcccagctacttggcaggttgaggcaggagaatcacttgaacctgggaggcagaggttgcaatgagctgagatcgtgccattgcactccagcctgggtgacagagggagactccgtctcaaaaacataacaaacaaaaacaaatgcacagtcctgcagccccgctccccaggctactcgatgcacgttaaaatgtgaggaagactgacctggaaagtgttttggagaggaaggagcagcaccaagctgtgacagggaaggcagggacagggctccaggaaggctggctcaggcaccaacgccctgctgcctgcggggtctctgctgacctcgcccctcttgtcttgtccccctcctgctcttatactccaagcaagatgggcttctccaggtcctgccttgccctgcctgcctctgggcctttgcaagtgccatttcctgcccagggtgctctttcccatcttctcgctactcatcctcaggtttcagcatctgggcccctcactcagggtcacttctcctggctgccacccctgttaacactccccattcttcctctctgcactcccgaaatcaccagtgcacattcatgtccccccacaggactgaaaactccacaaaagcagggacccaaagctgggcccaggatgcagtaagagctgaaagaatatttgctgctgaattattaataaactataaatgccaaacatgtggtgcagacagagggtgctactagagcccagaagagggagccatcttcaggggtgggaatcaggaaaggcttgctccaggagcatggagacagatggccaggaatctcagtacgcagagctggaggggagttcgaggtcctgggaatgacactagcaaaggcccagaagcaagaaaatgcaaagttggtggctgggaggccagaggaacaacctcttacccagacaagtctaaagggcattggggcagtgcaggtgaggccagaaatgtaaatcaggagcaaccttggaggacccaggacatcagatgttcgggacctagatcaggagctgtgttccagagagattccttggatggactgatggggatgccttacgggaaacaaatgcgctgtaaaggaaaccttggcactattccgagagcacagctctggacgtggccactgggataggaaaccaaacctcagtgtggtctacacaagctgatcttgtctcgttaaaacataattgaagtcctaccagttggcacagtcacagaaatgtccccgcagccccagaacctgctccacacggtccacccctgtcatctcctctcactgagagccagccccatggatctgggggtggcagagggggagtggatgtggctgagacgggcctgccctggagctcccagcccagacttaggaagggaaattccaaggagaggccagtgaggcgccatcaaagccactggccctgccagcccctgggcagtgtctgaggttcggggccggggtgcgaatctagcctgccgacagcctgtctccctgggccaggatgaggcagggaccctggccccagcaccgggctgtgcttggcacacagctgactctcagcagatgccatggaaaggagggaggaaagctggagattgtcataattctcctgtttcagagacaagactgaggccatggtcgccctgatgctaatggggagagtctggattcctgcctaagcctttctgactcccaggcagatatggacacagcatcagaggtgtccggggctgggagggagaggtgatagcaacaggtataagcacactggagcaggggcatggaggtgagggcctgggagcaggtgtatgacctcggctggcagaggggccagtggaggtggcctgggctgggggtggcagagggtatggatggcagtggtggacagatgctggactctggagctactcagggaactaaatgggcaggattttctggagatgagatacaggaggaaacagccaactccaggcatcactttgcttggttggctgagcaagaagagatgctgacatgggagagtctgcctcctgctggctgcattgccttggcaaatcagttccctgatgtttgctcatctgcagaatgggcacagcgatacagggggggaaaccttcatcaggtcccagcatgacccaggtccctgtaaagactgatgagagggcggctctgcttcctgctgacccgcaccgcacaggcgcacacggcactcacacgcgttccgtgttcctaactcagagggcctcggcctgggctgcacattggcaccaccagcaaagctgtgcaagtattggttcgtgagcccacccctagagcttgtcctgtcagtggcctgggatgctgccaggtctggggcaggtgtaactgccccaggtgattcgagtgtgcagcccggggtcagcctgttgctctccagcagcatcggtcagaatcctctcgggggcttgctggacctcacccccagagtttctgacccccccgccggcctgggtgggacttggaactctgcattttaacaagctcccagttgatgctgatggtgctttaagtaaagaagtcactggcctgggggagacacagactggtagttatctgcaaggctgcaggaccagggtggtggctgaaaggcaaggagagtggctgcgagttggcagagggcaggcccttggccggagagggcaatgttcactggcgcagcctccccaccccttcgcccttcttgtgtgagcccctcagcacagccagcgtgggcaccttcctggaagagggaaggcactcttctatggctccaggctgccagtccacctgaccagtggggtggacattagtggctgctggacacaccctcggcctccctctcaggccgcccaggggcaagctcaattctgagctcaggttgactttcccaaaacttccccgatggcagagggggatgcatctctgctccctggagttgcagtcgtgattcctgtagacaagaaatcccacaggggcacggcaccacctcagccctcccagggtgcttggttcccaggggctccgcctcagccagtgactcggcccacaggcatttatggagcacccactgtttaccaggcctgtgcatcaaggtgaggctgagggcccaccctcgtggagctggacacgaggtcacagtgtcctggggaggctggccaagggagcagctccagaaaaacaaggaaaatgaaaacaagcagggtgggccaggccgcgagcactagggaggtcacgcaggcttcctggagaaggcgaggcccggcaccatcttaaagggccagaaggagccagtcacctggaaaggagaggacagcgggggtgccaggggtctcccaggccaagggacaacccctgaggccagcaggtgcatccccagagcggtccccgtcctgaggcagaggccacacggacaggcctagggtgagggtcaggttggtcccaaggagtgaggactcactcagaggagcccctgctgggccagacctgctttgggggccatccttcgggacagtggttctcccagtgtgctcccccagtgtgctccccgcgcccgctgcatcagcatcccctgggcacttgggagaaaggcatgttctccgcccccctgagtccgaagctgcagggtagcgcccgcagccaggtttcagtgcattcgggggatgctggtgtaagcccaatgtgagggacgggtgctatgggggcaccagggaggactggaccagggagggctcacattggctgtggagaaggccaggcagggtcccctgcagggacacaagccaggaggaggggcaggatgagcttgtgtgtgcacggccccaacaggaaaatgtgggtgtcatctccgccacagttaccacccccacaggacacccaggtggccagtgccctgaggctgggcctgggtgtctcccccatccggaacagcacctggttcctggcctaagtaaatacaaagcctgctgtgatggacccaggatggagagggctgggagacaggggcccagtgccagggcatagcaggtgcctgccactgcggaagaggctgccctggccccaggaggccagctgcttggcagagggtggtcatggcagtgcaaggtagacccagaagggaggcagctgctcatgagtggggtggtccgggcttgggccttggaagacagaccaggatgccccagtagctgggccctgccctatccagagcctgcctgcctgctgagggacccaaggagagaggctttctgccaacgcagggggcagggccaggagcttcagagctggtacctctctcaggatccccagaagcttccttcacaaagggcaatggtagtatccagggttctttctcaacctggccccatgtgtcccatgtcctgaccgagaatgctgttctgtcggccccttgacacccagcggcccctcaggcagaggagaccttggtaagggctggaattcctggctgggggcagagtttccgggccacgctgctggctggggtctggggtgccttccatgtgtctactggctctcggggctctcctgggactccaggcgtgtccccactgagcagagagtccacctgctcctgtccgtaaggctgagtcagcgagggctttactgagcatccaggagttttctcgaacattatctcaaggtgctgggccattttggtgggtaaaggcctggaagtgcatcaagcctgtgcttcctccctctttgtgcctccgtttcctcatctttgcatgaggatgctcaaagtgcctgcgccggctgtgcctatagggttcactgaagcaccggggagcccccagcccagcacgggactaagttatttgtttactaaacgagagctctggtcgttccagcaagtcctggcctggccctccctcccgtccgccttccaggccctgaactgggaccaggagctgggctcagttcgaggaagagaacgaaaagaaaagaaaaaaggaaggaaggagagagagaaggaaggaaggagagagaaggaaggaaggagagagggaaggaaaggaaaggaaagaaggaaaggaaaggaaagaaggggaggggaaggggaggggaaggggaggggaaggggaggggaaggggaggggaaggggaggggaagggaaggggaaggggaagggaaggggaaggggaagggaaggggaagggaagggaagggaagggaagggaacttaagtccagcagcagagagggttttacgaacccaacttctgcacattggtatttttaagggagacaaaaagccagccccgtcggcagctgagctgggacttgcccggggttttcaggccctaccctcccaccccccatttcctgacccacggctgggagatcgggaaactgcagcccagaatgttcttggtgcatctcatctgccttttcctggcggcctgaagccctggcctggcctacagctctgtgctgctgttcccgccccctgggaaacactggggatcagctaggtgagggtgggggtcacgagggcaagaccccagctcactcagggcctgcggtgcaagtgtgggccgcggcccccactgcattgaaatcagcaccaatgccgccctactgtgtgtgtgcgcgctgtgtcgccccctggtggccggaggactgcagtgggaaaccaggttcttgccttcatggggcttaggtctgatgcagggaaggcggtgagtttaccccgtccctacaggcaagctgagggtgggggatggaaggaaaaggagatacatcagatttgatgtggcacaccatgttcacccctggagccctcacccctcaccatgtgaccttgtgcttttctctccccatgctagactccttggctctcttgtttccttgtctgtaaaatgggcataataataatctttgccttggctgtcccggcaattgaaggagacattggtgaagggtgccatgccctcctggcacagagatagtggtgcttggcacaggatcctgtgcttattattattaagaggtatagggagccatgcagggtgtttgagtgaggcaggaacctgttcagacttacggttcaggaaccccagtggggcaacacaggatggcacgggcaggagccccagctcacgggatttcccagggggtattttccgggggtattgctgagcattctacttgttgaaaagcaggtttctctgctgtattgaaatcatcaatgtcaacagttgtagggcctgacagagagacggggcctgaaccacgagcttcttcagggatgtgcataaatatttcagaccacgaggtggtcagaacaggagagcaggggtttctgggagaggctgctgagctcagcatccagaaacccagtccttttcccttctcccatctcctctaccaacaacttggcgcccacgaccattcagggtgactggcctgtgtctcactctgcagcagatgtgcccggtgaccctgggcaaggtcccctctctggggagcacagccacccaactgcacaatgagtgggtcagcagcatgctagatccctcagcatgctagatctctcagtatgctagatccctcagcatgctagatccttcaacctgctagatccctcaacatgctagatccttcagcatcctagatccctcaacatgctagatccctcagcatgctaatccctcaacatgctagatccttctgtaccattgagcccacccccaccccagagttgggatccaacctccttgggccatgcagcccaggtgtgccctcttctgggcaagcaggacctggagccaaaggtggcaacttcaggcctgacagcagcggccacaactcaagctttatttttgcaagttcttccccaaatctttctgttcaaggtccttaagtagcgtggtagccttcctgacagaagggccccacaggccaggcctcccaccagcatgatctatctgagacccccatggcactgcctgctgctctgccccagacagggccagtggttcccccatctcccacgatccccgactcggtctcagcagaaaggggctgggactggtcagtgatttttgaacagggtctgcaattccctagtgccaaagcagggagtgctactggcttccccactgcccagcctcacagctcagggtgcggggacttctcacctttgcctctgtggctgctcctggcttcctgggcagatagcagcagtgaggtcctggtgagcactgggctcccaccctcccctcccctcccctcccaggctcgccccccgttcgcgcccccgttcgcccatcacctttttctcttttctctgtcccttccctatctgctccaggggctcccagggagatcccaggaaagagcttcagggaccccagcctgagaaagtggggtcagttagactgggcagaaggtgaggtttgaggcaggcctgactcttggggtgatggtctgagtgccccgcctccctcagaccacccaaagctccagcctgagagtcccagccacacccgtcggggacgcaagccactcatctccaggaggcccagggagcaaccaggcagccctcagccggggtcccctctcctcccacaccctgcctggtgggggctatctcagctccgcctgacccagcctctgactgcactgaaggctagaccctgcccactgggtcagaggaagcagtgacccctgaggaccagggagcccccaggaggctttggcacagccccatgatggaggccaggaggcctgatcctgacactccctgtcctgccctacggttcctgaggttggcagacagtgacttcctggtggggaccaggccagggggggacaatcacctagtcctttcagcttcgtgcttcctgcttatggctccagggcttcccagccatccacagccttggcgttggctccagctcctctcctcctggtccacaacacccctcgactccccttcccagctctgcaccatgccagtagtgggccaggcagggctccagccctgggtcgccctggtcgccggtcagctgaaactggtcttgagagtggcctctgtggcttggactccagacagggatgggctttgagtttcagcaagactccttgaggagcaaggataggcatctgtccggtcggcttttccattgctcagtggatcatctcactcttctggcctcagtttactccctagaaaatatgggtcagtcatctccttgcagagatgtgtcagaccccctgcttccccgatggcctagggagtgggctctggacagtggccgaaccactcttacctcagttcacgccaccacctgggaaagccgcctacgctggggggtcccagggtgagacgagatgaatgcacagagtcccgcaaagcctggctgaggccatgctggttcttacaacccctgacatggttgggtggcagtcctgagaaaggcagggacccactgctccccatcacaccccacccctgccttactcctacccaactgcccagcagctccggctggcccaacgtggaaacagcttccattctttaagagcacagagacccctgggcaccacaatctgcacttttgtgccaaacacacactgtgtgccctgcttctgctgggcagtgaaccacagaccctaagagcccctccatggtactgaccccagggggctctccagctggggtctggggggagcttctagaaatctgtgaaaccccagaagtggccagcaaaatgccatggtccctgtgctctttctgggggcccctcaaggaatccaggcaaccacgggggcaaaccctgggcacgaacgagttttccagacaccagctccccactctgtgccaagcccggcagcaccagtccccctgctgtgggcattttctgcctcctagacagaccgcaagcccctcagaacccgtggtgggcaggggcctgattcactgccccctcttccccccgcagctgagctggggatagagctgggaaggcagacattccaggtgctgttgggaactgccctccaggccccgcagactcccttctgccagcccacccccagccgggctctggataacatctcggagaccaaccgcggcagcacagggcagccgagcacttcctcgtctgtttattactgaacgcaggcatctgggagcccgcggagcatgaaattaggaacaaatgtgcaggaggtctagacaggaactctgcgggctgctctcctccgatcgaggacgccggggcccttgggcttccaggtaatgggagcgcctttgtaaccagacagatgtgtttgtggagaaaaggcgctctgagtctccataagccctcgacgagacgccggcatggggaggagtctgaccgtgaggcaacaagcctgggttccaggtccagctctgccctgggcccccagggttggccctctctgccctggccttggtttccccatctggaagtggagggcgcccgcctcacctggttagaggggccgcttgtgaagccatcagattgcagggcccgtgcagctgcactgccgtcgggacgtctgtgtgtttaccaggctccccgtcctggggcccggttggtttggaaggcgcggggctggatgagccagagggcacggccagtgccgaggatgtaggccttggcttctccctggctcctaccacgagcgctgggcatctcaggtgaacgaggcagacagaagccttcattaagcgtcgcctgggccctgtaccatgcaaggcagtggcgggggctggggctggggcacaaaataaataagctctggaggggtccgttcccgtgggctttacggcaagtgagggggatgtggcaagagggacagaaaactagcagagtctgaaattcagcacgggacgtgtggcccagatggtggttagcagggggtctcctgccagggaaaggtgggtgtggggagggggctcccgggggaggcaggtggaggcccgtgtctggctctgctgccaggtgtttcctgccccacccccagctccacgccattcattcctcggtgccggtgccgcaggagacaactgaagcttgtaaacgcagctggctctccctgccggctacagagacgagatggggccctcagaaggggactgttgcccgcccaggcccccttgccacagactctgtggactggggtgggggacgcacaggggagccccatctcacaacctgtccctgtaaaaacccggggtgggaacagggaagcaaagccatttataaagctttaaaaccatttatggtcccagggggcagataaacaattcagcgctattctcgccaaattgccttggctggcagtgcggaggcttcagggagctggaagaggggtggggctcgagtcacaagcaggcggcagagtagcctctgccaggctgttgctgggcctgacccgcatggctctgcctccgaggcttggcctgtgctgttcccagcaccaacaggccctctccttcttctcccagcccatccttcacagcccggctcagaagcttcctcctccaggaagtttccctcggttcctcccccatccgttaccaccctgagcagccaagtcctcccctgttctctcaggcactcagctttctcagagcacaagtatccttgggagccaaagtgtctgtagcccttcccgttctctgcctacccttggagggtgtcatctggctttttcgccttatcacttgatgtttgtttacattttcataatcctgactttgttgggtgtctaaatcatctggattcctggcaggaccaattaaaaatccaagtcccccagagttgggaggaatcagcgtctaaaccctgccacacccattgtacagataagaaaactgaacccagggagaggcctctgacccaaggtcacccgcaagagtagagcaggacagaggccccgcagactcgtatcacctgggccacagctgagtagagtcctggggtccccagggaggaggctgaaggtaagcactcagggagggcagcaggtggtccatattcttcccccattaaatgaaggggtgggacctggtccctctcagctctggcgtttgaagttttgaagttctgtggtgtgtattaaagttcaggaaggcttcctgggagaggagggcacgtgctgggctttgatggcgtggtaggtccgggggggggatgggcatcccagagggtggggcacagctagagcagaggggaggcaggagggtggaggcccagggaggccgtgtttttgggagctgctcggagtgaactgtggtctgatgtcaggctgggcgctggtggagctgccagcggagtgtgtgtctgtcggccatgcctggccctgggacctggcgccgtctcgggcgttgctgctcctcggcaggcgtgtatctgcagagcgaggctgagaggctccagctggaccagcctgggtgttggagggtggctgctgacagccctgggcacctggcctgagccggcacccttcccgtcacgccgccaggctgctctccgctggaggagacctgggcccagaggagctgcagccaggcggagccagggaccggctgcatctcagacctgagagagagctttgcggcgagcggggccagctccctcagggacccgatgaaggactcagacccagggagggacacggtcctaacatcagcacagcactgagcatggtgcagctgctgtcccacagaacccctggggttctcccattttatagaggagggaactgaggcagaggaatggaggcactgaaggcccattcttgcagctaaccagaggcaaagccaggctggcacttgggggtttagcctgggtgtcctgtatggctccccagtacctgtccctgagggagcacctcagcccagccatggccacctacagtctccatcctccctgcagtctcagcctgacagcagtgggagcccctccacccaggcccatgcttccctatgggaaagcagtggcccccattgctatcagtaagccctagcagtgggccctcagccatggcccgtagtggagggtggtgctgaattttaatccctgcatgaccacagacaacactcgggcacgagcctccacctccctcaacccctcccaagctgtgtgagtgccctcattgatgaagtggggccataattacctgggtgcaaatagcaaaaatgccctccaggtgacatacacacagtaggtgacatacacacagcaggagtcactctgcaggtgtcggggagggatcggcacctgagtcaggaccacaacagcaatctctccggcagctgtggccttcctcgctccctccggggaccagcgccttctgactctccaacatgtggctgaaaaccccacccgtggctacagcctggccacagcctgagcactcatgtctctacccaaggtcaagcgaccagcagggaccggccagtgtctcaggccttaattccatttcccaggagagaggccggctggcccagcctggggtgcacgtccatcccaaacccaataaactgtggccgaaaggacagcagcagagggctcagaagtggccaccagcctcttggctcagggcacaaagaagagggccatggctgggccagcacccccaaacctgctatcagcacagtgtgtgcttccccaaaggagctgtggcattcaaggcattcacgtggaggagacatggggttcagcagtcggggtagggtggcaggggccccaaggtggatggtagcagcggatccagccctgacctgacccagatccctcatcttactggtgctggggcctgggcgggtcatttctctccaggcctcggtttgctccctagtgggatcatttgaacatcaaaaagaatcatgactgcagtggactgaaacgcatcaaatatattttcaaaaatcagtgagattgcactgggcaagtttccacgtagaaaggcaagctggggcagacaacaggctgggaccagtaggcacgcggggcctgcaaagggggcagggtcacttttggttcactgagaggtgtggatctgggctggcctgttctccgtcctctcggcacacacacagccacaaacctcagggcaccagctcattctgatccctgataaagggaggaatggaacctctgagccttccctctgcaggccgcatgctagggtaaccacacagatgataaaggcatgtgctttagagctttttcaagaagaactggagctcataaacgtggaaagaaggataacatttggaaagtcactactttgtaactcctagtgaagtaacagatccaggtcacgcacaggatgctgcagcaatgggctgggagaccccccggaatctggcaatggaagaactggccgagagcagctgcagtcattagctgattgtgacgtcaagatgagggggacagcagacaccaggcccctgggagtgatgcaacaggaagccagtttagaggagaaacactgataaaggagcatgttcaatgccatgcgaggaatcccggccagctccagtgcctggaaaattctgtcagataaacaacccagtttctccaataaacaacatgggggtgcggggcgtgaatgggttttgagctgttctagagcaaaaggagccaaaagcaagtacatcctgatttgaactaaccaaccgtaaaaaaggcatttcagagacgacaggagaaagctaaacgtaggctgggtaatttttttaaaatcctcctccgtcagatgctgcactggagtatttatgggtaaagtgatatgctctgtgatttcctttaaaatactccaatctcttcctccaccccataccccagcaagaaaaaaaaataaaaatgaggcttgggaaattgaggaagggaagtggcgccagctcccactgctctgtgagaggtgattgtgaagaatttaggaattttgtaagccgcttgtcaaaccttgcttgaactgaaactggccatggtaagaaaatctacaccacaaaaatcagcaaatgctcccagccgggtgctttgagagctggtttatcagcacagcccaggacagggatgagctgaatgcagcagccactgacagcatcactccagcctccctgcgttgtgtttgatggacattttccacaagaaggagtttgcaaagggcatgtccctaggcctggaaatcccacttctaagaatgtatcctgaaagccactgaagcaggttcaggtggttcccattacttagctacaaagacgcttattaaaacattgctaaaaatatttctttaatgtaagaagcccaaacgtcaggcaggaattggttttcagttttgcaagatgaaaaattctggagattagttgcccaacagtgtgaaatataattcatgctactaagccgcacacgtacaaatggtgaagatggtacattttatgtgtgctttaccacaattaagcattttaaagaaaaggagtcagttacatgaaacaatggaatcgggttagagactatgttgcagaagaaaatttaaggatatggcagaataatggtgactgtgtgagatgaaaatgcagggaagcaggttacaaaaccatatgttcggcctgactgcatttgggtaaatttaaaaacgtgcaagcttgtagagccaggctggaagggcgccattcattgacagcatgctacactaagcatggagagacacgcttgtaaaagtgtcacaaaaccctgtgctattagcatccaccttctacggatgtggaagctgaggctgggagaggggcagggacagaggccagctgaggcagagcaggacctgggctcctgctgcaccccgtccccggcagagcccctgcctctcacaggcacatcctggggtgcttttttcccctcagcttgtcttctcagttctctagaatagcacgagtgacttttgtggtgaggaagcgtgatgctctaaagctggcggcgtgtgttgcaggctgttgatggagaagggggcggatgacagccgggaccgtggtcatcaccgggggcatcttggcgactgtgattttgctctgcatcatcgctgttctgtgctactgccggctccaggtattcccgggcggcggggaaggggacagggcagggaggcccagagggtgcccctacctcgggagggagccccgcctgaaggtcacaagggtcacggcccgggaagtggggaagagccctgtggcagagaagacacacagcagaaggcagcaggaccctaccatggggctcagtaagatgcgcctgactcccctcacccagagcttataaagaggctcagagacgggaagggacttagccaagggcaccagctgcccaaaaggagtgtcacagtgagcaatccttcccacctgcactccagggccatccagagtctccatgtctccctgagagatgagggggagccatcggggcagggcgaggcaacacagctgccagtgcctgtgacccccggctctgctgatgtggggctgcgaacccctccacgcctcagtctccccacctgcaaaatggagataacagtcacacctgcacgttgctgggcggaagagatgagtggatcgttgtgaagtgctcagcactgcgcctggcctgagtgagacccatagcactggttaaacagctgaggtgtcaggcctgggcttgggccaccccactcccaccgtgcctatctcccctccccagtcaggggtagcctttcccacatgtcggttctggggtgggagcgggcggccgcatggtcaccgtccctctgcccgcagtactactgctgcaagaaggacgagtcggaggaggacgaggaggaaccagacttcgccgttcactcgcacctgcccccgctgcactccaaccgcaacctggtgctgaccaacgggccggcgctctaccccaccgcctccacctccttcagccagaagtccccgcaggcccgcgccctctgccgcagctgctcccactgcgagccccccaccttcttcctgcaggagccgccggaggaggaagaggacgtgctgaacggcggggagcgcgtgctctacaagagcgtgagccaggaggacgtggagctgcccccggggggcttcgggggcctgcaggcgctcaaccccaaccgcctctcagccatgcgggaggccttcgccaggagccgcagcatcagcaccgacgtgtgacctgggcccgcccccgggatcctggccttgaaggtcctgagacaatggggggattcctttggcacacccacctggccccaggccccaagtggggcttggctgagccctcctggaatccctgtcctcaggggaggcccaggcttggggagcccccaggctcgtggcagggataaggctcattgaacacaaatgtgtcctggggggaggcacagctggggcctggggctagaaggaccaggtgaccatacagccggctgggcatgcaccagggctctcaggcacagaggccaccgttactcctgatgattctgtctcagacccaacaacctggccttcccaggaggtctccatgtgtcaccccctccctgggtctcacccttctcacctgctcaaggaagggatgacctcagtgaggcccagggccctgcagcaaggccctccctggcaattgcagaccaaggattctgctcctccaccttgaactccagcctctttctctccatttttccctctctctcccctacccgtctctccctctctctcacacacacactcttccgggttcaagggccaagtgtctgcctaggctgagacacgtgctgagctccctgaagatggaccagctgccccctagaagggagactttcaggggcatcagggcccttgggatgctccgccctgaccagctttttggtggcagagggaggcacggggagagggagaggccatgtcgcagtccccctgccgtgggagaggcaacgtggaaatgtatagacccagtgctcagccagaaacagggccagcaagcggcagtgaacggaggcagcccggggctcgtcaggggcagagccatggcccaggggttgaaaacccccgagttccccgtgagacttggctggcccttcccacccctgggcctcagtctccccatcttgtgtgatgaggagagaccctgaggacagaggtcttcaggctgtgggtctcaacaggaactgagatccccaagggagacagagttgcaggtcacctcccctacctgcttctcagcaggacctaggaggcctggcccagctcctggtggaccccaagcagccagagcctactgctgccatctgaagacctcatctgagcccactttccaccaagcgcccacccaggctgaggtctcctgggaattctcacccgctctcctgctgctaaggaaatgacgtcaatggctaccccagagaaatgccccacatcccaggacaccagccatcaggaaggcagctcttcctcacccagaaagaggcaattatttcctctcagcagcctggccccaggagcccccttccctctctggggctctgcctctccttttgtgccctgccatggagccccagggccggggcagcccctctctgcccagggaaggcaccgccctcaaagacaaggcttggccgggcagtgaccttccctgagcggaggggtggcttgagcaggacacttcttgcccttactcaaaaacgaaatggccagtttccagaggcgtcgggggaacggctgacgaagtcacaatcgttatgttctcaattgttttcctcctcttactttctctcctgcctcgtttggacaggccagtggcattcgcccttgaggtccctcgcagccccggccccccgggcccgcccacacctctggcttcctctgtgcatcctgtgaagtctgtttctgatgcgttggcgtggggggtgggctgggtggggtggggatgagggcccagccctcatgattccatttcccaattcctttctggtctccatcctctctgtagatatgtagatctctttgaaacgaagtaagcacccatccctcccagctcactcggctccaccgtggggacctgctgggggagccgctggctccctgaggaaagtgaaagccaataaaacatctcccacactctcgtgcagcgtcttccgtcctcccgggtgtccaggccgtccacacccacgctcttcaaccttctgggaggggcttcctcccaccccgcaggaggcagagtcagcttctccttccggatgcagccagtcaggccagggctctgcccggcggggccgagagctcctctctggcttgggggcacagcagtgggccacgtttgattttgagtttcccggtggctatccatcttccagcattgagaactaccagagtggactctgaacccctggacagagggttgtgggggggacaggctgggtcccctgggacaagtgacagagcatctctgggcctcagttttagcctccacacaatggggtaatcgcgatgcctatatcgtggggacctttggaagataaatccaggcagcaccgaggaggtgctgggcacagaacctggcatacagtaagtgtataataaatgttggcagaaaggagaagccgggaggaaacagtaagacaggaagatgtgggttgggggacacaggaggagagaagaacagcgaggtgagggcgggcaaagggtgaggtgggcagagaggcctcagaccccggggtctcaggactcggttctgtccggcccaagctggtgaccttgagcaagtccatcccaggggcctcttaattcctggactttagggattgaaaggaccatcctgattgcagcgcctcagtgcacacgcgtgcaggcacactcagaggcaagaacacactgggggggggggtgctgccttagtttccccagagccccaagtccttcagaagcccccctaaagctgtgatggacgctgctgtggctcccagtctgagaacaagctggcctcacatcgaggaagcagcccggcagccactcacctcccgactgcctgcgtgctcagagacacctcctggggcctctccgggcggtacagccccgtccttcctcccatgcagcgtcctccagctgtgtcacttttcctctcctgagtgctctttgctgccctcttgtctgggaaaagccactcctgctgctgggtcaaccaagcagcccctccccagaagcccctgcgttcctgcacccacaagtccgggtcaggaagccctccatgagctccaggagcggcagtgacggtgctgtttcctgaggctcaaggtgggcccagccccgcgcccccaacacctgcctcatctcctctgttcttgcccacgcacttggaggtgggtgccctacaccttagccaaggtccctgccccctgcccccacaggtcctgtaccagttgctgatgggctcgagatgtccactcctactccagcgcctgagtcccagtgtccccagacgccctccctgcacactccccacgcctctcgttgccttttatctgcgtctgtctttctcctcagagcaggtgctgtggtcccccacggcccacccctgcccctgaggcctcagtgagctggagggaccccacacagccaggcctgggccctccaatccccaggccacccacttctccagccagaggcaactgagaccccatgatgccgccataaataggaccactttattaacgtagatgagcactgacgctgactgcaggggcgggggccgaggtccatccccaaacgtcccgtgggcaagcgcctctgcccggggtagaaagtgcggcgggaagagagctccatgggaggggctccataagagggagcacgcctgggcctccttggctgcctgagcccctctcaccccatggcctctgagggaggaaggccccccaccacgttgggctcgcctgcaagtttccttcagaaggccctgccacccagagagggcgtgggctacgggcccggagcaagacacctccaccgctggctgtgggccctgggcccctcggctgggggctgctggggggctggggagtgggagccacaaacacaggatccacgcaggaacacggacaggttcccacggcaggggtggctctgtctgggggaggccactgggtgccggaggctctgccccaggagcacaaaggtccacgggccgtgggaagtcccctctcgacagccgaggctcagtgccacgtctcttaggccagcgtgccccgcaggaggggggtctgtggaggccccagaagctgcagcagccccaggaggggcgcttggtcttcatctggaaggggctgcagctgccgggcctaggagtgggggggcctgcaggagcggcagcacgccttgctgtagtaccagtgcccgcagaggttcactttgatggccagggcacagttggtgcctggctggtcctggcagctgtcatctggagaaggaacacagagcgaagcagggcagtttcaggaggtggccaaggggcgaaaaccccagggacccccacgtgccgttttccaggggcagtgggcctcccaccccgtggtgggtctccatctctagctctctgccccctccttcctggcccatctctgtccccaagatgtcgctgtcccagatcatgccaggtgatttgatctgtgtcccaagaggagtgatgcctaaaggagctacagatgtcacacccagaggcctaagcatccccaagggttccacaggggccccccgtccaccactcaatgtatccaaagcataactcatcacgtgccctgcacctggcaccctgtccctcctccaggtgcccaggccctgcttcagctgctcccctccctgccccctgtgtgccagcccctggccgctccagctgagtcatcctggattcaggtcttggccccacagtggccctgccatctgaagctgacccttttcccaaagtacaggtctcagcatggctccctggggccatggagccccagtcaggcctcccccattccccttccctctctcccctcccagtggggctcggccatgccgggagggagcccccactccctgcacagcttggtctctcaagctggttcccaggctcgccatcaaggtgagcaatgtctgctcacccctcaggccctgactctgtcctcgcctcccctgggaattcccagagccaccctcggcctccccgcgcctcacctgggggctccgtggggcagggctgcagatcacaggcctgtctgccaacgggcttcaccaacggatcgcaaccacggacgatgtcggtcccctggtagcacttgacgtctcgcatcctcacgcccaccccgcaggtcttggtgcactggtgtgggagagacagaaggcatggggaaagcctcctgatggggcaggggcctgggcagggggcggggaacctgcacactcccccttccccaccccacccttcccaggcggccatgagtcccaactgacacaggacccgtggaagcccatttgaaactagacctgcggctccaaggctgagttgagatgccgacaaaagggcactggctggcattcgggaggctctgattgtctcccacccagggctgcctcagtctccccagatccacagtgaggggtggtccctcctctctcatttcccagggggtccaggcactagctggccgtcaggaggatctgattctctccccacgcagggctgcctcagtctccccagatgcacagtgaggggtggtccctcctctcccatctccctgagggtcctctggccccagctttcctgggtctgtggtgcagactgtttgttgtgggccgatcaaatgcatctcgcgaagtcaccaccccctccagtggctccccgtccagatgttccccttggaaaaccccgctgagctccccagaacaccagagacatctgctggccccagtcaccctgctgtcctcctgccaagatcccacaggcggtggctccctcacactccccccaatgtgggtgaccccacatcatccaggcacgtctgggacctgagccctctgtcctctgagatgggtggggtgggaggccctggccctgggacccactctccacttctgtttgcaaaggagcaaggaagaccgattaagacttggcagaaagactgctgcctgcctgcctgctccgagccagggggtgggggctggcaccgtctgcaggcgaggagaggctggcttggcgctgacggcgtgaggacaatcagcctttggcagggccctgaggagcctctggacgtgcctctggagagcagcacattcccggccagccctggtgccagctcctctgcccctggggagtggatgggactgggcagctggggcaacaaacactgactgagccgccgctatgcaccggcatcggggggcagccaccaggaagaaggagtccacgcgcccaccagccgtctgtgccagctgcacctcgtctggccctgccacctcctcatcagggctagggggatgctcctccccagcaccccaggctgtccttctggggtccccgcttcatcgcttcatggctccccccgtgccatggctcatcacccagcaaggtacctgcacctagtgggtccgtgtttcctggccccacagtggcccccccatctgaagctagtgctcttcccaaactacagacctgggctggctccctggggccctggaaccccagtcagcctccctgccccttcccactctccctcccaccgggcttagcctttccagaaggaggcttcagggcccggcacgccgtggtctctccagctgactcccggcaaaagccggctcacccttcaggccctggctctgcccaggcctcccctgggaagccccaggcccaccctcagcctttcccctcctcactcgggggtcctttggtgggcaacagggaatgagtgagtgtgtgttctccctcctgaacaagcatgtgtgctacagggcaggcagaggccctggggcggggtggggggtggggggtggcggggcagggtggaggccagacaccaccaagcgtgcacgaggagcctgggacctggcaagggcccggggcctggaccccaatctctgagcagggccgcactggggtccccagctcgctcctcacagactcttggactctctgccttgaactcataaggtttaggatcttgcatccacccgccacagcaaccaagacttggagccctcgggcgccagggcctgatacacacctgggcacttcaccatgaacgttccaggctctgagttccgtctgacacccccattttgtcgcctgggtattcagagttggcccatcaggaaactgagggcagaggtagctggagaccccaggtaaacagcctggctatggaagcacctgcccagtgattcccagataccctctggacacccccaggtccccctctcagaagctcatggcattgccaggtgtgaggcggctgggtctggggccagggctggcgctgctgtgaaaggggcacggatggctgatgtgtcacagctgatgtgagttactcaagctggagtctagacagggctgcctccgtggggcccagaaggcagaggggcacccactggcacatggcgaggctctggagtcacccggaggccccacaggaagtgcagcagaaggggaaaacagcaggagaggtgaaagcaacctgtttgctctgcaagacaactgggggcgagggggcacccagtttgccaccccctctgtgaaaccagggctgcccacccacctcggggctccctgcccagggccccttgggatgagctggttcaggccccccttcccttgcagatgccacaccccacctgggtttcactctagtgccatggacaggcctggcctccaatgtctgctacagcccccagtaactgtgggaccccgagtgggccagagagctccctgaacctctgaggaatggggaaaagaacctctcctcatggcactattgggagagaggagacccttcaggcaaagaactgggtgagggttgccacacgtgcctcagggcctcagggtgggagggctctcctcccctctacaaagagaaccgcgatctcagcatagtcctgcctcacatcctgacgctggggcattctgggggcccaagagtcaaagaatctcggaggggccagacccgtgcaggagacgtactgcccttccctctggccccgccggtgtcctgacatgggggtgcatgtctattactgtctccctaaattccaagcggctgccttggctgtggctcccagagggccaagcctgtgtctgcctcagcccaatctgctccccccgcccacctggggtctgtctgtcccgcggtgtccggcacatgggctgccaaacatgcaacttagaggccacaattcgaggccggagttcccgggcccaaaaaggcccaggacgagtgccgtagggatcccagggacaagatcagagaaggcttcctggaggtgctggctctcgcaccagctgacgtggtggagttgagaagctttcccgggaaggaaagccctcacagaggctgtcagggagggaggagcaggaagcacttaaggaggcttgaggcgggaggggcgggatcgacattcaggtctggcctcaggcaacctcagaggggccggctgggagctcacctctgaccaggggctggtgtaccacttgaagcagggcctctcgaaacacgtgctctcctcgggaggcttcttggcgagcccgcactcggggccactgcgcgtctgcggcttcccgttggccagctccatgcagagcaccagccgcttcttgaccccgcgcccgcaggtggtgttgcactgaggccggggcagagggagcgggtcagcgccagggcccagcaggaccctacacacagggcccacggcgactctggtgacaacgggctggtcaatagcaattgggtgagaatgctccagtgcataacaaactggctggaaactctttgttcgataaccatttggccccagatggatttgatcaaaagcaatttagcacataaccatctgttttgaaacaaattggctaatgacaatctggccagtgatgatttggccaaaatcaatttagcagaaaacaatttggctcgagattatccggtttagtgacctgccgggagctgctggttgaaagcaatttgtggagagcaactcgtctgaaatggcaagttggtgacgatgacaggtgggtgcggaagacacactggtcacgatcagaggtcgcaaaggcccctgggccaggagcaggcagccaaaacaacccctgtccctagctttctgcgtcccagggacttgggggcccaggctgggggcaatgccaattctgcacgtaccactgagccatgcaaaattgagatttggggacttgtaaggtgttttcctaccttttaagccttttgtattctaaattaatttttagggaattgtcccttcataatttgcaatgaattcctctttttcacccatctgtggtcccagccatctggctctcctctctggccaaatgctctccagataccaggaggcccttccgcgggctctggggcactcacccgctcccagtcctgggccagccagtgggcgggacagtttttgtccccacaggggtggatggccagaggcttggtctccatctggcactgggactcaggtactacccgtccgtcgctggtcttgcagtacacgtgcctgatggtgcggccttgcccgcagcttccactgcactgcaggggagaggacaggcaggggacatccagtgagaggcagccacaccaggaggggccctggatgtcagtcccaagggagaggagtggctcccaggcagtgtcgaagcggttgccatggtaaccactttttaaataacattttctattctaattacagaaataatgcatgcttgatgaaaagcacacagagaaaagcacacttaaaaagatcatctgtgcacccaccacccagaggcgaccccagctagcatctgagcatctctctcgatgagagagacagagacagggaaagagacaaagacagacacagagagacagagatggggagacagacagagagactcggagacaaacagagacggggagacagagacagaccaacagaggaacagagacacagacacacacagggagacaaaggcagagagagatacagagagataaacaggtgatagagggaaggtgatgctggccacgtgtttggagagaagttttgattcctataataacatgggagaaggctggttggacattcttgacctcacacccttgcctcggaaaaaaatggaaactgaggcacatcaaggcaaagctctgggtcccctcaccagccgcacgcccagccacccctcagtgcaggcctcaccggtccccagtcggagacggtccactgccggtcacagggcgggcccgtgcagttcttctcccctacaggcctggtgttggggtcacacagcttctcatcctccgagcagcggatgtccctggtcaccacactgcgctccccacacttggcagtgcactggggcggcagggggagggggcagggggggtgtgacacaggtgtagccacctccatctcccaagcccagctccccagctcttcccgacccccggcttgctcccgcaggcactcacctcggaccactccgacatctcccactggggcccgcaggcggggttccggcaggtcttgcgttcctcgggccgcacggcctcggctgcctcgcacaggtcgctgtacacggagctgtcgaagccgggcgagagcatcttccagcagcgcacgacgcggaactggtagccctctccgcaggtgcgcgaacactcgctccagctgctcgtctcccacctgccccgggagcggatggccttcaatgatcccccccatggcagccgggaccccatgcaacccacacccccagagacaacgcggctcctcccttcctcccctatgtggtccaaaaccgcacacaacaagctaagccagacaggagggtgtcgaggctcaagggtgcaggctgggccatgacggccccggaggtcttcagggagcaccttagcaaggtggttggcgggtgccctgagcgtgggctcggccttcctgccccttcgtgccctgctgtgtcacacaggtggctgtgcgcccacaggattctggcaagggtggaagtgagcagaaggcacatttctggatctgtgtccagaaagggggcatggccagcgtgctggggaaagacctctccttccccttagcttgagctgggaggggttatgagtgagacccggaagtcttccaggcagatagacttggaataagaggtccaaagctgatgggctctgaggggaaggacagggcctgctggaccccacccccgggccagccttagcagcattctggggaccttgggcattctgcccttcccagaaaggagcaaacgtgcaggaagtgggaggccccagatggaggagtccagaaaagaagaggcagtgtggccgtgtgcggggagcaggagggctcagcctccgaggagtgtgtgatccttgtcgggggaggccggcaccctcaggctcatctggggaccccacttgtcactaggtgtaggatgcactcagctcagactgactgcatccacaaggcaggagacgaggcccaaaggtcaagaaaataggcctccacccacatccaagggacagccaataggcatggaatcttgggaataatcccttgagtttataaaaatcctagatgtgccaagtgggcctggtggggcaaagataccgctgtaatataatgttgagaatggtttctaaatctgcggtggcaagcattaattgagcacctactgtctacgaggcacagtgacagattaaattgcaactcctgggaagacccagaaggtctctgaggggtgaggtctgtatgcccctcctcgaagagcccccacggccctgcacacgaagaacctctacggggcagggggtaagtctgactgctcctttgggcagagcccctcacgccccctgccgaccccctgcccagggcccctggtggcaggtacctgggctggcactccctcccagcgcagaactcgtggacaggctcgggacgggtcagggcgtcacagtagctgtcatccacctcgacgccatcatagcggacacacatggcgtacgcagacatgacccctgggttggggacaggggtgggtctgtgagccatgccggcaccttggagcccagcagacaggcctcaggacttggggcaagtcacctgacctctcagctcagctttctggcttggggatcagtcacagcttgtgcaactgtggcatgagggcagcactgtgggtctgagctgtgcgggtctgagctcttctctttgcacccccaccccgccccacccaacccagctgggctcccagttcccatgtcacggagtccgggctttgagtctgctccagctggcccccgtggaggtgcagaggcaaacacagtcaggtgtcccccatcgccaggcgttcagcaaccacccatccctgggtggacaggcaggcgggagtgacatctgacggctccagccccgtcagcctcctcagaggtcatggtgggggttcgggcgcgccctgccctctgtggcatgccccagtccttagcaagcatcctcttgaactttctttttttgagatggagcctcactccgtggcccaggctgtagtgcaatggtgcaatctcagctcactgcaacctccccctcctgggttcaagcaattctcctgcctcagcctcccgagtagctgggattacaggcatgtgccaccacacccggctaatttttgtatttttatggaaattgggtttcaccatgttggccaggctggtcttgaacttctgacctcaggtgatccgcccgccttggcctcccaaagtgctgggattacatgcgtgagccaccgcgccaggcctgaactttctttaatcatcactgtgtgcctgtctttgttggtgccccgtactctgtaatcccactgggggacagtgggtgacaggcagccctcacctagcagtgccacttccttgaccacatctccaccttctgcttctttcgtcctcgcccctgcacccttgcctggtaccgaactgccacacaggcccagctccctgcccaggagcaggatgattctgggagagccggcagcagtgggaacggccttggggtggggttagggtttgctgcttctgctgtggctgtgtgtgtgtgtgtgtgtgtgtgtgtgtgtgtgtggccacgggagacagacccagccttccgggatgacgggcatcatggaacggtcttggctgcagctgccagttcccccagaaggaaatcggtttccccatatccagagaacccagccgcccggcggcgtgtgtctgcaggccagcggctcctgcctctccaagccccagcgctggatggaacgaaacagcctgggaagcagccgacaaggggattttttcttttttccgtaaaggacgagccaggctgcaatcacggttcctctcccgccagagctgggccgtgcagcctttagccttctctgagggggaggctggcttcccggccaggtctgcttggaatgttccaagcctcagagacacccgctctggggcccagggaggtgcggggctggggacttgcagaccatcgccaagtgcctggttattcattcgctcctcgtcacggagtggaaacgcggcaggccttggtcaagagagactggaatccaagtcccagctcagtgcctccctggggtgacgtgaccgtgaccagactccaggcctcagcatgctccttcccgaaatgggaaccttccagagagcctgtgagaatcaaatgccaggacgttttttctgggcaccctcttcatgacacccatctcgaaaacggtgcttttcaaaccccctgagccacggagcccctccttgaaacaaaagaaaggggaggatgaagcctgggggccgcaggatccactgtcctcaccacggtgccctggagcgccgaagggcagcagaaacttccacctatgacctgagccgaggccaaactcacgctcctctgttgctatggctccaaaagagtgtcttcgaagaaaaatctaaaaacaagcttccccaccgcggccaaagctcagggcaggctgatctgccccactgatagaactgccctgtgcctgggttcttgcgaggcacaggatggagggtgggccaatgaccatccatgggacatccgcacggacacaacctatgcaaagggtggaccctgactctgttatttctgcccagtgccattcagcacctcccacagtgacagggaactctccctccctcctgccctccctttctctctctctctctcaccctctctctctctccttctctctctctccctctccctctctctctccctctccctctctctctccctctctccctctctccctctctctctctctccctctctctctctctctccctctctctccccctctctctctccttctctctccctctccctctctctctccctctccctctctccctctctgtctctctctctctccctctccctctctctctccctctctgtctccctctctctctccctctctctctctccctctctccctctctctccctctctctctccctctctctctccctctctctctccctctctctctccctctctctctccctctctctccctctctctccctctctctctccctctctctttctctctctttctctctctccctctctctttctctctctctccctctctctccctctctctctccctctttctctctctctccctctctctctccctctttctctctctctctccctctctctccctctccctctctctctctccctctctctctctctccctctctctctctctccctttctctctgtctctctccccctttctctctctctctctctctctccccctttttctctctctctctctctccctctctctctctctccctttctctctgtctctctccccctttctctctctctgtctctctccccctttctctctctctctctctctcccttctctctctctctccctctctctctctctctccctctctctctccctctctctctctctctctccctctctctctctctctctccctctctctctctccccttctctctctctctccctctctctctctctctctctccctctctctctctctctctccctctctctctctctctctctctctccccctttctctctctctctctctgtctctcagggtggctcatttccatttctgaacaacctcctgtaaagcagagtttccttcttccaaagccaaaacctgtctttctgatttcctgttgtcctttgccccactgcaccttgggccacgctgcacagacccagtccagccccctccctgccattctctgggtgttgggagacagtgctgtgtcctccctggggacatcttccacgcagggctgcccatcaggccccttgccagcgaggctgcctcaccctgcagacgtctcgagcgacgtcccctctccagccagcgatgtgtctgggaggaatcacagatgtttgcagacacttagtgacaacgcccacaggcttgacacttactgacaacgcccacacgcttggagtcccctggccaggaagagtggaggaactcagggcaggtccgcaaaggacttggcaaagcagacaccctgctgacaccccaccaccatgctcagctccgctaggggtctgcccggaaggcaggtcacatggctcacttccaaggccagctgctcctgggtatggtggaagccgcaccctgcatcaggtggtggcagccaccctcagaacggcagcatccattgacctctgaccatgagaggctattccttgtttcatgtggatccccacaacccacctttgagataagcaggcgtcccagttcacctgtggaaaacagtggctcggaaggctttggcaatttgcccagggcccatggtgtggtcaaccaggcggtgcaagcctggccaagccggtgcccaccacgccgcccacagcggtgcgagcctggccaagccaggtgcccaccacgccgcccacagcggtgcgagcctggccaagccggtgcccaccacgccgcccacagcggtgcaagcctggccaagccgggtgcccaccacgcctcccacagcggtgcgagcctggccaagccgggtgcccaccacgccgcccacagcggtgcgagcctggccaagccggtgcccaccacgccgcccacagcggtgcgagcctggccaagccggtgcccaccacgccgcccacggcggtgcgagcctggccaagtcgggtgcccaccacgccgcccacggcggtgcgagcctggccaagccggtgcccgccacgccgcccacggcggtgcgaaccgggcccagccgggtgcccgccacgccgcccacggcggtgcgagccgggcccagcagggtgcccgccacgccgcccacggcggtgcgagccgggcccagccgggtgcccgccacgccgcccacggcggtgcgagcctggccgagccgggtgcccgccacgccgcccacggcggtgcgagcctggccgagccgggtgc

SEQ ID NO: 37366 - DNA, 1708 bp, Homo sapiens
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccaggtaaggctgaagggagagtcagggtcagaggcagtggggggctggcagtgggtaatgtctagatctcagattgcttggcactggacgtaagggacatggtgagttcaggcaaatgcttaggtctgtatatttcggtgagcctggcaggtccctgcatgtgtgcctgtaagtgtgggtgtccctgtgcccctgaatcccaatgcgggtgtgtcttttagcacatcctggggcctatggctgtgactgtctctgcaagctctatttcctgctgcctccgtttcccaggcagaaggagatttgcttaaggtagggagaatggcagacactaagccaaggctgatattcaaaaattttagcaattaataaggctcctaacaccagcctaccctaccccacgcccctcccacactgtgacctgcattaactctttacttgctggattgtcctgggagagaggttggggtgatcagggcagcaggaagtcatttgtggggctcagggcagtggttatttacaaaacagtttagaagtatgacaatatatttagcaaccagtagagccagagccatattggtgcataatggctgaataccaggtctaactcctccccgaccccaccagacacacacacacacacacacacacacacacacacacacacacacaggtgtcctcaatccgagctagggccatggccatgccaccctcaagggtccctgtgtcctgtcaccttctttccccatcccagccccaactctgagtggcaccaatgatgctgaagactgctgcctgtctgtgacccagaaacccatccctgggtacatcgtgaggaacttccactaccttctcatcaaggatggctgcagggtgcctgctgtagtgtgagttgtggggagggtgtctagcctcatctcccgttttagcccctgttgagactcccaccttcttattccccttctccatgccaagcccaaccccttcaaggaaatccctgaaacaggttcccagacatggtccccaggcatgctggattctggggctccattctctccggcctctcaccccaggttcaccacactgaggggccgccagctctgtgcacccccagaccagccctgggtagaacgcatcatccagagactgcagaggacctcagccaaggcaagcctggccctccctggccctgtctcctccctctgagctcctgtctaagattccagcccatgatccttcctctccttcctcctctagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaactaa

SEQ ID NO: 37367 - DNA, 19378 bp, Homo sapiens
gaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggtaaagcaggggcagaatgtgggggagactgggatggagggaaggagcgagggggctgccggctgccacttgtttctggagctccgagggtccgcgggagactttgccgcctatatcctcacgtttcttcacgcgacaaaagtccggtcctgcgaaggtgccaggagcgtggtagccccaagttcaagccaccgccggcgaggttctcggagccatccccttcccgcctcaggttgtgagcagaggagcgtggtcggagatgagctgctcctcgagcgcgctcgaggtcctgggaggctgttgccttcccgccggattccttggcgggtgagcgcatggactgaggtgcggggaagccggcccctcaccgaagctttccgtagttacggaggagcttgggggtccatcgctgcttactgcgcagagctgctcctttgaggtgctgttgtttcaggctcctgtcctgccgtcttgtcccacgacggcgcggagtatccccgctgaaaagcagggggtcgttccaggccatcagacgtgtggagtaagctgcaggttggggtgccgcatgtcctttatttgtttctcttccacctctcaactgttaggactttctcataacttgctggggtgagttgagccgttgggaaatggaggagtttggccacactcgattaaccaggagcgggaattatgaatgaagactggtgattgcaggacatcccgaggaacgtcctcgagtcacgatcctctctctcgactccccaaactgaatctttcacgtggtggggtctgggcctcgtgggtgaagtgagtgcagaggctgtcacagcgttagtcgcagcagagctctttagagttcgcagttttttttttccaccacatgtgcgtgaagcatggtcagagtttcactggcggttaatagttgtttctagggcactgtgagtttcacaggattgtcttgatttttgcattcgctttaccagtttgttgcggatgaaaaaaaagagcaagcagtttggagataagaacgtgcatgatcaatagcaagcaggtgttggacctaaggtctgaatctttaaagctgcatttatatgttgaaagttgaaattaccccttcctgccacgtgcttctctgaaaggagttgtttctctttagctttagttgaattctgtaacagtgaactaattttaaaaatcaaaacaattttctcgtggtaggatttgttttaggagggtttttttttttttttttgaggacttttgtgaggctcggaatgaagaacctcggtcctaggtggtgaataaaagaaaataattaattcttgtggtaaaattataggttgaggaaaaatacagttggagtattagaaagcatgtatatcacttaggccaagtatctcttcagccagttaagctttatggcaatctagcacaattaaataaatcatttaattcgtgtgttaagtaacgctgacttgtgtaattatttaaactatgcttaagcttaagaaagtacacgaaaaagttgaatctgacgaataatgtgtaccaggtagatgtgttcactcattttgaatgttcaaaacatgaagcatggtttaaatgcctgagttattttgatcatgaagcccatctatgaaataagctcttacctgaaaagtagtattttaagttaacaaatgtggggaatgatttcatgaagttagaaccaagacttaggttcaccgttcaatgagtctttccatgggaaaactattccatgttagcaatcagcattttccttaggtcagtatttcagagcactactgttaagttgcataaaatacaagcatgtaaaatacaggaaaagtgttgaatggacaatacccgttttgagattctactgtcctgattactgggaataaatctgtaaacaaagtcgctgcatgtagtaggaaggttaacctgattgtgttctgtgattttgataacacattgtgacataatacttgacatactttagacagatatttaatgtttatgttttatgaattaattttgtacattctcttgcccatttgaagaacttgagaattgacagcagaatgtcattgagagtgtagaccagggattttctaaaaaagaatgaatgccttgaaactagtgcagttagtgagcttgcaagttatagataagtatatcaaaagaagcttgcatttttaaatgtcagtctttttcattaggtaggtttaatacgtttttaagattctgtaaacttgatattgggtggggacgccaactattgttcacttgggtgtgtttggcttggatattattgcaaggactggttccataactccaccccagtgcactttattactgatgacatttatttaaataccttggtgtaaggtctaatatttgtagtctatcttgagtatttacagggaatgaacttcaaaattctattgaagagattgatagttactgtttggctccagttaacaggcagcagaacaactgggtgtgtcttgatggtgttctactttcttagaaagaaccaaagtgaagcagcttaaaatcttgtaaaaccaattcctcagctgctttatgactttgtcagaaattgggaattagagcataccaacaatcttaaagtcattaatttaaccatcaatctgttgatccttatgggcaccaataatttaaattggttgcctttgtggggtttcagacattacaggaaaaaagtagtaaagggggaaattagtaaatgcttcagctatcacttagtgtcacaagttttcttatttcttacatgttgcttaaaagcggtcttaacgtgtgtgtatttggtttttaaagattctttgaaaataaagatagttgttagggcaaattttttagaggactctctccatgcataataagtaactgtttcctaacttggaagtacttagggatgtgggagtgtgtacaaacatatatacacttacatgctataaaattttaaactttaataggggaagatggccctttttgtgtgcctgtagctaagaagaccaaaagatgacactttttctggttaaatggctgttttaaactgaagtgatgttctctaataatcctaaatgccatattttcctttcagatttgtaattttatagaattatgagtcttaattgcatttttttttcagattagatagaataacatagtgcggccctcacttttgtgaggggccatatctagtgagtgtgttgatttgcttggttatttatgaatggctgctggtattttctttggtattttaaaagccaaaatgtattgcttgcctaaaattttttaaatttaaaagtttttattaagagactatcttggaaagtgacgggaataatggttgcccaaatgatttccaagtcagttatagaaaatgcttttgagggggagaacttggcaaacttaaatagaagtttaaaataagtttattgtttttattttatttatttatgtatttagtcggtggtatggattggaaggtttattgtctttaaatggcagttttcctaaggtactttgttacacattagagttgcccagtgtttgcttttttccaacaggaaatggtagtggattggaagagaagcagcttttgacagtccaggcctaaagtttttggattgcaaaaataatttgcttatgcaggttatcttatcgttttaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgataggtaagttgtttcttgtttttgagccagggtcttggtctaacatgtaggctggagtgcagtggtacaagcttggctcactgcagcctctgcttcctgggctcaaatgatcctctcatctcagtctcctcttgagtagctcggactacaaggtcacgccaccacactgctaattttttttgtagagctgaggtctcactatatatattgcattggctggtcttgagctcctgtgctcaagctgtcctcctgcaatattgggattacaggcgtaaaccaaagaagtcttcatattttgttactttatagagtcacattttaatgttaagctataaattgggcataattgccaggtagcagtctggctaattgtttctattaatttttcacagaaacatctgtatgtgtgcattgttaagctttagatctttgggtaacagttcaaacttaggtctcttgtaatggaaacactttgttgaattgataaccaatttctttttctttctctctccagatacagagttaaaaggaaaatactgttagttgaaggaaaatactgttggtttattgtttatagcaaataaattacttatgcaagttagatgtgtttaatttttaagtgtattggtaaatagtgatggactggattatatgtgcaatgaatagcagtggaaaagtatatgcactggtagtaatgctttagagtgctaaaatagttttcttgttttgggaggctgtcttgttctggtttcctttgtgtttagaaacagactattttgaattttctgaagtgtatgtatttaactattggtttttgagccagtaaacatgttctgtatttttgatcttttggatgaattttcctcatttcttctggaaaccatggaagtataatttatttgtttatattatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcgtaagtcttactggtttttattttactttaatattttaatctatttaataaacaaactttgaatttctagaactaaagagtattatgttaactcagttttgttagttctttttcacattacagtggcctgaagcacgaggacaaacgtggaggtagcggatctcacaactggggaactgtcaaagacgaattaacgttggtattctgattttcttaaaaattctatacctaactagaggttaatccatacctctgtcaaattttacttgtctctgagataagaatgaatgctctcttctgagagttactatattacaagataatgtcttatgggatgggtttgggttatagtatattgaatgaccggttttttaatatttcgatatatttgttactcattttttcccccccatatgtatttgtagcttttcctgaaaccccacaataaggttatttgggtattctgattatcttagtgtccttaatagttcctattctagcttttgactttgttgtcattacaaaatttgataagctagtaaagcttcattttataattaactgccttgttctgttactttttaagtatgaagtatatgaactaactagtttatattgtttacttttcgacgtcttctggggagtatatttagtaagaaaggagttagagaatgtgagagcttatggtatttttgtatgaagaacttttcagctacatgtaaatggacctagatgcctttctttttctttctttccttagagagtcccccaaatacattcagaaacaaatatcttataattacagtgacttggatcaatcaaatgtgactgaggaaacacctgaaggtgaagaacatcatccagtggcagacactgaaaataagtaagtggtattgcgtgtaatagtaatgacccagaattgaaagcactggagttttaccaataagataacccatagatttaatgctgttacttgatggctttttgtttttgacaagggagacttactgtaccctcatccctcaaagagtatttgaaagaatgctttttttttctttttttaatagagacagggtctcactatattgcctaggcaggtctccaattcctgggctcaagcgttcctcctgccttggcctcccaaagtgctgggattacaggcatgagccactgcacccagcccttaaaagagtggtttatgtgtatatatttgactctaacgctttgaaaaatagaatattttaatgtggttatttctgtttgattagtcattttaccattgtcatacaactgtacaaattttactttgagatagttaaaactagaaaatgtggccattttaacattagttctatcttgaagttatttccaatgtagaatttggaacatagcattactggcctgtttttaaatgtatgaagagagcaaagatcagagtatgttattcactatctttttttttttttttctttttttgagacaagatttcattctgttgccgaggctggagtgcagtggagtgatcttggctcactgcaccctccgcctcctgggctcaaatgatccttccacgtcagcctcctaagtagctgggactataggtgcctgccaccaggcccggctaatttttgtatttttagtagagacagggtttcaccattttgcccaggctggtcttcaactcctgagctcaggcaagccacccaccttggcctcccaaagtgctgggattacaggcgtgagccaccttgcccagcccttcactaacttttttttttgtgtgtgtgagatggagttcactcttgttgcttaggctggagtgtagtggcactgtcggctcactgcaacctccgcctcccgggttcacgcgattctcctgcctcagcctctggagtagctgggattacaggcacccgccaccatgcctggctaattttttatattttttagaccagctggccaggctggtctcgaactcctgacctcggtgatccaccctccttggcctcccaaagtgctgggattacaggtgtgagccaccacacccagcccttcactagcttttaaaattacatggtgttttgttttgttttgttttgttttgttttgttttgttttgtttggagacattctcgctctgttgcccaggctgaagtaacagtggcgctatcttggctcactgcaacctccgccccctgggttcaaacgattctcctgcctcaccctcccgagtaactgggattacaggcatgcatcaccacgcccagctaattttttgtatttttagtagagacaggatttcaccatgttggccaggctggtctcgaactcctgacctcaggtgatgcatccgccttggccttccaaagtgctgggattacgggcatgagccaccacgcctgacctaaaatcatgtttactttgccagttatttgttacagtattgtggtttaaagtcttggattacaggttatttaggacagtgattcctaaccagaagcatattcaagttagttggggggtgggaggggcagatgttttctaaactttttcttttttcttttttttttttgagatggagttttgctcttgttgcctgtgctggagtgcaatggcgtgatctcggctcactgcaacctctgcctccagggttcaagcaattctcctgcctcagctcctgagtagctgggattacaggcatgtgccaccacgcccggctaattttgtatttttagtagagatgggtttctccatgttggtcaggctgatctcgaactctgacctcaggtgatctgccctccttggcctcccaaagtgctgggattacaggcgtgagctgccgcaccttaaactttttcttttcttcagaaagaatttgctcttatggtgagcactgttaatgatgggaatatcatattccgtggatttgttgggataaggaaaaatgatatactattggagggagtagataaaaatacatggtattgggtgatgttttgaacttggtaataaaaatttatgcaaaactataatggaatcataattttgcatgataaacaatgaagttgtgattggtgccttaacaaatgaaccctatgcaacgttaagtttctcatagtggtcaacacaacttttttttgtttctttgagacacagtctcctgtctcccatgctagagtgcagtggcgcgattttggccattctgaagttcaagcgattctcctgcctcagcctcccgagtactgggactacaggcatgctccaccatgcctggctaatttttgtattttcagtagagacatggttacaccatgttggccaggctggtcttgaactcctggcctcaagtgatcctcccgccttggcctcccaaaatgctgggattacaggtgtgagccaccgtgtccaaccacaactgtttaatagagcccatgttcaatcactcagtgatatgcaaagattataactgtttaccaaaaggtactaatgtattgataggctattggtagcaaatccttagctcagtgcccaggagcgaaactgagggtgtttggtttaaagaaaataattatccatcacattagaactgtctgtaatcttattccagactaggggagaatctgggcatagcatatggaagtataaatttaagaaacacaacattggctgactttgatgaactaacttatatatagcttccagagcttctgtttggtttttatttaatccttgcagtaattcctgaaaggtaggtgtcatgcctccatgatatgataaaaggtatgctaagttctattcctggctgtgtcataacatatgggtaagcaggactttttttatattcttagatttctcatctgtaaaatgactaggtggactcagtacccaagatcccaagatcctgtcaattcaatataaacttgctctaggaagttttttgttttttttttgcagcatagatgtaactggaggaacttttaagatagcatttgtcaaacagtaaagggcagcatccagggagatatttgagctctaaggctaactgaatcacctgctatctttggaaagaagcagggctccccaaatagcaaatgacttgtttggtgacaattgcagattgagattatactaaaataatggatccttaggcctgtgctttgtttctgtaaaaagaggaaaggatcatattctatagttaagacctgagaattatatttggaaataaatggtttagtattaaataatgaaaccagtgtgtgtttgtggatagttctattagtagtgaatccatggcctcctttccatatacaggttggtttgaaaattggagtataaggattttaggatttgtagaaacacggctattgttttgatttgctctaagtgctagttgctgaaacaaagcatagaggaacagttcttttatattccaaaatttgaaccctggttgctgacagacatcctagaggattaccttcttgtatgttattaagagttacatattgtgggaattatggaaattaaaaatgtggtttaggagaagataggctgaggattttacataagagggtagtttttaaacaaggtagtgtttttaagaaatgtgtattttagtattcgtaaagccagttctagattgtattactgataaatgatcatttaagagttcataagtatgaattccatattccttacttgtctctaattagcaaacactgaattcctggtctctaccaagttgcttagttacataggaaactagggtaccctcatccttgaataatctttctctaaaagattacaaggttaattttctcaattaaaatcataaatttaaaatacttttatgtaatatcagctctctaccaggtataaaacttgaaaaccttttcacagggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggtaaaattaagttttgtcgtgtttgaaaatgttcagatgtgacttgaattgtatttataatttttgttttaaaatttcacatgggttatttgtctgttaaagctttacataggatcatttggggcagataatttgctttataaggaaaataaactgtattatcacatattctaagaaatttagtcctttgatcaatttgtaattatgttttatgtggtagagttactttttcctaaaaagctgttagtggagtatcttgtagttattggtgttcagaaatatgatagttcttttcaaagttgtggttgtatttttgaaatcttgccaaactggggatcattaaagggctgtggtattatggtgttaggttgaaatcttgacattttcatatggtttaacctaaaatgtaagtgacttcatttagaattcaacttttgaaactgtctgcctataccatatataatggccaggacactcagtaaatggcaatgtgcattttgtctaaggaatgacgactttaaaaaccaaagtatatgtgggttttacttaagaaacatggaaactagtgaaaatacagttgacttgttgaacaacatgaggatgctaggggcactgaccccgcagatcaatgcacatgtaacctttgactctcccaaaacttaactactaataacctgttgactgaaagtcttagtgataacataaccagttaacacattttgtatgttgcgtattatatactgtgtttttacagtaaagtaagctaaagaaaatgttgagaaaatatatttactgttcattaagtggaactggatcatcacaaaggtctttattttggataggaagaaaagggattgggcttgcttgtctcaagactgacagaggcagaatgttcaaagccacgttgttcaagggtcaactgtattggagaaagtcacattgatggcttttgatttggtagcttccgtttaagctttggggtgtgttcttagaggaatgtttcagtgcggcttcctgtttggctttaaaaactcatacaagccctaactatattatttcttctcctaaattcattttctctatcagcttcctttaaccttttgacatttgtgtttgatttattcatatcataaattgggctgtgccagaaatccagactgagttttatcatcctaaggtaaagttaaattaaaatattgtgagggcaaaccctttcaataaggtattagttatttttattttttttttttgagacagaatctggctctgtcgcccaggctggaatgcagtggcaccatctctgcttaccgcaacctccacctcccggattcaaacagttcttgtgtctcaacctcctcagtagctgggattacggacactcgccaccatgcccggataatgtttgtgtttttagtagagatgaggtttcatcatgttggccaggctggtctcaaactcctggcctcagtgatccccgcctgcctcagcctcccaaagtgctgggattataggcgtgtgccaccatgcccagccaataagcataattttttaaactgcaaaatggctataagacaaacttggaaacattttaaaataaaatggaggttaaaaagattaaaagtttttttaggtttagagatgatttttaacatttacttcatatgagtagtaaatgaggacattgtcttttttaagtcctgtagaaaaaaaactgcattagaacacgtggtttcagccaggcgcagtggctcacacctgtaatcccagcacttttgggagactgaggcgggcggatcacctgaggtcgggagttcaagaccagtctgaccaacatggagaaaccccgtctctactaaagatacaaaattagcctggtgtggtggtgcatgcctgtaatcccagctactcaggaggctgaggcaggagaatcactttaacacaggaggcagaggttgcagtgagctgagatcacaccactgcactccagcctgggcaacagagcaagactgtctcaaaaaaaaaaaaaaaaaaaaaaaacaacactttaactttcacatgtcttcattctcgtgacaaatgtgaggtagttaaggggaaggaagaaactatttacaaatggagaactgtgttaccgtgttattgacagagctcagagtttctgttttctgctcctcattgtctgagtgctctagaaaaaaggtcggacacagtggcttacacctgtaatcccagcacttcgggaggctgaggtgggcagattgttgagttaaaagtttgagaccagcctgggtaacatggcaaaaccctgtttctacaaaaaatataaaaattatctggatgtggttgcgtgcacctgtggtctcagttacctgggaggctgaggcgggagaggatcacttgagcccaggaggcagaggttgcagtgagccaagatagcatcactgcattccaacctagttgacagagcaagactgtttcaaaaaaaggaaaaaagaaaaaaaaaaaggatccccctgccctgactttatcccagtacagtttcttggtatctgcaggggattcgttccaggacccagagatattaaaattttcagatgctcatgtccattatataaaatggcatagtatctgcatatagcctaaacacgttttccctatactttattttttattgtttctattttttaatttaaaatatagaacaatttacagttttgcgtgtcatccttgtggggatcatgctaataatctttgtattgttccacttttagtatatatgctgccaaagtgagcactccctcatacactttattttgagacaaggtcttgctctgtcatgtaggctggaatgcagtagcatggtcacagcttactgcagcctcaacctccccgtgctcaagcgatccttctagctcagcctcctgagtagctggaactacacacctgtgccaactcctggactcaagcagcccttctgcctatgcctcccagagtgctgggattacaagtgtcagccaccacacctggcctactttttattgttatatggttggttggttttatttttttctgaatattttcgatctgtggtttgcaataaattgaaagcattggtttgaaatagcaaacatttaaaaatcacacaattagtatatataattgattctaatttgctggtgttttgtgaatttgtttttatgtttctagcctcctttaaaatttgtattagaacattctattgccttacagtgtgttggtttggtacaaaggagtgacatttaatactagtatgagttgatgtaaggggtgaaaacatggataaaaacacaaaaatttatttgtactttaaaggctagttattaacagctgtaatattttaagttgagtctaatggaattgtaatagtacaagttctaatgaaagaacaaaatgttctttatccctttagaaaagaagattccttagatgtatttaggaaaagaggaaaagaaagctgtactttcaagtcctataagtacagttttcaactagaagattaaaacccatcccaagcgtacaagaagacatcaggcatgaagcagtatagaattgtctggctttttgcttttttcccccagactgggtcatgtatcttaaacgcaaatagaaaagaggatctggatttcacaaacatgacttcatttttaagaagtttctagctgggcatggtggctcatgcctgtagtcccagcactttggaaggccaaggccagcggatcgcttgagcctaggagtttgagaccagcctgagcaacactgtgaaaacctgtctataaaaaatacaaaaaaattagccaggtgtcatggcatgtgcctatagacccagctacttgggaggctgaggtgggaggatcgcttgagcctgggaggtggaggttgcaatgaacccagatcgtgccactgcactccagcctgggtgacagagtgagaccctgtctcaaaaaaaaaaaaaaaaaaaggttcctgtgacacatttaaggtgtggttttatttgtgcatagctttacaagattcccctctttatgtaaagtgtgtagtgtttcacttgaatttgtagctctccaatttgtgtagaaaaacgtagtggttgtgtattaacagaaaatgcttctgagaagtttatatctagtaaggtctttaccctagttgtagttggaagagtgtagaacagagtttttctttctgagtgttctttttaacttcagtgttagtgctagtagtaaccttatatgtcatctctccagaggtcttcatcaaggattcacatggcagtcctgatctgaagggcatatttaaaatgtacttgtccagatttcactgctaaagattatgattcagtaggtctaggatgggcttcagccgtttgggttgattgtgatagcatacatgtctttagttgaggactgctggtattacctgcaattttgagatagagaaaagtgcaggaaaatcttcctccaggatcactaaagctgagccctagcttgttacctgtggaggcattgagacatttgttcacagaaagtacagtttggatttttggttttttttagaagaaagctcattatttagaaattttgcaatgttacttttctactaataacacaatcatcttcacttatatttttaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaaggtaatttaagactttcttttccttttacataatttaaggacctcttataagtcactggctgggtcagacttatgtcacttttgggaacataagtagaagtagtagcagtgtctttaagaaaccgcatgttaggttatatttatgtttaaagcacttaaatgcctttttgtgtagtgctgttagtagtgttaagttaccacccttttgagttctttctaggtgccggtcatggtgctgggctaggcattttatgtacttaatgtcatttaattcttgttactgtgatgacattctcattttccagatgagaaaattctggtatagtgaatcaggttaactcttggcctttgctaaggcttacctgaaaaccagtctgttcactttgataattcctaactgctttttaggtctccacttaataaccattgtgttccttgtataattcctcttacgacacttaggattgttgacacttttttcttttactagactcttctgtgagagctgggattcatttttggcttactttctataatctctccaatgccttgaacagtatgtggcacaaaacaagttcttagagaaatattttggtgaattcccaagtaattgatagatttgaactcagatctgatgcttggaaacaaccataatgtcctcctaaattctcaacaccttacacacaaatttggggacccacctacttgattgagtctgtttttgatgattacaggggtaacttaccattgccagtgtaatgatactttgttcctccctctaagaccaaccttttttttttaaggtggtggttgtgttgatgggcttttcccatactttcttttttagttctgttatttatactttaggctataaagagcagtttggattccttttttcagactttcaaccttgatgattattgctacttagatattagttccttagcatgctttcacattggtgccattcttatttagcaagtggaaaaagtataagaatactgaacaatgcgaattcacatacataattgcttatgaatctacttgtatggtttattggaaaaagtaaaacaactgggctgggcgcactgcctcacgcctgtaatcccagtactttgggaggtctgggtgaacagatcacctgaggttgggaatttgagaccagcctggccaacgttgtgaaaccctgtctcattagccaggtgtggtggcacatccctgtaacctagctacttgggaggctgaggcacaagaatcacctgaacccaggaggtggaggttgcagtgaactgagattatgttactgcactccatcctgagcaacagagtaagactgtctccaaaaaaaaagagaaaaagaaaacaacccatattattactctggaatgaaaataggccttggtagaaatttaggacagggctcattgcaaatacttgtagtttttttgtgatccataattttgtcttgatacattttacctagaattttaacagtaggatttttttttttttttttttgagatggagtctcactctgtttcccaggctggagtgcagtggcacagtctcggctcactgcaacccttgcctcccaggttcaagcgattctcctgcctcagcctcttgagtagtgggatcacaggtgcctgccaccacacccagctaattgtttatatttttagtacagacaggatttcaccatgttggccaggctggtctcaaactcctgacctcaggtgatccacccaccttggcctcccaaagcgctgggattacaggtgtgagccactgtgcctggccaacagtaagatttttttagagttctgtcttaatgtagacactagctaacaatgtaattttgaagaactgagaactgtggttaattttggtttttctttttcagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcat

SEQ ID NO: 37368 - DNA, 418196 bp, Homo sapiens
ttcagattactttgatgacagtgacttccagtcttctctgaaagatctccacgatgctggcagcccggacaggggcagcggggagtcagatctcagaggagaacaccaagttaaggagacagtctgggttttctgtagcagggaaagacaaatctcccaagaaagcctcagaaaacgctaaagacagcagccttagtccctcaggggaaagccagctcagggcgcgtcaactggctctgctgcgcgaagtggagatgaactggtacctaaagctctgcgacctgtccagcgagcacaccaccgtctgcaccacaggcatgccgcacaggtaagctgcccctgctctgcgcgggctttgggagacgccgttcgaaggtgctctggagaatgctttgatttcttttcctctgcagctggaagtcttaacggctctaattgccttagagatgattggcacttcagaatgtgtaaccacaaagagcaggatcttggtgcaaatggcaaataatgttccctgcattgttattcagaaaagacctcttacaaggaggcagtagatgcttaggagctgacaggacaaaagagcattatgatttttcttaagtaaaaatcagaggagttaagagatggtaggaaagtgctcccttccaaaataactacaaaaaagagtttgcaatctttcagcatttcctttgctctgagaacttggggatgagggaagaacatttgttttgcctggttgaaaagtggagttgagtagtgtgaacttgttgaatgaggggtcaggctggccatagggatgcagaatgggacatattgaccaccaatatagggatctgagccccgtgtctaagacagataacatcaggagaaaaaggtaacttttaaaaaagagataaatgtaaggcaaatctctatgggttttctttctgttctttactcagcctcagcttcaaataaagcagaggaaggataatttcacaaatcccagtgttccaaggcaaaacgtactgagtaaaaagtgtctggagtcctgaaatttaaggatgcttattttctataatttgtgcaaaaaatctcttaggaattaaagataattttggaagaaaaaatactgtgaaaataatacctagaatagctatgttattaaatggtaataaaaattcctttgagatgaaaaatggttccaattacgtagtcaaagtatggaaaactccttttgtagagactgtatggtagcactgaaattctgcaatgcagcctgtatcaaagcatccagtgcactctgagctgcctttctgtctatatttctatttccaaaagacactacagaaaaacttatttagtaattgaattaacttgtgcatatagactaaaaacttgtaccgtacactttaaaactcctcaactaactttcattttctctttttcaaggcagcaataaatagatattttaaaacctaaactattattcaaaaatcaacatttaaaaattagcacaaaataaagcttctggaaatgttctatgaaatacatttggtattcatggccagagtggtttgtctgaagctcttgtatatgctgttgggcccacatttggggtacatgggaggaagaccaaaggaaaagtagtctcgtttaaagaaagtttgaatgagcttgttagtgttacatatctcatatttcaaactattacatatctcacatctacaaatcttaaagctattattaaagatcctctaggaaaaagagttaagtggcaaaggaaagcattgaaaatggttttcttccgtaacattttccttgacttgcgatataccagaaatttcctttaaagagtctaatacaagaccacagaattcttcattatctgacattggaacaacattgaacaagtcagagtggcatattagttaaggtaaccaggtttagcaagaaacttttggggaaaagcaaatatctgctcttttctgcttcacttaaacaataatattttgttctgtaatcagaaaagactagattagacatgatccagaattaatgtctcctgtgataatctgtggggtagtgttattaatcactgattgacaatagcatggtgtttcccttgtttagtaaaagggttgaaaaagagtgaagatatgtccaccttacatgatcaaaaattaaaaatttcccatcctcctttattattgcagcatgattatttccaggaagaaacgagtatgtgtagttggaactaactctatttataaattaaatacatttattacagagttcaatgtttgcaatagctcaggaaactaaggcagtttttctcatcgccagcaacttttttacctctcaaatgttggaactacattcctctgtcgagtccttgagattcctggacagtgacaatgtctgatggtgcaatctcttccaaatttaatgttagcgatagaatgtacgatcccccaagtcacccaaatttttctttcatttgtaaatgtcagccgttgagaagtcccagaaaattttcttggacttccaattgttctttcttccaataacatggcccatgagtgatatctccattagaaacttgtatgtagaagataaatatgattaacttataaaatattaacaaatttatccacctgtgaagcattacttacaagacagaatatgaaatgtattgaagagtccttgaagacattacacatttgctattggaaataattctgtgggtctttggttaatgttcatcagtaaggaattgctagcgaactcaaacttgtttcctttcttggaagatggaattaaaatattttacatcaggttaattctagttcctgaggaatttgaggattgctttatgtccatattctatggtaatttatatttgaaacaaagggtattattaaatgattggaagaaagcattagagttgggggagattcagcagtcctggtatatttaagaagtaaaattgcaggcagcaggatagggaatgcacattaggtttgtggtaagtagttctgactcctgctgtatttacatatgactatataatgaaacaatctaatatactttgcttaatacagatttattgttcatctagagttgactgataactctgtgatactgatttttttagaatgacagctcagggccctgcaccttgagggaggatggggcaggggccagagttctggagttgaaggcaaaagattggcttttcttcttactgcctgtaactgtgggcatgttttttaaaaaaagtattgtttttgaataaaattttttttctgtttacaaaagtaacatctgaactttgtagaaaagtttgaaaacaggaaaatataaagcagaaaaggctactgttgttaatattttgacatgctttccccagcattttgaatttgggtcatgggtaaaagtcagaatatgatcatatcattccttttttcacttaatattacaccaatctattttattatcttaaaaactatttaaaattttgtaaggactatatcttatgaccataatattgcttagccattcttcttttatatactatttatcattattagatataatattacaataaacatctttgtatcagattttaaaaaaccatatttctgcttattttcttaggatctatttcttttctttttttttttttctttttgagatggagtctcactctgttgcctaggctggagtgcagtggcgcaaactcagctcactgcaacctccgcctcctgggttcgagcgattcgcctgcctcagactcccaagtagctaggattacaggtgggtgccattacgcccagctaatttttgtatttttagtagagttggggtttcaccatgttggccaggctggtcttgaactcctgacctcaagtgatccgcccgccttagcctcccaaagagctggaattacaggtgtgagccaccgtgcctggccgaggctctatttctagaagtgcaattaatggatgaatgtattatatatgtgtatatttacacatatacacatatacagagatatgcaaatatatatttatttattcttaatgaatattatccagttgctttctggaaacatttttctcattataccttctcactggcaatattcaagaatgcctatcttattgctttctctgtactacacaatgtttatatggaatctttaacattgagttttatagttcaacaaaatgttgggttatttaatgaacttttccgggtctcaatttctttgactgcaaaagggtgctaacaccattataaagaatggtcgtaggccgggcatggtggctcatgcctgtaataccagcactttgggaggccgaggcaggtagatcacaaggtcaggagttcaagaccagcctggccaacatggtgaaaccttgtctctactaaaaatacaaaaattagctgggtgtggtggtgcatgcctgaggtcctagctactcaggaggctgaggcagaagaattgcttgaaccgaggaggcagaggttgcagtgagccgagattactccactgcactccagcctgggtgacagagcaacactccactcaaaaaaaaaaaagaaccattgcaaaacttaaatgagataatgtgcagtgatttgaaagaggaacgtgctttgttttcacactctgtaaaatagggcttgagatataacccatactgtacacggtgtatttaaggcctatgaagaaaattaaggatggatgactccaaaaatccccaacaaaagtatatacttcacctagcatcaagagctgagcatcccgctgtgctcaattaatattttataagagacctttgtgtgtcctcaccaaaagctttttaaggatttataggataccaccctcctgaggaaaagtgacttggagatagaatacaatgagcttttacatactatcagtattcacatttcaaacgatagttgactgaacctattaaattgaagttactaggaacatttagtagggcaaactgagatgtgagtgaaaatttagctatagcattttgatactgattttgaccaccttaatgaatgtttcttattatctaggacagtagttatactgagactcgctcctaatattttctctctctgctctcaaaactgcttgacttccaagaaagtgtttactcacacttgcttctagaaggctgaatgtggttctatgtgagaaaaggcagttagttttccaggtgagtttggtagacttgattcctgccaacaggcagcaggagatccaagagcttagaagcctttggttgagcttatgaaagcatcttaattgatgcaagaagtttatgcaagaagatattcttgttaagaatcaagctggaggtcagtgagtaaacattcaacagccattgattgagattcttgtttgtacaaggccctgtgacacaaagatgaaactagaaaagattctagttgcttgcagcctaggagtaattgggtatggacttggaagatgtgcaggatttgagcaggaggagatggggaggggaaggcaatccatgtgtagggaagagtgagcagaggtgcagatgaaaggggcaggaaatgaagatggagagctgcttctgttcatgaggctactaacagcatccttcaaagtttcttgcaggctggatctgggagtgtggccaggagaacaagaggagaggaggccatttgactactttggagactggggagttgggcagagagcaggcgtggaggagaggcagtgtgtgcaggccactctcaagaagaggcagtgcagaggagagagtatgatagttgaagtctgtagtagagtctggggggaaatttgtaggagaaagctgatctgtggatgtttttaggcaaaggggaggagtccaggggagagagaatgtgtgtaatacaaataatagagcaaaatcgtccccatatccccaaggagggggagcctcttgggtatcaaatgcaggtattagctttggcaaagtgaagtgtagctgggcctggtgatgaaaaagctctggagtctggtggcctgcaggctgcatctcagcagtaccacttactagcctggaggctctgggtaagccccttgcctgcgagaagcagttggttttggttgaggccacagatcctggagctaggctgctgggttcaagccctggctctaccaattatcagctatgtgatttagtcttctcagctataaaaagtgggtaatgatggcagtaataccttagggttgttacgggagctcaagtgacttaagtaagtatagctcacagaacagcagtgggcacatatagtagtaaatatgatattatacaaaggtcttagcatcattcctgacgcatgatctatgcccttgctattatcatgagattgttattggagatgccaaaagtagggatgcctctcttttctggagtgtactcacactgatactgtaaatgggcataaaaatatctagctcataagactgctataaggattccatgaaatgatgtaaatcatctggtgtagattagacactcaatcaattttggtgctcacctctgccactttcctctttttccacattcctggaacatagtggacagcatcagtaagatggtatcagggatggagtatggaatggtggaagtgagctacaatggaataactctaaattattcaaccaatattttttttcctagaaaaagctattaattcattttttgttgttgaagagaaagctcttccttttctaaaatatgatatctatttcttagagcaggcacattctccctaaggctgtaattcttgtcatgtttgcatgagcagtcacatagaagtattattttcagagatattggaatatgaggacatttttatgtagtttactgtgattttagttatatgctagaaagattgcctcctagctcattgttctgttgttttgcatattagagaaaatgttggaccactgaatgattgggctaggagtgggagagtgaacctcaacaggacaggatttaggtagccagagaaagttacagcattctagtagcagcctctggggagggttagggttgccatggccactaaagatggtgatgatgtcctttgacttggccatgaagctgccattgtcctgtgtagctgcaccactggggtggtgagttggaagtagacatccctggacgggcacatccactccatgggagtagccaaatgcacagggacttggttcagtctgcacccctgtgactgcttttttggttatcttgacaaaactgagccagtttctcagttttagattcctcttcatttggggtgtgtgtgtgtgtgtgtgtgtgtgtgtgtgtgtgcacgtgcgtgcgcacctggtttcttctgaataactgtggacacctggaaggcagtgcctctatctcagtcttctgacttgcccagagggttctttcctaactggacgttggtaaattagatagagcatcagctctggctcctctttctgagatctctctgccgctacagggaatgggctcatgtaacagtaggaaaattggttgaggggccaggagacatgattcaaatcccattttgcagtatggtcataagtaaggtttttaaagttctccagaaatcagtgctcctctgtaaaataatgagactagacgagatgatcccttgagctttgtccagctttgagcctgtggagtataatgacataaacctgaccaaaggggcacactgtgttgtttatagagacagtgcaactgaagtatctctgaaagaaaaaggggatgaggtgatactttgttttgaagttgtaggagaaggagaaaaattctctttgattttcaaagtgtgttattttagtgattggttgattactgacagatatgtttaattttttaaaaagtgttctttagtagaaggagacagagtaacacaaatacctacaatttgtagtatccttgtttataaaatgtcttgtcgtgcattatctcatttgccttcacatgacatagagcaggtgttctcctactttcctgtgagggaacgtgcctcataaaggcgatgtgcctgatcatctaggcccagatcccaggtctcctggttccttgtccaggcttctttacatgctttcaatgtttcccaaactatggcactctaattgtgccaaagataattttggggggcatgtggaaattaaatctttcaatgggttgataatttattttcatgaatattaggaagaaatatataacatacacctaaaatctataaattcatggctatgagagcagggcgcaagggtaagttttaaaataaatgagtcaattgagaggaaaacattcactaactgtaagtagtggtggaattgagatctgacaaaaatcctcaaggtgatacacaaaggactatttctttcatctccttcataattatcaagcatttataaagcatcatgccttcttcccggggcttttatagtcgttctgtttaattcatacaacaacctcatagtcttgttacaacccatatccttcagtgaaggagagtgtggttctgcctattcattttttgtcagtcgttgattttttttttcttcttttcccattaaggggatgaaatattccctgagctacctccctgctgaatatgcttaagtatgttccaggttatctttttgagccttcgttattctactccatatcgaaggtcaacctttctagttctgtctctatgtaccgaatactctgcttctctggggtgtggtgatatcataccatgagtttaaaatttagccttagctatacagcttagcttattaaagtttcacgtttacttttcaggttgttgtgcagttgtggtattagccagttagagatgttgtgcctcttgcctcctctataagtcaccacagatatataaactggggacacattaatataagctctgatatcaggctgacttaggtctaaattcaaccccttacaatctgtgtgacctggaacctcagtcttctcaccagtaaaatcagaataacagggttacatattcatagagttgagaaaattaaatgagataatatccataaaagttttagcacaatgctgagtgcataggaaggggccttcagcaaaagccataattactattcccctttgaagtgccatcaggccatctgttattttgcctccctgatcttcctttagctaggagtctctctatgagcccctcaagcttgggaaaattctccaagccttagcaaatggtcttgacatgctgcttccctcctcgtttaacttagaaacttgttctaagattttcattcataccctgatttaaaatcttttctgattaacatggaccaaacgccttgtctgtctcacacttcctctctccatgcacagtggatccatctcttgactctggaataaaaaggcctaggtttaaatcctagctctgtttctggctggttgtgtggattttagcaaaacacctctcctctccaagccttgattttgtcatctatatggtggaaataaaaacatctgtgttatccatcttctaggattttaaagattagatccaaagtatatgtgaaaatgctctgtatgttataaaccactatctatgtgttcgctattatttttattaccttctgcactggacatgggctctacgtcagcttagaacatggcttaagagcatggttaccccaatctgtttttctagtaaaaataggtgtagatgtagccttcattccttcattccttgaccttgaacaagccttcctgggtgagctgaccaaagtctatgacatctgccttcttttcctaatatcaacaactgtttattgaatatttattatatagctagcacattccttagatattccattgattccttcccaatgatccatgtgcatgtgatgcctatttttatgatcttcactttgtggaaggaaattgagccttaaaaatgatcctgcccaatgttagccagttaagcatgtgataaagccagtacttgaatctggagactcaggctgcagactgcagatgcacatctcaactcaacagaatggctccctgccctagtttgggttgattattgatcactacaaagatgtcattttagtaatttcacttttcaccttcactttccaccacactataaggttctgtaactcgggatgtggcagtcatgtcttcccctcccatttgaagtctttgcttcttgtcctgcacctgtctatcaaaaggctgggaggctggaatgttgggaagtcacttaggtggatagcaaagggttgtgtcataggatgaactatggatttttatgtttcctcaggcttttctcccacagaaactgtttccatcgaaagagctgtgtaagtgcagaggcctgaggaggcacccaagtgacatcccttattagataaatttaattcaatttcagaatttgagtttaagtcaggctttggccatctccttctcatcctagctctgagagctagacagcaatagctgcccaggtctttcaaattgtagactgtggttgtcactgaatggcatgtgctaatgtcctgccagggatttttaccattgtattgtgtgtttttgctgcatgggaggaggaaacaacacggttttgaggagcacttactcatatttctttggagatggcagttgaaacaacagctttccccaacagcctccccaggtatgtgaaatgtcgtcagatgtcagttttagagaaaaatctccattccatggcaaaataaattaggagctttttgtgcatttttggtacacacattgtgacctaatttcaaaaagaaacttgccaaatattttttcagtctccaaaaaattaaactaggcttcccgccagatatctggctctggttcccaatccaggaacggctcccaaatgctgattgtgaataggctgtaggtgaatgccttttacaaaataaagtgcattgtttttattaaaggtaaccctagctgcaaaatcctgaaaccttaataccttgaaatcagaaagtttatttcaagctgagtacagtggtggctgacaatggtagtcctagctactcaggaagcagatgtgggaggattacttgagaccaggagtttgagaccagcctggacagcacagtgagaccttgtttcaaaaaagagaaagtttgtttcttacttatgcaagtccgaccaggggtgggaagggtccagtcaggtgggacttgggctgatgaaaattctgtcatcttcatcttttgttttctaagctgggccatagctgagcattgacatggatcaagagaggagtatgggaggagcaggtggaggccccattttgtgggccagacctgtaagtggtatctgcaggcagaggcaacattgactggaattcagccacatgaccacattcaactgcaaagaaggctgggaattgtagttataaatgtatgccttagaaggaagagaagtgggcatggtgaatcccaggtctgtttctgccacagagctgtgcttgaaacagggttagggagcttctaaggtagagtttggctattttccataacatggagagaccaaggtattcctttactttcaatgttattccccttgttcaaactggaccccttgacctgacctttcctgagccacatggtgggtcaatctcttctggcttctttgtttggatctcaactttcctgtttcactgagaaggctgaggacacttcagagacctgtagatggtcatctgatatccacctggcagtggaacactgataaagtaagcagccttccttatgtcagtctatgagcatcagctctcattttgaacctgtcagagtgtttctcattgccttgagactcacttacggctggatgaggctcttggcagctcatgtgttattcctcccccattccattgtgagatggagttgctgcaaggccatccctttccatggtaacagccacagactctggtgccacagacatgggctgatgtctcaggaggcaggatcaggcacatggaaacaagggtcagggagcacttgtggagagccaggagagctcactaattcagtctgttatttcagaatagataaggtgtgtgtttttaaggggagcttctacaacattgtgttcatttaaacagtgtaatcattacacatgtttttctataatgtacctccaggattcataacaacagacaagataatcactttgctcccagaagcaggagacagtgtggttttgaatgtaatgttgttaaataaaattgcatatcctcaatgatattctggcattcttctctgagtcactatcctcagtcaaggtatatatacatttttgtgcagaattaatgaggaatttggagaataataggttaagaaaatatggtttgtatacaagagactttttattacaaatatctccaatttgaaatatttccttaaaaaatcaaagcctaaggtacatttcgtagcttagtcttcatatttaatttgattacagcaatggacattaagtatgaaacaagctgtccaaagggctgttgaattatttaattacctctgggatttaggaggtgagagtcagcataaacaattccacaagtgggatgtgttagaaagatcagctctttctgtctcaagcctagtaatttgaacgatgtgactatccaaacaccagttgctgttgaacaaaatattaaatgcttaaatctgtttgcaatattttactttccagatggtcatttatccaaaagcagtactgaatgtgttttaaaagtattttcagttaaatgaattttcaatgaggttaacattcagaattagttttttaaaaaggaaaaaatatacttacatttaaggacattcttttattaccatatatgtaacattgaaatagtttctaacaatcaaactagaaaattaaacagaatttattaaggaagtttgagcatctaccatgttccagttctgaggatacagggatgcagagtcagggcttcttgccctgaatgatcctggagtctgttcagggaagacaacactacagtcaagtttttttggtgtgatattagaagtgtgaaggaaatgctataaaattcaggtaaaagggtgattagttatgccgggaggcagggagacagggaagagaagcatcaggaaaaaatacacttaagatgcaccatttcaactagacttacacaagaatgcatgggggtttgtgggaatgcgaaccaatgaggaagcaggtaagaaatggctgagggaaagaaacatgtaatcggcagcttcagaacaaattcgttgacttttgtttttttttttaggctaacccaccaaattgctattaactggaaaaaagttatgaggatgggactgataacatttctaaatgcaggaaatattcccaattaagcctcattcatctgacattgtcagagaatgaaaattttcacccaggtgatttttctaatacctgaaactttctaatttaagtgtcaaggctttattttaactttctaaacctgaagaaacaacttgacaactctcatttatcttaataaatgtcagctattgtgctatgttaaaatatcctcaggggctattaaagcatatggatctatctgccttgaaaattggaggcctcattttgctattttatttttaaattttggcttctgaaatttttcttcctctattattttttctgtatcctcaccttgctgtaagcttttcttgctgctgtcaggatgcctgcctctgatagttcttttaatctaatttgctatctttactttagggagggatgggaaataagaaatccagtcgtgttcaaattatgaccaagaaagaatacatggtttatgaattgaggtactcaaccaggaggtttgaaatgtaggctttgggatatcttatttgttcatttgttcattcttggttgtgttttatctggaaaggtttctaaaaaaggtgatctctacaaattcagttgttactctatttgaactaacatttgaatctgtttgggaaaatgtcaaatgctgaaattacttcaagtttatgtttatcttggaataaaccatagagattttataaaagcaaaccatatagaacacaatatttcaaaatgttgatgggatgcttgtagtctacattttataaatttctcagccaaagaaaacattctagcacaaatagagtaaacaaagtgaaactattcatttgtcttctatagcagagacacactgagggcttttcagtggattgtttttcaacagttttgccttggaactttggtgattaaacatttacaattattgtacagtgaaatggcatttcaagaggcaggatggtatatttgggaattcaaaatatataaacagatttagttttcttttttcttttttttttcttcacggtggagtctcactctgctgcccaggctggagtgcagtggcataatctcacctgactgcaacctccgcttcctgggttcaagtgattctcatgcctcagcctcccgagtagctggaattacaggcttctgccaccacacccagccaatttttgtatttttagtagagacagggtttcatcatgttggccaggctgatctcaaactcctgacctcaagcgatcctcccagctcggcctcccaaagtgctgggtttacaggaatgcgccactgcacccagcctggtttagcttttttttcccccattttttttccccagaggaaaagctaataactcagagagtattcaaatcatgcaactattaggctgccaggcaaagatttaagtccttgtccactaagcccatgctcctggaaacttgcactttattccagtccttacaataatgactgcttaatagtgccaatttacctggatgtctattaccttatttgtaaaacaagataattaaatcagtttatttttaagagttcttctagctctagttagactcctagatattttagattaattgtaagtgcctagaagatgaagagagagattgcttgattggaatgatcccagtgagacttcttagtgcatgatatcacaaaactgaaaatataaaattttaggcttgcttttgtagttgagatttacttttcatggtgccattctgcaccccagcctccaaggccttgtcatggacaagttccagaccccatagaaataacgtgtcaaagaagatagataagccccatggcagagcatgtggcaccagtgtcaaaatatgtggagttctttgcaactttcaaaactgctttctgagtaggcacttaaggagtgatggaggtatttcttgctagatgaagaacaaataagcatcattcagataatctctcatttctctttagcaagggagaaagtcatatttaaagccatccccatccattttgtactcatgcagcccataacattgaagtcccctgaaaattattgcttgtgagaagtctaagtctcccacgtataactgtgtgttctgtgcactgcacaacactagggggcacaatccacatgggttaaaatttggatggcagtccttggagttgtgcagtgtatgtggtaacccttagacactgacagcattgcaggtattataataataatcaccatttattgagccatttattctgtactagttacatcaaatacaatatttcttataattttcacaacaccctattaggtaatatgatgagctatagtttccgggggaagaaactgtgactcagaaagtgcccactggtgggttgtagtggcaagatttgaacccaagccttcctgacttcatagcctgtgctctttctactatactgtactctctgtggaaattcccctaagccaggccagtgcagactgggataaagaagaaggtgatctcagcaccctgcaagcattacttcagtgttgacttaacagcatgagaccacaatactatcatgatctcaaaccttccatggctcaacattacttaaaaagagagcctagagcctaaataatgtgactgagacctcatctcccatcctttcgacgccgctcacctacctctcctccaaagtagtcattgcttctaactgccacgttttgaggtatttctggccacattgtgcacttttgcacatctgggccccatggaccatttcccttcgtttagctttagactaaggccacattttggcatcttttgggaacttttgaataaagagcaagagagtcatgcccaaagtaggtgaggagagtttttgctacagatgccagagctccactcaaagatgctttctagttgaggactgtgggaccaatgcagaatagcagttaaatctcaagggccagtcttgcccacaaaccctctatgccaaggtagagatctatagatgtagtcaccaataaatacgctcatttttttcttttttttttaaacttttatttttggtttgggggtacatgcaaagatttgttacatgggtaaacttgtgtcacaggggtttgttgtacaggttatttcattatctaggtactaagtctagtaccaaatagttattttttctatcctctcctactcatttttttctaaagcaaggttatagtgcgtatgtatcatacattggtggggggggattgtttttatgctataacgcaggagtatacagtagataagcagtagggataaggaaaaggaatcaggtgagactgaagatgctacctttgggtctagggagaaggagctaaggctggctcaacaggggctctccattagtcatgtgttgtactcccatgcactgtaacatgcaccccctcccctatcctaccaggactgttgtgttgtattcactgagaaaatctcgactaacaggagatgtgagggattgcctagaaaaacaccaatgaatgacagagacatttaacattagatttcttgatggactgcaaacttcctcttttttttttttttgagacagagttttgctctatcacccaggctggagtgcacttgcgcgatctcaccacaacccccgcccccaccaggttcaagcaatactcctgcctcagccttccaagtagctgggattacaggcacccgctaccacgtctggctaatttttttttttttttgtatttttagtagagacgaggtttcaccatgttagccagactggtctcgaactcctgacctcagatgatccacctacctcggcctcccaaagtgctgggattacaggcgtgagccactgtgcccggcctggattgcaaacttgtgaaagaactccctccactcctcccaccctttacctttactgctgatgttgtctcagggtatcttctctgatcctctgctcttttcccagactgggtttagcctcagtgattgcctctatctttgctcatatcacatcacttcgtagtctttactggtttctctcctctcctccactgagagctccttgatgacaaaggcaatgttttatgcattgtgttttgttaacacaacacacacatactatacttagctgtggtcttgccacatatagctagaccccaaggtagctctggcaagggtgaagagaagatggcagtgacaggaggagcaatccctctagatggttcccagtgagatgaaggcagatgtctcacagcatcacctgcagagcactagtgagcaaacacgtgaacaagagcagaaagatgaagttccggtaaataatcagaatagaaaaatatgcgctggactgtagtgtggtgtcccttgtccaaattgacttggttggtcccaatacttccccaccccggcagtgacagtgcattcccactcctctagccccaccagctctggcctcagtttttattttagacctggatgttcttggatgactgcgacatgtccaagatatacagtgttcaacaaatcacctcgttagccaagaaaaatttagaactaggctataaaggtgtttgctatattccaagaataacataaatctcacgagcctggtatcttttataactagtgaataattcatggactccaagtctcgccagtaacaaaggaggaaggatcatcacctctatagcatgattagagcaattactttttaagatacacagaacatcagatgtagactagaagaatcttagagattacctaagtctgagccagtagagaaactaaggggtcagaaaggtcaagacctgtccaaggtcacactattgtttatgaatcctgaacaggtgtagatgaagtctgcccaccacccagagctgcgtgagcttctatatgtggcttctgtgtcccaggcctcccgtgctccatcagcaggacggggcaggcagcacctgtctcatcacatggccttgttgctttttcctgcactctgctgaccatgtgattgcacagtacttaaatatcctaaaaagaatatgaaaatcatcgttcctgagacacagaaggaaagcaagaaagacattaactgtccttctcagctgttcagaggcatttcttacagtcttaccacattgagcttaaaattgatcttagtttgtattgacaaccaaagggataaatagttctcttattaaatatagtttctatcctccacctttaaactgggatcttttatgacattgacctgcttttagaactttatgaaaagaaacttcagttccagacaaatattggctttctcatttctctctcctttcctgggcccagttccaaatttggaggacagaatgagagggacacatgggagagggctcatgccccatgttttagaaactgctttcctggttcacctgtgattcttccttggccctccgctggcaccactgcctgaacctccaggtgttctcagccctggaggaaccactttcatggctcacatactcagatttaactggtggctaccataagtgatgtcactggtgcaactttacttgggaatgctaatttctccctaactccattgtactgtgttttttttttttttttttttttttttgttccccctagcttttctggccttttctttataagctcttatttcttctttcatgctcagggcttttgctgctagggtgaaaatggaaataggtttatgagagaaaaggtagctattgggagtttaaaattaaagcaaggaaattgttaatctctatgcaatgttgattgtgcacaaagcatcattctgatcattataactggagtttacaagcttgtgtcagatacagtcccttccctaaaagagcttataatctggatggggagttaagaggtacacttgcaagagatgtatctcatactctggaacagcatattatgtctttgtttcccaaaggaggtacaagtaccactcatacggcattaaataactgattcactttgtaaatgtagtgtattcctgtttcaatttcctttcatttttttctcattatctaaaaagaagggaagagaaaatctcagatttgtgctaaattatctttaaaacctttctaatacttttaaatctttgtcaataaaagataaaaagagttaagactctgatcccaagcctctggacactaagtatccagctgcaatgtaataacattcttcatttttattgcattttttacagactacattctattttattacaagtgataaggtttttctgtttatggtggtagtaagataatgttttctgactaaatgtcttagttcaggctgttaccatagacttaatggcttaaacaatgcacattaatttctcacagttctggaggctgaagtctgagatcagggtgccagcagggtcaggttcttggtaagggccctcttcccggttgaagggccgctgctctctccttccagtgtccttacatggtgaaaagacagcaagctacctttggcctcttcttataagggcattaatcctattctgagggctccaagatcacaactcgcttacctcccaaaggccctatatcctaatatcatcacactgggggttaagattcccacatatgaattttgggaggaatgcaaacattcagtacataacactaaaaaaattcatttaggtagaaaaagcaacttaattccaaatagtaaataaataatggtataggatatacaaaaatacggcagaaatcacaaggggtgtgcaaatgtttgtgaaacggtttagaagtgtgaagtgagggctttaggtttgaattgcaagtggaatttcaatgaataattgtgtaccggggctgggaagaattcctagaggaggtgagctttaagggagcatgtgcgcgtgtgtgaagattcatgtcagcagagatgtaagatgtgatggcaggtgggaggtgtgagtgtgaagctgttagaccgaatgaacagtttatgtccaggagtcacagttggaggagagtcacagctggaatcatgtggtggaaaaacccatatgtgaggagtttctttgcttttttttttttaaactttctattttgagataactgtttattcatatgcaggtataagcagcaatagagagattccatatatcctttgcctagtttccccaaatgatggtatcttgccttgccacagttcaatagcacaatcaggaaactgatgatgacacaagcccctgcccttattcagatttttccaatattatatgcactcatttttgagtaatttatatttagttccatgcagtttggttacatgtattgattgatgtgaccactaccataatcaagacacaacagttccattataagaatcccacctctacacttttatagccatagccatcttcttcccttttgtcttttctaacccatgacaattatgaatttgttattcctctctagctacaattttgccattttgagaatgttatatatatggaatgatacagattccaaaatgcaaccttttggtattagctttttttttttcccacactcagcgtaagcctctcgagatttattcaactggttgttttgaccaatagttcattccttttacttgctgagtggtatttcgtagtatgaatatgccacagtttaatcattcacccattatggaatatttgggttgtttctagattttggctattatgaataaagatgttataaacatttgtgtacaagttttcatgtgaacataagttttcatttctctgggataaatgcccaacagtgtgattgctgtgtcatatagtaagtttggaatgtttagtcttataagaaacttttctggagtggctgaaccatttaacattcctaccagcaatttatgagggatccagtttctctgaatctttgacagcatttagtgttatcaccatttgtattttagctattgtgataggtgtgtagtgatctctcattgtggatttcatttgtatttccctaatggctaatgatcttttgatgctcttatgtgccatctgtatatcttcttcagtgaaatgtttgttcatatcttttgcccgtttaccaattagattgtttatgtttttattgttgagtttggagagttctttgtatgttctagatataagtcttttgtcagatatgtggtttgcaaatattttctcccagtctgtaatttgctttttaaaatccccttcacgtggtatttcatagagcagaagttgttaatgttgatgaaatctaatttatgagcttttccttttatggattgtgcttttggtgtcaagtctaataagtcttcacttaactctaggttctgaggattttctcctgtttttacctacaagtttatagttttacattttacatttaaatccatgatcaattttgcgttgatttttgtataaagatgaggtttaggtcaatggttcatttatttttgtttgttgctgttctgctttgcctcgcttatggatatccagttgctccagcaccatttgatggaaaagctattcttcctccacagatttgctcttcatatttgtcaaaaataattagccatatttgtgtgaaccctttgccttttacaaccacttgttgatatttgtctatcatttgacagcaacatctgaaagaggttaatggacctttcacccaaatgaatcatgcctctagtataaaaaattatttgattacaaaatatttaataatttagagaagtctcattacatactcatgaatcatccctaaggctttatggtccttataaaaacagattggcccagatcccaccaaaatatttccttttacctaaatagaaagacatgggaaaaagttcccatattttttttccccagggccagtacatagttgcttatgtttgactctgagtactttaaagggatgagaaaagtgattggccaccaaaagcctcctttatgcacaggcctgggcagggacacacaaccaacagctctgtcgggaacttaggagcctgctcgcctacaaaaatgataagagagatctaaagaaaacaagctaaaccttttgagggacatactgaagccagataacccaaggtattcacagcaagatacagtgagtcttaaagttaagcaccgtgcaattagctttgcttccttgggtttttgaaacatgcatctgtataaacctgcctgtgcagacatcccgagccccaagctgggtctgccaaaatccagtgaatcggctctaaaatgtagatggcacctagcagtgaccaagactcagcctcaggcggcctgcaaacctgtgaggcccagtggagcagccgaacagaaatatgtggaaaagtttctacgtgttcatggaatttcgttgcaggaaaccaccagagcagagacgggcatggcatacaggtactgctgattgcaaagtcatccaaccagggcactgcactgatgtcaaaggttgttattaaagaaataaggactgaaatagcaagacaaaaccctgtaagaaaaagaaggaaaaatgcagtgagccctcttcttgggttgcattcttgttttttttttttttttttttttttttttagctttaagcgttctcttttctcagagggttacagaaaagacagtcaagttcatctgtggaaactcctaaccatgtgctccagaagaagtatctttggctctgagtagggaggtgatttggcaggtcaaaatgaagagtggggactccattcttcttaagggaaagagaatttataagttaagagtagaatttttttttttaatgctgcctgggattcaagacttattttcttctaaacttgaatcatgtggtctgtactaatagctaataaagtagttcaagttctccttgaaatgacagcactttatttatttatttatttatttatttatttatttattttttaaatcagtgtcacccaagataaattactggttgtacactaaacttccaatatcattatttattttatgaaagattaacaaaaaggagaaatgttttcttggtatagggttggatgtgtaatctttataagttgctctgtgatgggaagaatctttcctattcagagcaattattgctcctgcacaagtgcttcctttacgtacgcctggagttttaaacagcccagaagctgagtaaaagctattcagaaggacaaggtactgaaaactgaaaaaacaatttagcaattgtaagaacagttgtcctagctcatatcaaaacttctgcacagcataagattgtttttcatgtacaagatgtccccagtgatttcatttttccaaaatctgaaggtctatttcagtgtagtagctgctgctctaatttatcagctaattatattcataaagcaatttgcaatgatatggctcctctctggagagcaaagtattttacacagactctatgtaataaaagggttgtgcagaaaagaaatgaactcttctcaatttataaggaggataggacagcctaccacatcctgctttagaaggggagctcaccttttcatggtagctcatggaatgaggagggatggatgaggaggagatgctgctgtttctttctgaatctgtcaccggaaggagcctgcttctctgtccccccacgttttctctcttctccgtgtttcctcgaccctcagtggtggtagtgatggtgatgtgaacacagatcgggcgaaggggaagatggaccatttcacttttaaaaaagtctgcctccatgtctttgtcataggatgggtggtattaccatgaattgttacataaacctttagagggtatgcctttctctctcaaaagtctagtttaaatatcaattacagatctgtgctgtgtgccaatgttcagatgaaggtatgttctaggaaagcatttttcaaaggattatgaagtagaggaacacgttcttcagacaggtgaaagcaaagctgcctcagctaaaggtgggagcttggagcccacctgcttgaggggagcagtcatcccccagcctcttctgagacacctatgtggattccatactccccataggttttgggcgactcttcatgatgccttggtggggaaggctctgttaccttggagatgccagatactgccttggacaagggtgtatgctaccatatcacaccctagtaagaaatgggacttaggagaatgttgcccctaaatcagtttgaggggagaaaagcacagtttaattgatcattaaccctaagaaatagccaaggctctaaattatgatgagcttgtgctctgacacatcttcctgacacatttctccattacccactccccaatgtccttagtgctctgtttattctccctttaagacactcgcttactgcccttatttaagacattctcctgcaaccatttggaaaggatttttaggaaagagaaccagggttctcttggctcctccccaacttagctttagaccttgatttcttataaacatagttggggttaagagagaagctgactttcatattcttacttctttattatgatttttccccctcaggaaaaagagggtgggcaggggaccatggctatgttaaaaaaacaacctctgttaagccttgttttttctattttcttttttcttgtaaagttgaaagaaaatgggcattgaagttaaacagaccagagttcaaattcaagctctgcctgttttagaactgtgtgacattgggccagtcatgacatagaaatgtctaatacagtaggtgctcactgggaatggaggttttcttcccacttactctgtagtgtctgtccatcagtctaagtgggggagggattgaaaccctttaggtgaaacatataaatggataagagaatattctcaaaaggaaaaaaaaaagaataagacaacccacagtagttcacaatctgtgtaggtttccatgctcagctttagaattctgagaggtctggaagagccgggtaagctgttttccattctgaatttggtcagacgccattgcagactttagcccaataccagctgcttgggtccctcgatcatctgtgagagagcattatgttgtgtttccatggagacttcgttttatttctaactaaggttgaccaggaggagaaaaaaaataagtaaatatgcaaacacatgcatcaattgaaaagaaactggaggacattgaatgtggtgtaaaaagtgccaagttgctgtgtagatccttctgttggcttagaaatctcagcaaaaatagaagttttaaaattcattttatcagtgactataaaatggttacctaagagggtcttcagtttactactaagaggctgaaaattaattgtctttattacatagcactgaactctaagccagacagtaaacacgagcctgagtcaaggttaaaatacactgaggagtagttttatgagaaaaacaccaaaaatatctagactgagttaagatgtagcaaatacctagctttgaagcaatcttataatactaacattggcaggagaaacttaaacagatataaaatgaagctctaatccagggacaacacttttcctgtaaaaggctagatagcaaatatttcatgctccaggttcgtatctgcctctgttacatctactgacctctgctatgtagggtgaatgtggctattgatgatatgcaaatgagtgggcacagccatgttccaatgaaactttatttatggacacggaaatttgaattttatagtttttgcatatcacaaatcttattttttcctccaaaccactaaaaatgtaaaaatcattcttagcttgtgggccatacaaaaacaggtggcaggctgggtttgttcagcaggccatagtttgctgacccctggtttagaaagcaaggccttcagttgctcaggttatgtatttacttgtttgtatttatttatttttaaacctttttgtttccagaggtatttaaggaactcaaatgcatataattgagaaagataaaaataaattacaaagaagatagaaaaaacagtgccaagaaagaccaaaagagcaggaagggaacagagagcctggggtgagggaccatgctgtgtataagccaatgtgttgcaagagttagacctggatttggctctgtgctttccagcagcattaaattgtgaagagggaaactgagccctttacaaagttacagggtccttgagttagagacaagccagttgctccataatggcacacctcttcctgatctgtaaatcagagagaagttccttttgaggttcttctttgtgtaaggaataatatccttgcaatatccttatagcaaacacagcagcaaggttcctagaggatctttcctgtggagcccctaatattactatcatatcaaataataactcagtaaagacaaataggtgcataatggaaaaaagtgacattgtttaaatagaaaccatattggccactttgggctatgctttaagaattttccaataacaaaaacacagatttcttttttattcttttttttaagaatgacagggcttctccaggttcatggaatgaagcaattgtttctagaaaaataagtgttatttgccaatcaaggataaaattttctaaagccttgagctgacggcagggagaaggctataaaagaagaaagggaaaagtagagaaactcttggaattcttaacttgagatgggccttaaggataatctgctccaatttctggtcttacagctgaagaaaattgaggctcagagatgttgagtgtctagcatgaggttgcacttctagctagcaacaaaactaggactagaacccctgtctcttagttctcattccagtgctttcttcaagctttccatatttattcccagctccccaacctccatcccaccacatgccaagacacacacacacacacacacgcacgcacacgcacacacaaacacacaccgcaccctggagatactgcagatccagccatattcaccgtcctgctctgtctacttttccaggctccccgttattgtgctctgtgacttgcttagtcctgctgctttgcatgcttaccctccaccttctgccagaatcattgagtctctactcatcattagttttcctacctggaatattcttacacatcccacttgcctaggtaactccaacccacagggtctccttttgcccctacagcattgaccaccagacttttctctatataggatatagattgttagttatttgtgtgtgtgtgtatcttattgtcaaaattgtgcatcatgaccttgaggatgaggactaaaacttatattttatacttcttcaatgcctttgcacttagaaagtgctggtacatacttgttgcttgattgaggtgcatccattcagaagttgggaaagagagaaaccaaagagcaagtaggaactttccttttccctgctaatagtgctctagccccatcttttctcctgtatcttagatacaatatgctacttaatcttgttaagcctcagcttccatatctgtaaaatgggcctaatttaacttacttcacaatggcattataagaaatccataaagtcacatatgtgaaagtgcttggctcactgcctgctagcatgggaacctaagtgctcccttgcttcaagctcctttttaaccaatcctagtaatctatcacttaggcatctttagcatttccaaaaagaagtgtgtgtctatttataaaggatagagggacagaaaataaacacctaaaatagaatattgcacaattctgaacatatcaccctcctttcatcacttgctttttcattttctttcttttttttttttgctgttgctattaggatctactcagaaagtgtttgtttttctttctttttatctcacacatgggctcctaatcagcttggcctcaggaagtgtgggaataaataactcttcaaacgatgtaatacgaaggtatcttttatcaactgctgcatttccagtgcctggcattgtgcctagaacaaaaatatttgagccagaatgaaatgaaaaggactgaaacttccaccagcttgcagtgtctctcccattagcttgccccagtgtccgaagatctccctagactggagacatcagttctcagagacttctgttaaaaggggagtgtgcttgctgagtggtggccacgctaatctaagctactagatggtagaccaagaaggaaaccggacatagtccaagcctgacctaaaataagagaaaacaggaaggaagcttccaggctagatcaacagaaaagctcgagtatccgagcatggtacattactacggactatcatagaagcaggagggatggaattgaaaaaaaggggaaggaaaactagagagaaacctcacttagctaccagcttttctcagagatgtcagggcagagaatttgaaggcataaatgagagttttcattgatcattaaacaaagactccagagataagtaggaacaatttttcacctgaacccctctctgtgggttctgtcacagtgcaaacatgatgttctagcagaaggatttaaagacaagctcttccctccctcctctcatcccctgcttccttatctacaaaatgaagctgaaaaaccctacttcaaagggtaacgccatcctctcaaagaggcatatagtggatacccaggaaagactatccctcttgccctttctccttttcatagtattacagggttgacatatgtggaagttgaaaattacatttgttcctaaattgcacttactttcatcctcccaggaccctccaaaccccaccaaaaacaccctttcatcatgtgttcttgtgacctgcccttttcatgagacacttggcacactcagacctgcttgaaaagtattaatagctagagctgtgactgtgaaaatcaatagcctagaaaaatgctactcatgcagggggttgtattaaaaaatgtccacatgatttattttagatgacctaatttggtaagtctctgggcctgtgcttatttgctgtgagctctctagctgtttttctccttgcatcaatatttctggaggaaagtagatgacaccaagatggctcaggctcaggacgtatgtgattacttgaaacctgaataggctgctggtgaagggctgtggaggcgtagtgaaaggggcttattcaaaacaaacagaacgtgttatttcctattgaatggaatagaaattctaaaataagtatgttttcaaagtgtcagtttagatagaaaatgcttagaatttaagcaagagtgagagacgagtgctgcttgggtttgaaatattgttgagaggggcagatattcaatctgttttgaaatttccacttggggttttccaggataaaagttgctttgtttatgcagcatgacgaaaatactggaaattcagggcttgagaacaatactgggttacagggatccgtgctttcttatatacaagttgttgacagcggtttcgtctgaaaaaaagtgagcattttgaaatctgattttcatgaccgaggagtaactgtaggccaaagatgttttcacccaagagaaaaacaattcctgaatttccctgcagtgcctttgagtgccactgggatgtgctatttcataaagaaaaggaagctcttctgttgcctgaaacgctgctagcagaaaactttattcagacagtcctagactcgaacttaaatttgaatctatgtatttaccttgattatgacaatgggaaattttatatagtgagaaaaaaattaaaaaggtaagaccagcatattcctaaggttctgagaagcctagattccatggcaagcctatgttattataacctaacccagttagatattttatagagcaaattttctatgtctgggagttttctagcgtagggggttctgagctacaccacagacctctgggcatggctggtgaagaaaggaaaagtagacatctcatcccctaccatctttcagagaatattctgttggtgtcagccccacctcaggtgcaggcaccttgttacacagttaagatggagcagactggaacgtgtgtgctatctggactgcacgggagaaggccatatcaaagcctgtcaatgctctcagaaccatggtcttgtgggcctggctcatcaccaagttaggagatggccctcctctgtacccactgtttgttttcacatatcacgtgtcacctctccacacttagagcgagtgcctcccatccagtgattcctcttcctctccttatctagttaccaactaattctccctaagttttaaaatatagatgctttttaatagagtgtctgcaaaatatatcatccaaagaaatgaatccctaatgatgggagtacaggttatttttagacaaactgtctagtacttaaggccagaactattttaaaatttttatctgaaaataatttcaaacataaggaaaagttgctaaaataatataaagaacacatctgggctatttattccttaacatattgttaacattttgccccatttgctttaacttttgttcatgctctcacatgctcactccttacaacccacctctccatttatttttccaagctttttaaaactaagttgcacacatcatggctttttagtcctcagtatctcttaatagttatgatattttcttatccccaatacaattaacaactttggtaaaatttacataaatatgatattttaatctaccattgtattctaattttgtcagctgacacaataatgctctttgtggcatttttttactccagttgtacaggatcagtattggatggcaatattttgttgtcatatcttttaggtctccttcaatctggaacagttcaggagaaattaattttagtataggaaggaggtcaaaggaaagactatgactaattgcaagtccgccttgggttgggaggtggcgctgtggtgccacacaattgttatgcctgcaggaaggtctcctggatattgttaccgtgtccctgacaacgactgtgtctcccacagctacccagcgagggttaccacgttttcttctggaactttaggcccaaagctgagggatctcataggcctgctgaccttattagcctacataaatccggtcccctgtgtccctgtgctcagcacatcccctgagggtgggtgttagtggtaggtgtgttaaaagggagtcaccaggcgttaagaggggtaaggccctctgagcactgatggaccacagacacggttacctcaggattgtctagcccctaagtcaggtgcccataaatgagctgggttaggaaaccatcccaagaggctgaagtggcagccgaaggagaggcctgataccagctggattcagagtgacgggagtatggattctggccttagcttctggtgaacccactgtgggaggggtgggagctttcagaaagatgcaggttctcaatgggctagatggaacatttttagacaatggattttgacccaattgtcttctgtcattttctccttcatgatattcctcttaatttgctaaggcagatgagatagaagctctgacaattgtagagtgtgggtgtaaaatgtgcagctcattaagtatccaagctctccgtttagcatttgaagggtttgtaacaggtcagtgattcaccctgcttttggaattttacggcactctataactcagtgcatagtgacaatacatgcctctagaagctagttacggtttcaaaacagagctatgattacttccagagatgaccattgtataagatgggcacctttatacgtaacttcccaaaaggttaactctcgttgtaacttctttgtaacattccatgctagcactttcttcctctacctctatttttccttttggcgcacttatttgtttatttctgtattgtctgtctctctcactggaatgtgaattccaaaagggcagggattttatctgtatagttaattactgcattcccagaatctgacatctagtgtagagctcaataaatatttgctgaataaataaattattaagcaggagtctaacaaataaaccttcaatgttcactggaggacaagccgctggatatcagtcacagggcaccacttcaccaggatccatagtctccccagcgctcacttcctaactttctctctttaccaaaaatccaagtatccttatttgagatagtgatacttgaggatgacattgttctcgtaggaaataggtccttaaatcttggattttaagatgctttgaggtgaccatatcatgctcatcatggcatagcccactgtatgtttgtttcttctgagatatccattttgtttaaccttaatttgctcatttacttcaatcattcattaagtttgtgatgattaattttgtgtcagtttgactgggccacagggtgcccagacatttggtcaaacactattctgtgtgtgtctgtgaaggtgtttttgcatgaaattaacattggaattggtggactgagtaaagcagactgccctccccactgtggttgggcgtcatccagtcatttgaagttgaacaaaaacgctgacctctcacaagtaggagggtattccttctgcctgattgttggatctgagacatcggtctatttctgctttcagagttgaactgaaacatcagctcttcttgagtcaagtcttgagccttccggcttttgggtccaaacttacaccattgacccacctgaatctcaggccttcagatttggatcagaattacactattggctctcttgcatctccaacttgccaactgctattcttgggagttctcagcctccacagttgcatgagctagttccttataatcaatcaattaatcagtcaatccctatctatccatttatctatgaatttatccatctcctgttagttgtgtttatctggaaaactctaagtaacatagatttctcattgtactttcctccaaaaaagttctccatgtgttgctgcccaggcctattcatagtggggccttgagttaccttgaccagaatgagacactcgttgctttcactcagtgtgaattcctgtttccacttagaggtggtgctttctgagggaggtttagctgattacagtctgactaaggtcaccagaagtagtgcagatagtagtgcagatgtctaacacactcatattacagagccatgggcctctccttctccactcctctcaccaccagctagctcttctttccctttctaccagttgtccctcaatcccactggcaagtcctctttaagtttactcttttcctcatttcgcctttccatcttattacaggaggggtcatcatctcattgtagcagccagttgtcatcctccgaactatgggggacaagtgtggagagctagcttacctgttgggattcctagctgactcgtcctcctagataaatgcgccagaggattttctgtctattcagtaattgtggatgagtgtgggttctggttagacttcttgttcttggtatagatcagactttcccatcaactatttgacctacaactgaaacactctttcactggtaattaatagttgcaggctggtccttggtggtatcatcagatccatgggttttcttacttaagtctgccctactctaccactttggcaagaccctggcccatttgactcagcaaaggtagtcagtgctgctgggactgggcaatggcagtggaggggtcatgcgtttctacttcagagggttggttacctgcaggagcctgggtgagactcattacagtggacagaatccagctatcttctttctgccccttcttcacaggtacctctccaagggccttccatttctgacctaatgttcaccacttcttgggttctggatcctgtatgggttaaatattttccctaatatgtctcatgactgtctcatttaaattgttggataatccaaaacatattcttatacaagatggaaaaacaggttcatgcagccaaatttactaatacaaattatatgatacattggtgacactctttacaaagctattttgtatgaccactagtcaagcctcgctgtttttggtacactatctatttttactgaaccatctacctatcccccctgccctgccaccacccctcacacagattcatccaacagctctccattgagtgctcaccttgagttatgcacaattccaggcattggagatacagcagtgaacacttaggctaagttctctgctttttaaaggatttaattctagtggggacgtgccagttaatgaacaaaaataaataaataaaatttataatactttagaagcataaattctctggagaaacacaaagcacagaaggaggatgagtatttgtgacagggagcagttgccattttaaataacatagccaaggaaggcctcactgagaagacagcatttgaataagtacctgaaggaggtagaaatgacaatcattgaagtttccggggtaaagagtattatagacagaaggaacagtatatgcaaaagcccagtgtgaaagtctgtagaaagaaacaaaaacagccagtgtgtcaagggcagagtgaatgaatggtagaatagtaagaaatgatgtcaagaaggtaaaggggagaattgaaagttcaggaggtcctcaagaatgctctcaggttcagtgattcactagaaggactcacagaactcagcaaagtcattatgctcatggtcgtggtttattacagcaaaaagatacagattaaaattagcatcaggaagaggtacctagggttgggtccaggagaaccaggaatggagcttccaattgtcctttcccactggagttgtgtggatagtgcttatttctctcaggaactgggaagcttacctgaaccttggtgtccagagtttttatttgggtttggccatgtagacacggctgactacctgtgtgtttgaccttagtctctggcccctctggagttcaggctgatacaatgtggcccaagactcccaccataaattaaatacttagcctagactatctcgtagggccttaggcccccagataaacaaagacatttttattgggtagggcattccaagggcttagaggttaactcccaggagttgggggcaaggagctagatttttctttgggcaagattaattctttactgcacaataggcacattgtacaaaaatgtgtaggccattttaaaggtggtggcttctagtctgagtgagatggaagcttttgtgaatactgatcaagggtgtgacatgatttgaattattttttaaaaggattgtctgaatgctatgttggaaaataggctgaaaagtagaagtagggttactggttaagaagttaccataattgcccaggaaggaggtaacagcagcttaaaccagaatggaaatggtgagaagtagttggattctggaactgttataaaagtagcatcaggaggatttgaaaaataaatggatatgatatgcaataaagggaatacttaaagatgactttaagcttctcagctcaggcaattgggaccaacaagttgcccttaaattagatgagaaagatttcaggggagtggatctggagggaagaagagtaggaacttactttttagacaggttgggtctaaatgcctattagagaacagtgtcaagttgataaaagtttgaagttcatgggagtggtatggactggagattcatgctcaaaatataaatataaatatataaatcttggagtcatcagtatattgcgagaacataaagccatgagataagcaagtaagtgtagagagagattataacaaaagccccaggactacagcctaggctctccaatgtgaggaggtaggagagatgaagaggaaccagcaatggaaactgagaatgagtgtgcagaaaggcaggagagagacaagatagtggggtgtcaggatcaaacaaaagagagaaagatcaagtatgttcaatactactgctaggtcaagtaaggtgaggactgagagagaccattggatgtaggaacatggaggccactatttataagagcagagagaaaaacgtatcttactttctacacagcactatgcttgaaaggagaaagcaaagacccatatatgcatgtaggaacattttaaaatttaattctgaactcctacttaacagaactctgactaccatccattgagcagcatctctgaatttcctcctacttatgaacatatagaaaaaaatcataagaaattggccctacctatgagcagaatacagaaaggttttccacaaatgatgatacttataaagctggattattaaaaataatactcataagttatctgtctcatgaaacagcatctctgccccctgattgagagtagaaagacattgtgctcttattctatggtatattttatattatagtgctccctttgttttgacaactggaaatgtccctttataggttataaaattgcatttaaattaattttgttatattttattcagaaattctatttgcttgaggtgtgtatgcgtatgcatgtgtagaatgttccacatcaattaaatcttttatattgacccacagctcaatttttcagtcaaaataacatagatattatgcttaacaaccaaaatggataccattaaattataaaagtcacaacaaaaagaacaggatgaaaaacacacaaatattagccgttgctatttttaggcattagaaaggtggattattttttttcctttcctctattccaaatgcatgtgtattactataataaaagggccgcctgtaatcccagcactttgggaggccgaggcagggggatcacgaggtcaggagattgagaccatcttggctaacacggtgaaaccccgtctctactaaaaatacaaaaaaaattagccgggtgcggtggctggtgcctgtagtcccagctactgggaaggctgaggcaggagaatggcgtgaacccgggaggcggagcttgcagtgaggagagatagcgccactgcactccagcctgggtgacagagcgaaactctgtctcaaaaaaaaaaataaaaaataaataaataaataaataaataaataaataaataaataaatgggccaaaaatgtaattaaaataaaatttaacattaattctattagattttaagaatttaagatatatggttttgaaattctttttgagataaggtgagatagctcagatctaaaaccaaaacaagtgttgggattcgttagtcatatctctactgaggtttacaaataaatactcttacactgaaattaaccaggagaaaaatttgggctctcatgtaaacaagacactgaaatgcattctatcaaagtgcttctattttacagttaaccttggatcatatagactattttttatcagatataacttgttttttttgcaagtaacagaaaacctaacacaaactggcttatataataaaggaaacttactggctcatccaactgaaaagtccagaggtagggaaaaatttcagatttaagatgcaaacaatgtgtacaggactctgtttctttctctctgcatctgtgggctttctttcttgataatggcttcattctcagctccacatggtgggtctgtggcagcttcaagccttcctctcgtctgcaatgtggcatgtgactgacaactgtcagggttacaccctacctcattcactcccagaaggaaaaagcaaaggcacctttcatttcccagaagctctggcttatgattctttagttttgattggattcattgtttgtctctgaactactgaccttatctgggagatgagagaagctgaatgacttctgtagcttctgtgctcaacccctcctaagctgcctgactgagaatgaagactcagaatactcttggtgggagaagaggggagtagtttatggcgaggcaacctacatatgtccgcccccccctgtaataattgagtctggagggcacagatggagatgagctcatgtggtggtaaattcatggtagtgaagattccaggtggccagtcatctggaaattgggaatgacactactctatgctacctagttgtgtgttgtttctatttcttgagctttgggtcttattcttagctctcttcttgctctaaaactctgacttcttaggggtaggggaatattttcctctattagtctatgtctcaagtggtttgtgctgcttagtcacatgactaaaatgagcagaaatcttatctaactaaaagtaagaagagaaactggctttaaatgatatttaatttagcatggaaagtaatgcatttttaataaggaacacattaaaaactcataaagtattttatttataaggcggttagcctccccttgcccattgttccaataaataccattaagttccatcaactcttcagtaagtacaattacacaagtgccacatttcattttgcatttgattatggcagtgccccctccacatatattcttcatacgcgaagactaagtgcacagtattttagaatctgaggagatattaggaataattttgcataccccatcccactaactaattttacaagtaagttttctgaggcttgaagaagttaagcaacctgctaacagtcacatagatggtttgctaccctagttaagagtttaatcaaaggcttttgatccaccagttttctctttgcacaatagaattgttcaaatcaacaagattcactgagcaccagctgtgccctgggcaatatcactgagtttacaacagtaaaagacatagttccttctctaaagaaattctaagagcagtccagtagaagaaagagccatgacaaccaggtagttagagtctggcataatacatataatactgcttttaaaaacacagtcataacatagtagagcaagtgatgaatgctctcttgatagtcagggatgacttcttagaggcagaaaatcattcacagggttggataagagttcaacaagtggtctaagactagaagagaatttgatgtagaggaaacagcatgtttgaaggcccaagagctagggaaccaaggcgatagtaataagcacaaattttagagacaggcagatctgcactaaatgcttgttttaaatcttgctaggtgagtgactatacaatttaagtatcctttctgaacattgacttgtttgcatcagaagtagaaataacaatacctatcccatagggtttggagaagattaaataatagaacaactataaaacatgtaatgtagtaggagctcaggagcaggtagcaactcttctccatctcctcctcctccttctcctctttctccttgctctcaccccacccctcaacccttttggcgaagagagtgttagaagatgaggttaagaggcagggaagaaagagatcagtggaggtcttagaagctgaccatgaaaaactgttgaaggattcttaggtaagaagtgacaagatcaaactgccatccaaaaaaggtatttctggaagatctgtgcataggaaactgataggaagtgatttgaataatataggtgagagagcttgaagatgagtaacagcagtagaatggaaaggagaggaaagcatggatcaagagacattggggaagttaaattagcaggatgtgttctgcatagctttgttcgctgcattctggctttcattttcacacgtacattaagaggttgtctagaagggaaaatgctcattgatctaattaggcccggaggtagtcattgtggcatgaaggaaggaggcagaagggcagaactctgcagcagctgtagctgcttttggctcttgtgtctttaaaatgcttctacagaatcacttaaatcatcctcttattctcattcacatgaaaggaaatctcagagagagcccttgaactagaaaatcttttctttcttctctgactttaaagcaactccttaaaccactccatttctgaggcaattatctcttcactacaatttattaactgagagtaacctcaaatcctttacttttaagcagcacaaaactttcctccaaggctgtctgtgtctgccctttaagaggtattaaagggcccagtgggggtaggcctggcccctgggggtgctcaccaaatcctgtggatcaactgcatcacctcactgcctcgtcattcacccattcaccatgtacttcctttaaaaaaccctgtgatctttaccacatgtttatttttcttgtttcacaatggttttaatgaccccttttattgatgacctaactgaaagatggaataatttgttgacacacacaaaccactcccatccagcccccaaccctccagaggactgatgtcaagaagaagaatgtagttacctgacatttgtgataagatcagctgacagggagtttcccctcactcttcctcactccatttcatgctgattttggatctaactagtaattcagtttcgtccatattttctttttgaatataggtaactgtctatatatttttaaaatattttaattctacccacatatgggtttctgcataatctgtgaaggctggtccacataagcaaagtattgtgactttacactttacataaaataactggttgttgacttgtctacaaaatacttaagtatgtgagctcagatgaaaatgaatgaagaattattgataagggattttaatttttatccataatagtatgtttacataatagtattatctacaaaatacctatgcatgtgaactcagatgaaaatgaatgaagaattattgacaaggcatcttaatttttatccataatagcatgttttgcttatgttaaaaacaaaaccaaaaccgaaaactactcacatagcattcttaaatacgacagggttttgaattttttggtcttgatattgaaagcattctaagaattcacaagactttagaataaacatttagaacactgtgcgtgggatgcctgatttttaggattgggcacataacagcctttgaagaactcacatctgaagtgctttcatacttgaaatcatagaatggctttctaaacattgcctatggccaaattgaatagaaagagtatttaggacatatttatactggatttttttttttaatttttagcaaggaagacagagaaaatggtagcaatatcactatacctgtttatttttgtgcattatgtgaatctgatgtttcttcccattttaggtatttgaccacctgctacgtggaagatattatgctagacacaagttaggactaactaggtctcaaaacagagccttccattaattagttgccaccagtctccttactcctgatggtcttgagagaacagttgtcttattttcattgtatgttcagctgtatcttgaggttggagagaatcacggatgttactaagacctggagtctcttgcttaaaaaggataaggtagttcctaacatctctcatagacctgtgatgtctgtgaaattccttcagataatttctgctgatgactgaaagtgaggcgatttgccagccagcatcatgacatcttcagtaactcttacctttggtttaaaagaaaacaaaacaccaaagagcttgaccctgggacagcctggggagaaatctgcccaccctgctggctccaaatgcatgaaaaccactctttacctccttcatttgattagctgcttcaaatttacaccaaaggaagcaaaaatcctcattgacttgacacttgttttggacaaaaataagatcagaaaagcaagggaaaccatttcacaaagccaattatataattcacaaaactttggtgctctgaagtccgtaactaattgcagaggaattataattaggtagcttagaaaattgcttttaaaattcaagtttaggtgtggtttactgaacagtatttgaaagtaagattcacactatgctatcctatatggtagccactagtcacatgtagctaatttaaattaacataacagtaaattaaaaattcagtttcgtcagtggcattacccatatctcaagtgctgaatacccatatgaggctagtggctactgtgctgggcagtgcagatataaaacagcctcatcatccaataaaagagatggggattataaaatacaactcaaggcaaaaatctcagattcaacatccttaaggttgtctttgttttatggaattttttttaggttttccagtgagctatggcacttaaaaaaatgccacatagtccccttaccttgagtcatgccagatagtgggacctctggttgttacccaatgtcaacctcatggtgaatgtgtaggagttatgatcaataagaatgagattactatctggcagtgcagttgagttagtaacttgtaaataaaactcagttatggaaaagatgtcagggcgtacctcacctaaaaacattttgatgtatgcttttctgtatattcagctattattcaagttactgagaagcatcttggtcttggtgattaaatttctgcaatgagcacattcctggcaccagctgaatcttacgataagagatatatgaattttgtctttattcttgttgattcatttccagccataaccttttgctgggtgtaaacacagatgaagaagcactttaagtcaacttttatcttgttaattcattaccctttgtggcaacggcaaactttgtgcagaattataaatcaagtccaaatgttgcacggatgccatggcatgaagtttcatttagtgtggatacaaccttgatgatctacaaggtgattcattgctttttatcctgtcttccaactgaggagttggatgctggtgcatactaatgtgcaagagttaatgctaggcatcaagactgcaaagttttgcatactatccttctcagttctaactgtttcttaacccactggcgacagggagtggtgcctttcagaatcaattacataaatacagtgaattaatctgggtaatatgaagaatgacttggcctccctcctcccctctgcctgttgatggtttgcctaactttatggtttagatgtgactaaataagagaggcagaaaatgtaaggtgaatgcttgagagaataagagagcattatacctttcaaagtgcttttgcaatatattataccccatttgatcctcacatcattctgtatacaagcagagaaggtttagatgttaccaatgaggccgctctcttgagaagaattgatcatttttccatcagtgtcccattggcttcattcctccctacatgcccctgtttttaattatttgtgtacatgaccatctctttcactagacttgaagctgcctgcagggagagaccatgttcttactcattttgttttcctggcaaatagtgtgatgcctggtgcatcagctatttatttgcccagaagaaaggcaaatgtaacacaaaagatccgtgaaggaattatgatgtttgttcagggagaaaaacatgctagattttgtcagtttgggtgttttccctgtccaaattgaaaaagatgttgtttagcctggtccgggcctcggtaccagtgatggagatctagggctcaggactctttttacaatatgtttctcattaaaactttctcttctttttataccactctgctttattttaagacactccatctctttttgtagttagcccagcaaaagggaaaataaattttacttgcattcagaatagaaatggattgcaagtgcttaaataggaagaattgaaaagctgtactgctgtttacatttttgttactggggatgatgtctaaaatgcttttgatgttgaaagaagatcctaatgaaagcaaataggccgggcgcggtggctcaacgcctgtaatcccagcactttgggaggccgaggcgggcggatcacgaggtcaggagatcgagaccatcccggctaaaacggtgaaaccccgtcgctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaagcaaataagtgagcagagcattatactgtaaactggactataaacagaaacggagtggtgagtttgctgctaactgacggacccaggcctgtgatattgtgtgtggtcagtggatgtgcagtttgcagacctgcaccaaaggtcttgctctgtgctcagtctggcagtttgagagaagagggaggcagagcttaggtgaacaaagcagaggagactgaagaagggagcagtctccacaatcagcattactgtgtttcatgtattgagtcaatacccctaactaataaaagatagcatgaagttttactccattgatcaacaccttaatttgcttacagatcttttatattacatttgcctttctcttctaagcaaatgatgttttgttatagttagtgtttttatatgtatttatctttaacattatatctgtattgcggctttattcccttttgttcttctgagctctcctggtttttcttttcaatgtaaataattagttctcacttttcaaatgtaaattattaattctcaccattttgaatctccttgaattggggacttgtttactgtgttctcacaagggcatctctgccttcttgttggatcacagagtagttcctggaaggtgtgtaagggattctaaggctgtgctcatgtgcaaaagaaagccttttgcgatgttgggaactggggtgtgtgaatcacctgatttctggctggagcttgggcccctcattttttccatattcagatgttcagcgaacatttgtatattacaagagaaagagagaaatggccttacttaagggaaagtaatatgccacgatacacagcagaagtaaggagaaagactaatgtctcagatgatatgctgtgctttactgttaagtgtagtgttgaaaacaattatcagtgtcatgccatgggcatgaggcagagatgaggcagcacatctctcttttctgaaagttccaaggtctgtggaggcacacactcagtttttaatacataaaaagggtctagaaatcttatctttgaaaaggaacaggggagcagaggatgcatttgaaaacaaacagtaatataaggagctataaagaaactgtgtagtagcactagagagatactaacaaattaagaatgaatgcgcaatcccaaaacaaatgtaaacatgttatttttatcattgtgctagacaaatttaaaaaatacatatatacacacacacacacacacacacacagataggcaatatatggtgtactttaaaacagtccttattcatgaatatcagcaagatcccagtgcttcttttatgggtttacatcttttaaagcatttccagatttcatttgctagctgtttgcaaacattctctttgcttttgtggtaattgcactattgtacagactgtttcagctaaatgtctaatggaattggtagaatgtatggagtgaataaattggtcaacaattttatgataagggattgtattccatttaagcatctccccttctaataaaattctcctagatgattgagcttttcatgtaacgttctgcgaaggctttttaggatttgtaggaaccggttgatgtttatggcggtttagtgtggcaggacattggaagtcatcctggacatgggcacctcttggttgtgctagactgtccctgaagggcaacaagtctccattcctgaccagtgctgctctagaagtccagcaccctactctggctccaacaagacagagtccatgggaccccagggatgtgcccagctatctgcatcccctttctgcaccaccatgtccacatacccagaatcctggtattccctcactgaatgacttacacagcctctttagatctcttcctctaagagtggacaatgccccagaccacaggtggccaagcttgagggtgtggatgtgtgggctggcatgtctatcagacggtggcgtgtgagactttttgcaagggctgaaggagtagggaatggaaaaggaggagattccatctacagttatgaggcatgagctggtccccaagccacacccactacatgacagtggcaatacagttattgttacgatcaaatcacttctggaaatttctgaaataacctctgggaagcaacagtgctactgttttaagcaagaacattgggtttcttttttaaccaataagctttctctgaagatgacctaaaacaaaccccaagggtgttttgtgctatgacaacatcaatagaataaaaatatcatttttaaaggtgcttactttgaagaaaaactcattgacatgtataaaatatgatgtttattgaaaacaaaacagccagtttcaacaaactttttaacaacaacaacaacaacaacaaaaataagtggagattgagattgaattataagatttttgtagtataaggtgatatggtgtgggatattcagccaagagtcagaaaaactgtgctttagttctagcatttccatggagcagctgagttatttggggcacagcctcttaggatctcatttttgatatctattaaatgagaggggttggacagaatgctctctatactttcttatatgtttggaagtcctggctgggcatggtggctcatgcctataatcctagcaccttgggaggctgaggtggatggattgcttaagctcaggagttagagaccagcctgggcaacatggtggaactctgtctcctcaaaaaataccaaaattagccatctatggtggtgcacacctgtagtcccagctacttaggagactgaggtgggaggatagcatggacccgggatgcagaggttacagtgagctgagatcatgccactgcactccagcctgggtaagagagtgagattctgtcccacccccaaccgccccccaaaaaagtaagtcctgaatgtgtaaaaaccatgttctctattagctatacagcatataagtatctatcaaaccgaagatactatcaattgtatggtacaccagtaatttgtgtactgttaagaaagaaacacactgcctattatcatttaaagagacaacaataagaatacggttttaaaatttaaaaaatttaaaaggctgtaggaagcattccagtttagaaatgtgaaaatataaaaaatatatcttagagtctctaatacatggtgattattattttattcatctaaatatttttcacagagtcttgcacagtacctaccatatctattaaaaatctgtgtattcattcaacaagtgaatataaatttgatgcttattatatgttaagcaatacaacatggatacatcaaaatgtactgaataatggaatttttgaagtatatttgctttttgtaacatcaacgtgcacatgaagctagtgatgctgttgagaaatcagctcaagaaaacagcgagatgttttctttttaggacagcagaattaccaaaaacttgatctctaatgtagacatttgctccaaagaaatttgtactgaaaaatggaaggcagataaacaaaagttcttagatcagtttcttagtcatccagggacttctgttacttctttcacatttctgtaaaaatcttgttgaaagaatcacttcttgcctccatgactctgatgaagatgttctttcagctgtaatttcttttccagtagaaataaggcgagggatgattttctatgaacactgatgctatatcatatgaaatatttttatatgatttattattgtaatttactgttaaattgatttttttacacttaagaaatcttcgtattatccacttgtatctaatagtatcctaagacataaataagttcccaaaagcaacatttttaaaggaatatttccctgataagctctccctcacagttagaatcttgagtgcaacaaatgacgaataaagctcatttagtctcaatatctttatctacgggggttattatgctgaagaccttaggaaaatggcaaaataatgagttgaaatgcttgagctcaatctatataatggaaaccatatgcaatgttatgtggtgattttaagcctaattatattcaacagtgatgtttggaccctcctcaggaaggaacgggcaagaaatttagtcaggaatgactgagagaacagtttttgttcttgttctctttggatttcccttcttgagccgttcttgccttatgggctctctgggtatttctatttggtcttcaacatggtttggctctttgtccccacccatatctcatgtggaattgtagtccccacatgttgaaggtggagcgtgatgggaggtgattggatcataggagtggtttctaatggtcagcaccgtccctctagtgctgtctcgtgatagagtcctcatgggatcggacagtttgaaagtatgtggtgcttcccccacttgcgctctttctctcctgctctgccatgataagatgtgcttgctttcccttcgccttcggccatgattgtaggtttcctgcagcctccccagccatgcagaactgtgagtcaattaaacctcatttttaaataaattacccaatttcaggtagttcttcatagcagtgtgaaaatggactaatacagtcttctttcagtttctgttcaaagttcattttcagtacagtgccctgatcaatcatattcccaaagaggccctttttccctctactgcccaaggctactcatcttgagactggcttttctctgggctcagaaggcttcccagcttcctgtttctcttggggccaagcacattgtgttttctgaccagctgaatctcttctccaaattgggatgaagagaggaattaggatcaattgaacaattggttcctatggggcctgtggggccaatcgtcatgggtttcccttcccaaggaatcgttttttttttttttttcctaagtgcaacatttccctgaaaatgtggctttacctattcttatggttttatgaagtcatagagaaagcagcaactgcagttattggcattccggctactactgtggttgatacctacaatttctgttgcaaagtatgcttgtccaagaatacttagaactacatccaatacagcttggaggtacaggtcattacttgcaaattgccaagtcctgtttaagccacaaaatgaagtgtcatcctggccgtgctccagaaagggcaaatatgggttttggtgtgatagatactacccatcaatcagctatttgttgtttggaaattgctggtgacaattggatccaaactttgccacctgttttgcagtgcatggttcagcctggttctaccattccctacaattcatgggttacatataataatattcagcctctccttggtttccaacatgctccagttagccataatgctcccaacttctgtctcatgtcattacttggcatgcacaccccaaacattgagtcctattggaacaaatgtaaagcaaagtgcaagaccacaagaggagtttgtcatgatatgttggactcatatttggccaaatttatgtggtgtgattgatttggaaatgttttcaattcccttttgctgcacatagcagaacaatttcctgttaactaatatgatgttttgactcttggttttagtatgttttggtataaatatccaaagacaaatttttcagttgaatacatctgagaaacaaattgttcaattgacccaggaattacgtacactgctttttggcggtgagtgggcttttacccaattatgtatgtctacctttgtttgagctacacaaggataagaatttatagttgattaaatatgttgcctaagaccatttctgtcaactctgagcaccggcttatagttagaaacttcacgcacacatacacacacacacacacacacacacacacacactgaaatcagttcccatttatatcattttaacctgtgtcaccccttgcaggaacatccattgtaagagtaagaatagtctatattggtttctctcttctataaatgtcattgaataattgctttcctgaagaatcctaatccatatgactacattttaaacacaaatttctccccagtggtcctttggcaatggagaaattagcatgaaatataaagcagagtgcttgaaagaatttccttgagggaaattgggatagcaggagggaaagagatttatacttttcatttagtggcaatatgtactttatccaattttatatcattaggaccattaaaaggcaggaatgtgaaatatgtcttctctgaagacagttcttcatatttatataacattttctgctttaagaagccaattgcaagaaagagtccaatgcgaatgtactgtgctgttcaaagtgtttatttcaagggctcttcatttcccctacgccctccagagagttaaaacgctacatggcctctaatctctaagtacataaccaactctcttctctggacagtcagtttctgaaaatttcttttgaaatcagtgacaaaaatgcctagcctattggtggattccattttgtaagcttatttttacaaatcacagacttctctagtatctttgtaattatttaatctgaccaagtgatttctgggagtaaaatatatttgaggctgtgtatatcagccaagggtgttctttaatgagaaatcttatcacacacaccttctaaatgcatttcaactgcacacaggactgggttttatatttcttggcattatgccaagaaaaatctctaggaacaaggtgagcgtttgatgcccagtggattcacacataaacttgtcaattttcttcgtatctgtattcatcagaagttgttattaaaccacatactatgagcaaacacactctaagtccctctggtgggggatgtgtgacagacagagggacagcagagtttcataacagaattttgaagccttgcctttctgcataattcaaatggcttttttttttttttggagacagagtcttgctttgttgcccaggctggaatgccatggtgcaatctgagctcactgcaacctctgcctctcaggctcaagcaattctcgtgcctcagcctcctgagtagcggggactacaggcattcaccaccacacccagctaatttttgtactttttttggagacagggtttcgccatgttggccaggctggtctcaaactcctgaccttaagcaatccaccctcctcggccttccaaaatgctgggattacaggcgcgagccaccacatgcggctatcaaacggcattttaaaaaagggaatgaggatggtgacatgattggttacttattcccaggtcagtggttagtggcaagtggccactgagagtagataggggcctttctagataattggaggtagtcagcatgaagtcacagagtagacaagacaaggggataaaaccgtaggctaaaggactgagataggtcctggaaagtcccaggggaatattgcaggcagagaatactctctgagctgggttttgctagccatggagagagcccagggcatctaatgccttttaagctagagcagttccaatctacccatgtggccccacacaactttgctaacacctctggatgtaaaggtccttctgtcatctggcagtttctttcagaagctagtgtgggtattacattcacttgtggaccttaaacattttgcttctagggaaagacatgtaaggctcattgaaagcatctggcaagtgtttagaaaaggcttctcctctggagagaaagaaaagcctggaagaagatctgaatgtcggatgcctcaagtcactgcggtcaacaggcagtgttgctgtctaagaggggcagggaccctggtcacaaggccctgacacaaaattgggtagaaattgactcagcacttttcttcttaagaagctcagccctgatttcactctcagggcaacagaaccattatcaagatggccagtgagttaaccagggtgtttccgagatgagggagtgagggtgtaataagacaatgggaagaagagggtctaaaaaaacacacaaaaaatcaccatctgtaagtgaaactcttcctagttttaactacttagttataaatgttaaacacactggaaatgggttatgaatcatccaggtaataagagcaattactgtccagtggtcagtaggaaagaaaatagcatagttcatctgggttttacttccaggtctatccaattgtcagtgggagtctcagtcaagccccttaacctctctggggacctcagtttccccatctttaaatgacagcatttattctaagttcttatccagtattattaacactctatgtaacaaaaaaatgcaacaaattgtatgcgatggttaattttatatgtcaacttgacagggccacagggtgcccagatgtttgtttcaatgttatttctgggtgtgtctgtaagggtgtttccaatgagatcagcatttgtaccagaggactgtgtgaagcagattgcccttcctgatgtgagtggccatcatccaatcagttgaggacctgaatagaacaaaagatggaggaaggcagaattcactctctttgcccaattgattcaattgattgagctgggacgttggccttctgccctcagacagtgacatataccattggctctcctggtcctcaggccttcagactcgtactggaacaacaccaccaactttcctgagtctccagcttgcagactaccgattatgggacttttaagcctctataatcatatgaacaaattccttgtaatgatctctttatgtttacctcctattagttctggttctctagagaactctaatacattctacatttggggacaaagatattgctcaaggctagccttcttatctccagttttactcaaaataattttaggaattaaatacttggtattttctctctttgttcccttcaagcaataattaatttttagtggtttgttcttgggtaggaattagaaacattatgtagctgacagagggctacatgcagagcttataaggaggagctgctttctgcagccagtttcttgatgagaattcagcaggaggagctctttagctgtgtgaacatccatcagaagggtaggtagttagcaggatctacagtattcagcaaaataaaattctcccagcagagaatgccatgcttctttactcattaaggaatgggtgagcccttccctgacaccctgactgttccagcctgtagtcaaagtatcaatgggaaatcagggacccacatacctaccaagtccttttttaggtcttttctttaaagctggttagttatcccatacatcagtgtgcccgaggtcgagaagagctggaggggctgatatttagccaatgtggtcgcttccacaggccctcttattctcatagcagctcagcctcccatcaggaggcatggagccaccaacgcaggggtctaaaaaggtaccaggaagactgggcttgggctgccaatgagggtgcatctgccagtgagctttcacttttagaagatatggcagcttctagctaactttaccagatgctagttgttgaactcttcctcaagtctacaagtggaattcttcagggaaacatggtgtttctctggctgccacaatatttatttatttacctactcaactatttggtggagaacctcacagggcttagagtggtctcagccaaattgtcagctcatgaggcttctgatctgttgcagtgagtttggatttttacccctctggactgtcatcaacagaaaacagaggtgctttgggtttgtttgctttttattttttaaggcttttaatacaaatgtttttaatacaaaatcacttagagaaatacagaaagaaaatatcctacaagccagttactaaataaaaaaaaaatcccaaccagcaaatttgtcacattgggcaggcattagaaaacaggaaaaaagaaaaagaaaaaataaaatacaacgtccctgaaggccgggcacggtggctcatgcctgtaatcccagcactttgggaggccgaggcgggtggatcacaaggtcaggagatcgagaccatcctggctaacacagtgaaaccctgtctctactgaaaatacaaaaaattagccgagtgtgctggcaggtgcctgtagtcccagctactcggaggctgaggcaggagaatggcgtgaacccgggaggcggagcttgcagtgagccgagatgcgccactgcactccagcctgggtgatagagcgagactctgtctcaaaaaacaaaacaaaacagttcctgaaatcaggcaggtggattttagaggccacggggagcttgccttagtcatcctggtgaaatgggatagcagtggtttttggaatatggccaccacctcctctgtttcttgccagtaatcgtcatctgaagggagggtgctagcctgggcaataaatatttgacgtcacttatgcagtctgaggtctcaaagacaagtagccttggagtcttccattccatatcccaacagtctcttgtcactcgatgctgagataatgaagggctagtcagggtggaaagcaacttcattgatggagccagcatggccgggcagctcatacagtattctcctgcttgtggtatcccacacatacacaaacctgtcggctgtgccaggtgctattttgcttccatcaggtgaccaagaacatcttagaaggttcttttcaaagttgtgcacatttccttgaactatgtttacacacctctctttgggggcaaatggccagacatcccagacacgaactgtattgtccattgcattggacaagagataagaaccttcagaacttaaggtcaggccagtcactgaatctgcatggcctgtcatggtgtaggttagtttgttctggcacaggtcccagaccttgatatcattgtctattccaccagaaataatctgatcacttgtgtcattgaaggtcacagctaacacctggtacatgttctgaaatgtttagatggctgctttcttccagagtcccaaagcttaactgtgccatcgtcactgctagtgcaaacaaggtggctagataacaggaattcacaaaggaagtatgtccctttagcgttttaaccctcttgcccgtttcactatcccacacagccacagttttatctgtggatgctgggaagagcatactgccatctgtgttgtaatgcagttccatcactgctccactgtgttccttcagtatggcagaattatcacagtcaccatagacattccacaacaatatcagtcggtcaaatcctgcagatgctaaggtggatcggttgggggtggaacttgcagcagtatacttccccttcatgtccagagagcagcatgattggggcttgaagggaggaacacctcggaggtcctgcttgcagcaaagctcctggcgtcgcctgctgctgcccggctccagggcccgatcccgccactcccaacagcaactcatgccgctgccgcttgactgggaccagcggtaactctgggcctgtacgcttctgctgttctatcatggcggcaaccggatgatgctttgggtttttgaggcccacctgcctccatttttgtgccacttcctccgtggagctctcccatccctcagtgcatagggtccctgtagtgcctctgtcccttccccatccttcaaatctgcttgcagctactccacagctttttgaaggcaatatgatgatgtcaactttattgtatgtgataatgacttctgttgtttctccagggacatctgcatttgaatagtacgaaatccgttaactcacaaagcaatttcaggcaaaagtttgggaggaaactggggagttcttatagagtggggctcataccacatctccccaatcacgttatgtggggttctaaccctcagtcacacatggccaatcctgctcactatacccagacacttcttataattgcctgggaaataactaatgcaaatttgaatttatggtatttttatttctttatttctttatttatttgagagggagtctctctctgtcgccgaggctggagtgcagcggcgcaatctcggctcacagcaagctccgccttccaggttcacaccattctcctgcctcatactccggagtagctgggactacaagcgcccgccaccccgcctggctaatttttttgtatttttagtagagacggggtttcaccgtgttagccaggatggtctcgatctcctgacctcgtgatccgcccgccttggcctcccaaagtgctgggattacatgcgtgagccactgcgcccggccgtttttaatttttttgagaatttgtcaaaagccgtggatcctcatctcatttaaatgtacacaggcatgcatatcttcttttgcgacagagtctcgccctgtcgcccaggctggagtgcaatggcatgatcttggctcactgccacctccgcctgccgggttcaaacgattctccttcagcctcccgagtagctgggattataggcgcccgccatcatgctcagctaatttttgtatttttagtagagacggggtttcaccatgttggtcagggtggtctcaaactcctgacttcgtgatccacccgccttggcctcccaaagcgctgggattacaggtgtgagccaccgcaccccgcccatatccaaattttacatacaattttaggaagggtcaccagacttcctagagctcatcttgggatcccagggttaaagaaagtttggtatttgaagtaaggagacctggattcgagtttccactgtgattttaggcaagctttccgtgttcctgtgaacctgctttcttgcctgtaaaaggaaaaccatagactctatcagtgggtttcaactagatataaaactttaggagaatattgaccctcacagtcatttagaaactggggttgagaactatcaggcaaggagacctctacaatgacctctggctccagcattctttgattctgaggttttactccagaaatctccacaaagttgagaagacactccttctacccctagtggggaaaagagaagatgtagcacgacagagatgcccagaagcctgacttcacttttctttccactctgctccattgtttcatggaagaaaattgaagaaagggagcagagcccttctagagttaattctctttgcattaagagtctattggattggggaaggatttatctattcaaccttgaaaggatagagaatctaatttatctttattttttgagaacctacttggcatatggtaggtacagaatgaatgcgtttttttacttaataaaattgtttctcaagatttattattttttggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggagcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaaaaaaaattgattattttttaactaagtaattgtaatgagcatgtgcttctccactccagtgattctttgagaatcaccaatataatattatataaggtttatttttcctgaagtcattgaaatagatatgaatttattgatgaattgaaattcaaggaatatttactaagcttttattatgtgcttgacacagttgaattttcaaaatagtaaagatttaagaaaagggtttatagttccatgctaatactatatatatatgtaagtactacttctgaaaaatattatagtccatttatacctttcctttccattccattccagaaggggggatataaaattttataaaattaaaaacaatttaaaaatattctttattattccctggtttggaacccccccccccaccccctcaccccctgcgttcttcccccgcgttcttctggctaattgctcgttatttcacgtggaaggacccagccacatacatgtgttttggggtggggaagcagcccattttggactccctcagaaggcacctgtcatggagctgaactagcttcactaacagctttatcttcctgtctacctttgcatgaaatgactctgtaaaagttctggctgcatgcaatgaggggtaaccccaggcaccaaaggcagcaatagaatggaccgaaagtgatgagactacatattgctctgtcaatgctgttgctcaaaactgttttcactcaggaaaagattgaattgcttcaaatactgaacttctcccttagaaaatgtacaattgactgagtatgaggaaaaaaccacttttctttcttgaccatagttatgtttttaacgtaaatcatcctagtgtaagtaataatattaataaatatgatttattgtatattatctatgtggtaggctctgtattagtcactttaatgctgacattgtatcgcttaacatatattgaacatttactgtttcagatacccaagtaattctctcagcaggcttattagcttggtactattattgccatcatcctccttctataattgaagaaatgaaggcttagaaggattaaataagttgtcagaggtcactcagcctataaatggtcaaaagctgggattccaatccagcttctctaatcttatttgtaattcaatcctcatgccaatcctataaagtagttatggacatttccattttacagataaggaagcagacttggagaggtgaaataatctgataatggttacataggaagtaaatggtggagccaagcatggaaccagattagtctgactcataaaccaatgtttgtttaattgtgccatactgactagttgtggatttaaagaatgttaccatgtaaaaagggagttacttagctatttaaacttttaaaagactagacatttattttggtttgcctaacaactttcttttcttggatattcagtatcaggaaaatgcctggtacctggagaataccaaaaacaaaaaaaattatgacatgtttattactgcttacaatgatccattttctactttttttttacagtaatatttaagtgaattattctgcaataaatttttttaatacaatccaataactgctttttgaatacctaccacatgcaaggctctgagttagatgcaatgatgatgatagagatgagtaaaacatcatctgtcctgaagaacgaggcgggattcatgcctcacccaggagagtagataggcaaataagctaagcagagtgtcatgcaggtctcagggagggagaacagaaatgtcacatgaagaaggtggaaacagagattggccttgaagatgtacattagtttgtttgggttgccacagcaaagtaccacagactaggtgactgaggaacagaaatttattttctcatagccctggacagtggaagtctgagatcaaggtatgggcagggtagggttctcctgaggcctctctccttggcttacagagagctgccttctggttgtgtcctcatatggccatcctttactctgtgtctgtattgtaacctccttttcttcaaaggacaccagctatcttagattagagcacaccctaatgatctcattttaatttaattacctctttaaaggtcctatttccaaatacaagcacattctgacatactgaggattaggccttcaacatatgggttttgagaggaacaaaatccagcccatgacagatgggtaaactatcaagagaggggaagtctagcagacgaaacaacacgagacagaggttagaagggagcagcgtgaaatgcatttgggggagaaattaagtaacccaacatgatggaaaaaataatggcatttatgagagtcccgagtgccagggtgaggagttgatgcttacactggtgggcactggagtgatttgaaattctctagcagtggagtaatttgataaagctctccttggggactgtcaatcaaacaatgatgtgttggattggctggaaagaatacagagagaaggtaaggatgccctctaggaggcttatctgggagtccagtcacgaggagatgaggatgtgaatgagcaggccagtaatggtggtaggtacatgaacacagtgaatcagagggactccatctttgaatgactccatggaggcttacctcaatgaacctggtgactagttggctgtgtgtggggagaaatggaaggaggagttaaaaaaggctctaaggcttgatgagtcagtggatggtttcatcattatctgaaagaggaaaggcagtgaggtggggtagggggagtaaagacgttgaactcaatttaggacatgtcaagcttgatgttcaatagacaggaatttgaaaaggtgggtctagaatatgggagtgacattggagtatataaaagattattaagttatatgaaaagttttaccaggaaagaaactggagagttattcatgaaaatgttaaactaattgtatttgggaggcagactgcagtttatttgtattccttctttttagtattattcaaaatgtttatcatgagcaactttaataactttataattatattagtgtgaggtatccatgtttcttaagtccctatataagatgggtttaaaatccctgttccctcactcatcataagtctaataccttctgcaagatatctgagaatttaggagcctctcacccaattagtttgtggattgtctaaaactcacaggccctgctcctattttgtatctcatttatgcagatattgaatcagaattttgcttattttatgaagaagagatcataaaaaggctcatgaaaatccttggctaatactagaatttattaaaattcaggagagattgtggggctttacatgcatatgtgcaaataacctaacattgacctagggacatccttcttaaagagtccctcagccatttctaccaactcagcctaagtttatgccactcatctctacttttcctcaggtggacacttcttcttcacccttattttccaatttccttccattttcttaagaaaatcaatttagccttctttatattctactccttctttccagggttggtttttttttcccccccccgggtcttatcttttctacccaaatgtcccaacaaggtatcttcctaaagtaagacaattttttttttttttttttattttgcggagtctctctctgttgcccggggttggagtgcactggtgccatctcggctcaaggcaacctctgcctcccaggttcaagtgattagcttgcctcagcctcccgagtagctgggattacaggcgcccgccactatgcccagctaatattttgtatttttattagagaccgggtttcaccatgttggccaggctggtcttgaactcctgacctcatgattcgcctgcctcagcctcccaaagtgctgggattacaggagagagccactgcgcccagccgacagtttcattcttaagaagaattttagttctagcctttaatatattttttaccatacaataattgatttaaagagtacttcaaaaataactaaatgttggacgtcatggagagagatgagaccatctgggaagagtatacagagtggaaagaaatgaggccttgaggagcgcccacgacaaggggtggagttggggcatagagaaccccgggagggagacaaggaaacatgaggtaggaggatcagaagggtgcagagccaaattgagggaggtgagggctttgagaaggggtgggagataagtctcaaggaacagggttccgaagaataaaaatggaaacaaagtcattgaggccacgggattcggtacagtggtgctattaggacccagacccaggatccctgttgggattgtcacattcactggaggacttgtgactgcctgaaagaatggggacactccagaaatcctacactaactgtataaaactggcagtgcatggtttgtgtgctgttcagagaacccctgaacattgaagttgacttggctgaacgtgtgctcagctgtccctagcagctcacctagtagccagcctggctttttgccctgctgtttgcccatagcagcctcagatgccagtttctctcactcatctctccccagttgcaggggtttgtagtacagaacctaggtccttgactctgcaatttcctgactctgtgaactcaggcaatcactgcatcttctggactcagtttccttatttgttagtggtaataagcataattatacatgccatctgggcctcccagggtcattatgagagtggcatgagaaaaagtataagtataaatgctctgtaagtgctattgactcaggttgcgtgggcttggccaccacttacagaatacgtgatcttcaacaagttatttaattttggtgaccctcagtccccttatttgtaaaatggggataataattatacctacctcctaggactgttgtgagctctaaataagttagtatacataacgaccatagagcaaattgtgacgctcagtaaatgctgttagctattattatactattactattattgtacaagtggtgatgtatttatctatatacatacaatttttttgtccctcataggatccaagacagtccaaagcttatacaatgcagagagatgacttaaattagaattgggtgaaagatggttattccttctgtgttcatgctcctgcctctattccgtaaccaccttccattctgttttctgccagtttgattctgcccctgccaggcctggcttggatccttttgtagcatctccaggctccctgttgtaccaaaaggaatcttatattctgtccagctctgttttgggccagagtgtgattagtaaggaagtggagagagacaaatagagctctcagggctgggaggcaggctggggagaatctcttaaagaaggagaccctgcaaggtgtttggaggctaaaaagaagttgccagtggagacagaggaatgcaatatgctggctagacagataattgatggaaagagtgcctggaacagccaaaatggcatgagttcaaggacacaggtatctaagaacaaagttggctggattttaaaaacagtcttcataaatcaagtgaaacaaagctgtctatctttgcaacctaggaccatcaaaatatctttcagggtaactcctctttgccttcctccacctgaaggtaagtaaggtcagttctaagcaaaactgggaagtctgccaaagtgtatcccctccttccccatacctgtttctcctgtctcttgtcccatactggttgggccattttccctcccatccctgggctcctgtgctccacaggctcatgtctaacatgccaggctccagatccagtcaatactgatggagaccaactaagtggcaggaattctcatgcatattatttaacattacagtacctccatatctctgttctcatagaggaaacaaaaactcagagagggtaggtgtaaagctcaaggccacacagaaagaaagtggtgggataaaattaaaacccaggattcctgaagactggtctagaggcctttccactatttcccactaagtccctacctgttgtcttcagtgaccttcattgacactccacccactttagcaaagctcttccccagctcatgtgaccttcagtcttcagggctgagcatcttctatggttccaggctctgatatcccttcttccactcacagccaccttttctactagcaggcccaagcccatgtccctgttacctccatagctaccttccagcctcaccatctccaaattatcaacaatttcctgggcttcactttctcccctagccagctggggaggcacaactttacctctattctcttagagtttttctgattagcctgagaattaagttgatgtcagataggagaaaaacatacaaatgtatttaatgtcacttttatgtggtatggaagatttcataaggaaatgaaggcccaaagacccagcctgagttgaatgcttatatagtgaattggagaaagattagtaaattgtgaaaatgtgacaaggctaaggggcttgggctagggcagttaattgggtagagaagtaactaggaagataagggttagtgtaacaaggtttgtacagatttccctcagccccaacttcccatcctcgatgataggagtattttttttttctcgtatagggaggacacctttcagatgggaatttcatcttctatttttaaaaagaggaagagtgatcttcttgtaccttctgtttttcaagtacctctaattcaagattgtcaatatgccagttggtgccttttgggggcaatgtgttctgaacttctctataactaaacacatataggccatccctgcaacttctgtactgatatcttccccacttccttcctttccttcctttggccttgcaaatcccaagtttgggaaatctaaatattctcttctctgcatctacataggagcagctactgagcatagtgcagaaaaatctcactttgccaatcaattggccacaagtctccaatgaccagccttgctggggggctcaattcaaacggatggtccttttcttgaaggcttcagttctgttttacttgctactttagtgtttcatctctcttttcaagttcccttcttttgcccaactccatgactccaatctgaagaacctgcctattttttttctggggagaaattagagcccatctttaaaggattgcctttaaaatttagctttttaatccacaaaattgtccgtattagttgtttctgtcctattcctttccacctctgtagcatcagtggttcccttcctgttcaaagctgacatctccctcctaggctgtgctgtggaccacatctctccagacatggcagcctctgttgtcttctttattccttgttcctgccttctgtcactgccctctcagaatacaagcctgtgcaagtgtttcctttttacagacaaaatgaaactcctttccttttgtactctctcccagtagctgctgcctgtctttccttcctagacctgtcctacctgcttctgccttctcatttctgttcaacctcttacctccttgcaccctagctttcagtctccatccctctaggaacactgccctctacaaggtgatgtgtgcttttactaatagctaagggagaggtttcaggccttgctctccttgttctttgagccctccctcccttttatactcctctcctgacttttagggcattgtttttctgaccctccttagcatcttttttttttttttctttctggagatggagtctcactctgttgcccaggctggagtgcaatggtgtgatcagagctcactgtagcctctacctcccgggctcaagtgatcctcccacctcagcctcccaagtagctgggaccacaggtgtgcaccaccacacctggctaatttctttttattttttgtagagacaggttctccctatgttgcccaggctggtctagaattcctgggctcaagccatcctcctgccttggcttcccaaagtgttgggattacatgcatgagccaccgtgctgggacatctcagtgtctttgactctatctttgaatgagttctctttcatcactaaccctccaccttggtatttctcagagattcatgcttggctggctttcttttccctttatacactccccatgagttgactcactcacattcttggtaaatgaactactgcttataactcttagctctgaaatctttgtcttttgtccatttgtcttttctgactgccacatccatattatcatttttacatatctgtgaactggataattctgcctggatgattcacagtcacttctattcagcatgtctaaaacataattaatatttctttatctccccattccatcctgcttcttgaactctccatccctattttctggaaaacagtatgatgaagtacacaaccactcagatcggaaacttgggcatcctgctggactcatcctcagccctgaactgtgccctctgtgcatctggcaagtcatcaagtcctattgactccacttcctaatgatctcttgcatccacattcatcctcatgacttcttaccttaacaatcgcaaagcctgatctctcttatttcagttttgcctcattttactccatcacccatggtgaagccagtgatttcaaatgccaatcaaatcaggtcatttccctacttaaaatcctcagtgtcttccctggcttacagcttcaaatctgggttcgctagcacagtatacattccccttcattggtttcccaatttatagcttaatttctcatcaatttcactcctttgtacttcacaagcttatcatgctgaactatgtggcattttggggacagaaacatttgtctccaaaatgtacaggcaatatgggacccttggtgggcagagcaatacaccattcattctctttatagcttcatgtcctttcacacattgttccctcagagagcattctcacgttcccttggtgaatttctattaatattttgggcatctcaagattacctacttggataagtcttttcccagcttcccttggtaagtttatattttatggcttatctccctgtggggtttttttttttctgattataaatgtcatcactctagaaaattttggaaaatatggaaaaataaaaaataaaaatggcctacaattcattcccccagaaattaatttctcagcattttagtggacctccttttggtatatttaccataaatatttacatatatttagaaaccagtattatactatatattgttctatagcctgctttgttaaaaaaagccatggtaaatattcttcaaaggcttgacatttaatttaaaaaattgattcttctgatttcaaaagaaatgcatgctcatgtaaataaaaatgcaaacagtacagaaatttacaatttagaaaagcaaagtccttcataatcctgtcataggttttgaacagtttgttagcatacgctttcagactttcctatgcttctactaatttcaatatacattaaaaatttatattgtgggacagtatgcttcatctattctgaaactttcttttaaaatatacttaacaacgtatgtttgaaaatgtaaaaacgaactttaatggtgtctcagttgtaatcatcattttgcatttttctcttctactataccctgaggccttggaagaaagctgttttcctgcaagtgaacttaatttactgttttctgagtaatttgggaggatattagacagatagttgtgatcacttctcagagaactccttgcccactggagaagggtgagtcgtggtgggccctggggactgaccatgctttgccgctgctgctggagttggctgacaaggtctcttcttggatctggagcctaccttgactcaagacaggttcctccaaccacaagcccgaggatgcccttctcctgctctctaaaagtgctggtgacactttgtccatgttgaatggtcttcttgtcctatgactccctttatttgacacattctcagcttctgtttctgactaggagctgtaaacttataatccctctttttggttaagaggagaatcactggaacccagctgatgggatcacagggctaaggagtccagagttatttgaatccctgtgtagtccagctaacctgttccatgatgagagctgcctgcctagtccagggagccaccccaaagacaaaagccttccttaatcccagagagggtgtgtgagtaagcagccacccactggcattgccagaagaaacgatggatggtgggtgaggagctccgtgttcccacaatggacaaaatgctgttattatggccagtgtgtgctatatcacattgccaaacccagtgtttcattaaaggggtgttgggggacagggtgccagggatggtgctcatgtattgataaatcaaagtgcttcttgccttttctaatcttttgcatctcctgttctgttttcctaccatttaaatctctagtgtaccctaatatgacagtgtggttaaataaatgtggccatgaaattcagagaaagaaaagcttattcttttcagtaatcgtcagttaaaatttcacaatgatacatgctttatacttttcagacacaggttaggaaacatctatctccaaaaggtacaggcaatatgggagcctcagtgggcagagcaaacacatgctaaggtcattttgttgggtcaggggttgaggggggcattgtcatgggctttttaactaaacaaatcgccaatcaaatatcttccagattctgatacccatgctgaattgaagggcctttttgacaggtgtaatgtttggccaaatattaaaccaaaagcaattattaaaacaatactttaaaaatgtttattttaagaaaatttgtacaagtatacaaaagaagttcaactacaattagtttctgagttatgttgagtcattaatcaaaagcttcagtcctgaggaattctgcgaagttcaccactgcactttgcctgcatcgcttttgtggttttcccagacatcttcctaaagcatttgaaagtaactttccttccgcctgctcccccagtgcccaggcctcttacctttgtatagctgcaaacgatttgcaattgccaacctgtgttttccttaccgctaggaccagtagactgtgatttttttttcttattctgtattaaacataaaaaacttagctctaaatataattgcatccttcatttgtagaagttgatatgttcctcatgacagctcagagacataagaagcatcaaaagtagaaaaaaaaagaatcagtgtagaccatttctaaatatagtcagtcacttataaagtacaagcaagaaataaagtaaatagctggtacctattgaacaattaggtgtcttgtagcttattgtgagatggaggacaaatcactaaacttccttgagcctggttcctcatctgcaaaatgagaacagtaataccggccctgctggcttcataagacccttgggagggccaaataaggtgatgtctagaaaataggaaagcacttttaagatttgtttttttttggaaacagagtctcgctctgtcacccaggctggagagtgcagtggtgtgatgttggctcactgcaaactccacctcctaggtttaagagattctcctgcctcagtctcccaagtagctgggattacaggtgctaccaccgcgcctggctaatttttatatttttagtagagacagggtttagccacgttggccaggctggtctcaaactcctgacctcaggtgatccacccacctcagcctcccaaagtgctgggattacaggcgtgaactactgtgtgtttttaaataataaaaatacaagacagagtggtaatataaaggcatgcctcctccaaaatgcaggagcagaggctcataatttgaggatgtttgtccttgctagagatttgaagagatggattcacatgtagaaataaacaaatatcaactggttagatcacagaggagaagcctcagaacatcagatcaagaacatgtagaacatgcagaaaaggcctcaaggcaacagtttgctttgcctgtgcagcagccttacaagaattcatggttttccagtgtcagtatcttagattctgtgacctgtcactagggaacctactctgcaaggctggcaaggaaactaacctcccatcccagggccaatttgctttacagaacattagcactgttcttgcctttgggcttgagcatcactggaaaatggcttcacacacaggaatgcttccttgtatggacttttaaaatgctctttcatcttttgttcttcaaactggctattcctatcagtaaagcctatatgcaacccccatgttttttatgaatccaatttaaagacacacaatacaattcttgtaagtgagaaaatgtcacagaggggctcagtcagaagttgacaaaatgtgcccgggttcttacagctattgtggtttaagggcaatacttaaaccacatagtatttttttaaaaaatactttcaaaaaaatgtcttctttttcccattgatataatgctaaatgaagagctgccagctactgatgacatttgcttttgccgcatttttacccctcaatttgcttgttcattccctgcctcatttaatgctatccccatgaacaaagatagccaaaggcacaatcccaggtgatgcccaaggcaagcctcacaaacaagactgaatttgatgtgaaggaaaaggactctgattctccaaatgttttcctttactgttggctaatacctaaagttttacagctagaacatcctttctttggaatgtccctctctgttcctcttctctatttccaggcaccactgatctgcttttggtctctatagattagataatttgaattttataaaactgagtttgaattttataaaactttatataaatgaaatcatacatgtatactctttttttggtctggcttctttgattcagcttaataattttgagactcatccatgttgtcgcctgtagcatgagttcattctttttattgcagagttgtgtcccattgtatggatctattgcaatttatttatttaccttttgatgattttgggtagttttaaattgccattaacattcttgtctctttgaggatttttaaagagatcttgttactagtttttgatttaattccaagaggattagatttgaatttttaaaagtttattgagacttttaaaatatagcttagaatataatttattttggtaaatgttccttaaacacttgaaaataatgtgttttgctgttgttagggttttttataaaggtcaaacgataaactggtggatagtgctgttcaagtctttgatatcactgctgatttctatctctttgtttaattaaatattaaaagaggggtgttgagttctccaaatgtgatgataaatttgcctttttttggcaattctatcagtttttgtttcatgcatttttgacgttctgttattaagtacatgaatatttaggttcgttatgtcttataaataaattggcccttttatcaatatgaaatgagcttctataaccctagtaatattatttgctttgaagtaggctttttctaatattattatagctaatctggctttctttagattagtattatgatagtaaatatttttcaatccttttagttttgatctatttgtgtctttatagctaaagtagctctcttgtaggtgggagattgagtcttggttttttatccaatttgacaatctccatactttctaattgggtttaattaaatgtaaattaattacatttcattgtttttaatgtaattattgatatggttggatttaaatctaccattcttgtatttgttttctacttgtcttatctattctgtgttcccttttacctctttttctgtcttctttatggattaattatattttaatgattttttccttttttagtttattagttataactctattttgttattttagtcattgctttagggtgtttaatatatagatggttcttaacttatgaagatttgacttatgattttttgatgacacaaaaacaatacaaattcagtagaaaccatactttgagtacccaccatacaaccattctgtttttcactttcagcatacagtatttaatagattatgagatattcaatgatttaatagattacaagatacttattatacaataggtcttgtgttagattattttgcccaactctaggcaaatgtaagggttctgagcatgtttaaagtgggtgtattagtctgttttcacactgctataaagaactgcccgaggctgggtaatttataaggaaagaggtttaatgagctcacagttctacatggttggggaggcctcaggaagcttacaatcatggcaaaaggggaagcaggtgcatcttacatggtggcagatgagagagagtgaagggagaagagccccttataaaaccatcagatctcatgagaactcagtcgtcactatcatgagaaaacatgggggaaactgctcccatgatccaaacacctcctaccaggtcccttcctcgacatgtggggcttatggggattaaaattctagatgagatttgggtggggacacagccaaaccatatcagtggctagtatgatgtttgctaggttaggtgtattaaatgcattttcaacctatgatatttttaacttacagtggatttattgggacgtaacttcatcataagttgaaaagcattcatatatctttaatttattatagttaactttcaagtgataatacaccacataaagcaaaagaatcttaaaaatatacttgtatttcttacctcccatccttttgtacaattgttgtcatacatttttcttctctgtatattatagaacccataatatattgctattagttttatgttaaatattaagaaaaaatttaatatttacctataacaacccttatagttattacttctcatgcttgtcattcttttatatagaaccaggtttccatttgttgttttttttttgttactgaaacgctttctttagcattctagtgttgcaagtctgatgatgatgaattatttcagctcctttatagctgaaaactttttgatactcactttgttttaaaaatagattttcacttaatatagaattacagattgaaaagtttttccttttggtacttccactattttctggcttacattgtttcctgtaataaatctattctcattcttatgcttcttcctttgaatataatgtgtttgttccctttggcttctttttaacattttctttttggcacttatttcaaggaatttgattatggtttgacttggtatagctttctttaagtttcttacttttggagtttatttatcttcttggatccaagggtttacagtttccatcaaactgaaagttttcagccattccattattttttcaatttttaaaattcccacgtcccccagttttcagggattttaattatacatatattaagctacttgaattatccaacacctcgcttatgctctgtgcattcatttttaaatctttttaaaagtttattatactttaagttctgggatacgtgtgaagaatgtgcaggtttgttacataggtataccagtgccatggtggtttgttgcacccatcaacccatcatctaggttttaagccctggatgcattacgtatttgtcctaatgctctccctctcctttccccccacccccaacaggcccgggtatgtgatgttcccctccctgtgtccatgtgttcttattgtttaactcccacttgtgagcgagaacatgcaatgtttggttttctgttcctgtgttagtttgctgagaatgatggtttccagcttcatccatgtccctgcaaaagatatgaccttatccttttttatggctgcatagtattccatggtgtatatgtgccacattttctttatccagtttatcattgatggacatttgagtaggttccaagtgtttgctgttgtgaatagtgctgcaataaacatatgtgtgcatgtgtctttatagtagaatgatttataatcctttgggtatatacccagcagtgggaatgctggatcaaatggtatttctggttctagatccttgaggaatcgccacactgtcttccacaatggttgaactaacttacactcccaccaacagtgtaaaagccttcctatttctccacatcctctccagcatctgttgtttcctgactttttaatgattgccattctaagtggtgtgagatggtatctcattgtggttttgatttgcatttctctaatgaccagtcatgatgagcttttgtttcatatgtttgttggctgcataaatgtattcttttgagaagtgtctgttcatatactttgcccacttttggatggggttgtttgattttttcttgtaaatttgtttaagttctttgtagattctggatattagccttttgtcagatggatagattgcaaaatttttcttccattctgtagattgcctgttcactctgatgatagtttcttttgctgtgcagaaactctttagtttaattagaggccatttgtcaattttggcttctgtggtcactgcttttggtgttttagtcataaagtctttgcccatggttatgttctgaatggtactgcctggttttcttctagggtttttatggttttaggttttatgcttaagtctttaatccatctgaagttaatttttgtataaagtgtaagaaaggagtccagtttcagttttctgcatatggctagccagttttccgaacaccatttattaaatagggaatcctttccccatttcttgtttttgtcaggtttgtcaaaggtcacatgattgtagatgtgtggtgtaatttctgaggactttgttctgttccactggtgtatatatctgttttggtaccattaccatgctgttttggtaccattaccatgctgtttttgttacggttgccatgtagtatagtttgaagttaggtagcatgatgcctccagctttgttctttttgcttaggattgtcttggctatacaggctcttttttggtctcctgtgaaatttaaagtagttttttcaagttttgtgaagaaagtccatggtagcttgctggaaatagcattaaatctataaattactttgggcagtttggccgttttcatgatattgattcttcctatccatgagcatggaatgtttttccatttgtttgtgtcctctcttatttccttgagtagtggtttatagttctccttgaagaggcccttcatgtctcttgtaagttgtattcttaggtattttattttctttgtagcaactgtgaatgggagtttactcatgatttggctctctgcttgtctatcattggtgtataggaatgcttgtgatttttgcacattgattttgtatcctgagactttgctgaagttgctcatcagcttaaggagttttttggctgagatgatggggttttctaaatatacaatcatgtcatctgcaaacagagacttcctctctttctatttgaatatgctttatttctttcccttgcctgattgccctggccagaacttccaacactatgttgaataggagtggtgagagagggcatccctgacttgtgccaattttcaaacggaatgcttccagtttttgcccattcagtatgatactggctgtgtgtttgtcgtaaatagctcttattattttgagatacattccatcaatacctagtttattgacagtttttagcatgaattgctgttgagttttgttgaaggccttttctgcatctattgagataatcatgtggtttttgtcattggctctgtttatgtgatggattaagtttattgatttgtgtatgttgaaccagccttgcatcccagggatgaagctgacttgatcgtgatggataaactttttgatatgctgctggattcggtgtgctagtattttattgaggatttttgcattgatgttcatcagggatattggcctgaaattttctttttttgtgtgtgtgtgtctctgccaggttttggtatcaggatgatgctggcctcataaaatgagtcagagaggagttcctctttttctgttgtttggaatggtttcagaacgaatgctaccagctcctctttgtacctctggtataatttggctgtgaatccatctggtcctgggctttttttggttggtaggctgttaattactgcctcaatttcagaacttgttattggtctatacagagatttgacttcttcctggtttagtcttgggagggtgtatatatccaagaatttatcaatttcttctagattttctagtttatttgtttgtagtattctctgatggtagttggtatttctgtgggaccagtggtgatatcccctttatcattttttattgtgtttatttgattcttctctcttttcttctttattagtctggctagtggtctattttgttaatcttttcaaaaaaccagctcctatattcattgatttttgaagggattttcatgtctctatctcctttagttctgctctgaccttagttatttcttgtcttctgctagcttttgaattctctcttgcttttctagttcttttaattgcgatgttagggtgttgattttagatctttctcgctttctgatctgggcatttagtgctatatatttccgtcttaacactgcttaactgtgtcccagagattctggtacattgtgtctttgttctcattggtttcaaagaacttatttatttctgccttgattttgttatttacccagtagtcattcaggagcaggttgttcggtttccatgtagttgcatggttttgagtgattttcttaatcctgggctctaatttgattgcactgtggtctgagatactgtttgttatgatttttattcttttgcatttgctgaggaatgttttacttccaattatgtggtcaattttagaataagtgctgtgtggtgctgagaagaatgtatattctgttgctttggggtggagagttctgtagatgtctattaggtctgcttggttcagagctgagttcaagtcctgaatatccttgttaattttctgtcccattgatctgtccaatattgacagtggggtgttaaagtctcccactattattgtgtgggagtctaagtctctttgtagctctctaagaacttgttttatgaatctgggtgttcctgtattgggtgcatgtatatttagggtagttagctcttcttgttgaattgatccctttaccattatgtaatgcccttcttggtctttttggatctttgctggttcaaaatctgttttatcagagactacgattgcaaaccctgcttttttttttttttttttttgctttccatttgcttggtaaatattcctgcatccctttattttgagcctatgtgtgtctttgcacatgagatgggtctcctgaatacggcacaccaatgggtcttgactctatccaatttgccagtctgtgtcttttaattggggcctttagcctatttacatttaaggttaatattgttatgtgtgaatttgatcctgtcgttatgatgctagctggttattttgcatattaattgatgcagtttcttcatattgtcattggtctttatattttgattttttttttttttttttttttttttttttagtggctgctaccagtttttccttttcatatttagtgcttccttcaggagctcttgtaaggcaggcctggtggtggcaatatccctcagcatttgcttgtctgtaaaggattttatttctccttcacttatgaagcttagtttggctggatatgaaattctgggttgaaagttcttttctttaagaatgttaaatattggaccccactctcttctgagttgtagagcttctgcagagatatctgctattcatctgatgggcttccctttgtaggtaacctgatctttctgtctggctgctcttaatgttttctcttcatttcaaccttggagaatctgacaattatgtgtcttggggttgcttttctcgaggagtgtcttagtggtgttctctgtatttcctgaatttgaatgttggtcaccttgctaggctggagaagttctcctgcataatatcctgaagagtgttttccaacttggttccattctccttatcactttcaggtacaccagtcaattgtagctttggtcttttcacatagtcctatatttcttggaggctttgttcattccttttcattcttttttctctaatcttgtattcacattttatttcattaagttgatcttcagtctctgatatcctttcttccacttaatcgatttggttattgatacttgtgtatgcttcacgaagttcttgtgctgtgtttttcagctccatcaggtcatttatgttcttttctaaaccagttattctagttagcaattcttgtaaccctgtatcaaagttcttagcttccttgtattgggttagaacatgctcctttagctcagaggagtttgttattacccaccttctgaagcctgcttctgtcaattcatcaaactcattatccatccagttttgtgcccttgctggagagaagttgtgatcctttggaggagaagaggcattgtggtttttgaaattttcatcacttttgcactgtttttttcctcaacttcctggatttatctacctttgatctttgatgctgatggcctttggatggggtttttgagtgggcatcatttttgttgatgctgatgttattgctttctgtttgttagttttccttctaacagtcaagaccctctgctgcaggtctgctggaatttgctggagttccactccagaccctgtttgcctgggtatcaccagtggaggctgcagaacaccaaagattgctgcctgttccttcctctggaagcttcatcccagaggggagcctgcctgatgccagccagagctctcctgtatgaggtgtctgttgacatctgctaggaggtgtctcccagttaggaggcatgggtttcatggacccatttgatgaggcagtctgtgccttagcagagctcgagcgctgtgctgggagatccactgctctcttcagaactggcaggcaagaagctttgtctgctgaagctgcgcccataggcaccccttcctttaggtgctctgtcccagggagataaagttttatctctaagcccctgactggggctggtgcctttctttcagagatggccttcccagtgagaaggaatctagagaggcagcctggctacagccactttactgcactgtggtgaattccgcagaaattcccaagggcttaacactgtgaggggaaaaccgcctactgaagcctcagtaatggcagatgcccctcccctcaccaagctcgatcatcccaggtcaacttcagactgctgtgctggcagtgagaatttcaagccagttgtccttagcttgctgcacgatgtgggaatgggacccgctgaatgagaccacttggctccctggcttcagccccttttccagcggagtgaatggttctgttttgctatggttccaggtgccactggggaaccaaccaaacatacaaacaaacaaactcctgcagcttcctcagtgtctgcccaaacagccaaccagttttgtgcttgaaacccagggccctggtgttaggcacacgagggaatgtccttgggtggtctgaggcttgcaaaaaccatgggagaagcatagtatctgggccagatagcacagtctctcacggcatcccttgtctgggagagagaggcttcctagctccttgcacttcccaggtgaggcgatgccccaccctgcttctgctcaccctccatgggctgcacccactatctaaccagtcccaatgagatgaaccaagtaccttagttggaaatgcagaaatcacccgccttctgcattggtcttgctgggagctgcagacctgggctgttcctattcggccatcttgccagatcccctgtgcattaattttttattaataaatataattttagaacagcttcagattaatagcaaaattcagcagaaaccacagaaagttcccatataccctatcctccccaccccaacaatctctttcactatccacatcccacacacaacagttaatttgttacaatcagtgaatccacaccaacacatcattatcactcaaagttcatagtttagggtgagtgggtccactgtagcatagtcagggtgagtgggtctgctgttttccttgcctagttctgctccagcagcagtgtcagcgcaggggcgggggactagcaggggcagggctggcaggctccatgtccaccaatgctctgatgacaatgacattgcggcaggggaggggaagtgcagtgcactcatgccggcagcagtggcatggtaggctgcatgcatacactcatgctggtggagaagggaaggcaaggatccatacacacatgagaggtggccgttggtgagtgcaggtatgtaaagtggcatgtgggaggctgcggtgtggggagggctcaggcaggctagtgcatgtccatgagggctgctttgctggagcattctgctggtcaggtgcatttgccagcacaggagctatgatctaggcccccaggaggtatctgggtgctttattgtaagcaggcacaattgggctggggctcccacagaggcgagcagaccaaggggttctcaggtcagacagggctcatctcattggcaagactgccctgcagagttcaggtacaatagtttctctggggctaaagtctcctgtgggagcaagttgagcctgtggggatggctgtccctggccatgctctgctacagatgcttccacaccaaaccctctaggctcaacactggctggagttctgctcctaccacttctctaagcagctctccctgccaactcaagtgtctgtcatggttgaggagtctcctcctgctgggattccagaggcctgtggtgagagtgggttgcttcttgcctcttcaacttacccattcaccccttccacagaagtcactgggggccaggaacaagtcttgggtgtagccctctgcagtgttctcggcttcctcctccttcagcccagcaactgtgtcttccctccatccactctcaacgccttttctctaacgatctgctaggagtgcaccagtcttcctaatgtccctgtccctcagtgggagatgttctttctggctgtgtctagtcagccatcttggagcaggaatccctggcatttcttttcagttctttcttagaatttccgtctctctgcttaccctacctatctgttcttgcatgttgtctactttgtccactcagtgcccttagtatattaatcatagttttatttataatgtcaacagttttttggtcatagatattgtctgtcatgttaaggtaatattgtttattcctactgtgccagtggtattattttttaaattggaaatcaatgttgaattctgaaaaaaaattctgaataaataatatctcacttatttagattactactaataacagattttttaaagttggagtaaaaacctccttacattactgaaataaactctacttggtcactgtgtagtagtcttttacttgctataagttttaatttgcaaaaattgtatttgtagtttttaccgctagggttatagtgagataattttttaaagtttttagattatctttgacaagttttggtattagtggtgtgatattttaacatacacacaaaagatgatcttttcatcttttgtatgcacagttggtaaactatggtatgacccacatgacaaattattcccatcatttgcttttacaaataaaatttcactgggagatattcatgaccatccattaatgtattgcctgtggctgctttcccactgcagtggcagggttgagtagttgcaatagagattgtatggtacacaaggctgaaaatatttattctctggtcctataaaagtttgctgatctctgatttagcataatttagatagcatagaaatgctttctgtctcttgatgatctagaggagctcactcctgaaacaaaagcatgggctctagagtaagatagcattgggtttaaaactcagctccagcccacattattaatgatgtgatgctgggcaacatacttaaccttcctatggaccgttttccccaactataaaatgtgaatagtaataaaaataataatacttgcttaaaataatactataaagaatgaaatacgttaacacatgttcaaaatacttgtcagaatgctaggaatgcatacattcttaaatacaagttattgttatgtttctcttgggagagttttttgatactgccgtcaaatcatgtttgttttctgcagtacccaaaggctatttgctgccaaagatatattcttaaattaagtaaattagttttttatctgaaagtattttttccaatccagattctttctatcaaatatatgtttttcaaatcttacagaaataatattttctaaagtttactctgtcttttcagcaagtctcttttatagttttgtattctttcttgctttgattcttcagatcttcttctaaacttctgtgattactcatatattcagtgattgtttttcatttgtgcatcagggggaatcatcttttgctcattgctgggactgcagataggtccagatcatacttatttgggtctttctccaatatttcaggtctgggcacagggtgaaaagaagagcttagagtagaaaccaagatgtcagtgggagtaggaagacagctattgtttatttaagctgtaaggctgaaagcttcacttgtccaaaaaagtttattttctatgacgattacattcataagttagctgagcactttccaaccactatatttactgaattattaggagccatgcactcccaggtggggcgggactgagatttgccctcctactcatcgctgcatggccttctcttgtctccagctcctgtcacttgtagaggtttggctcagggtctcattcactaacttcccaggtgggaaattactttttaggttatgactcagggtttggtaggctccttttaaaatctagtcttacatgtattttatcttataggcattttcaaagttaccagcatatagaagagacacttccctctgtttagaactgacataaattctctatctctatccatttgaatagaaataaggggcaagctggccggccatggtggctcacacctgtaatctcagcactttgggaggccgaggcgggtggatcacttgaggccaggaatttgagaccagcctggctaacatggtgaatccccatctctactaaaaataacaaaacattaactggatgtggtggcacatgcctgtagtcccagctactcaggaggctgaggcacgagaatcgttggaacccaggagccggaggttgcaatgaaccggattgtgccactgcactccagtctgggcgacagagtgagactctgtctcaacaacaacaataacaacaacaacaaaaataaataaataaaaataaggggcaagctaagttgggcagctaggatgatggactcgaatcagatgtcaattgattttcttatttttttaaaaattgtggtattcaaacacaagagaaaacatttctatcaaatagccaacatgtacaacacaaaaattatatatctcttaaataccttggcaattgataattatattaagtgagttttgtaaattacttgaaaagataattgtaagaagacttcttttctttgccaactctggggtaaagaagggattcttagaaagaacattttcacggagaaggcaaaattccaagtttcctttctcaagcttaattttcatagattgagctatattggttctatatctgtgtccataagtcagttattcagataatgaaaaaaacatttaaacatccaccttggtatgaatttttggtttccgtgttttaatttaagccaaaatattttttggtttgaatttattatttcaataaataatagtgaaattatttcactattccactttgctttgcatgtgtgaattaagccagtggaagcttcaggtgtaatagaatttgatggcgttaataaatataaaagtgaatttgcacaaaaaatatgagatgaacagtaggaacacctggcatgggacagaacatccttgttagtatgcaggtaaattcagttactttcattttcttttctcccctatacattggttgtcaggtccgatcgatcatcaagtccagttgtttctaacacctagctctctccctaaactacccgctccttcctctgcactgagacataatctcttgcccccaaattcagtggcctctgaagaggtgcttttagactctgccctcctctaatccccattgtctgtcctacattgacttctaaaatatggatctggccttgtcaataccctgactagatgctttaatgcctttaaggataagaactgaaatctttaccattgcaaaaagtggtctcaatcatctgtgcaatctgagactttccccaggcccttcagtccaggcacatggatagtcctgttgttcctagaagacgtcatgctcttttatgcctctgtgcacttgtacatgctgttttgtttgccgggatcacctttgcccctttactacattactgtgcactgtcctatcatattctaccttcaagaatcaggtaaaacatcaccaagcccatttggggagtttgcactccccagtttttggcctctggagcatttgcacgtatctttatttgatgatggttccctagcattcattccctctttctttgaccagtggttctcagatccctggggatctgtctctcctccattgtcaggttatggggattggcttgacctcacactcaacccaaatgatggctctcactgacttaagaatatttcactttcctggctccagtgactggctcaagggtgatctgagccagtccaattagcatgaacccaaaaccatactgtggttgtgacacacagacatcacttctcttctgggtttggtggtatgaggcttagattcctatgaccatccccctgcaacaaggagaaccttcctgaggctataaacaagcactttaaggaggaagagttgagagaaggagcctagaaacatcagtgaacccccaaatcagggcaaggctaaagctagttctgccttctaaactactcttcatgagccaaaaacaaataaaagttaactaactgaaactgactaaccaccattttttggataacccagcataggtaaagtttgtttatttacatttatctttgcatttcaacatataacagccacctggggacatcatagttattcagtaagcgtttatgaaaagatgggaaggaaggagacttgtagtttttcctaagtattttctgcttggctatgtaagtagcaaaactttgctctgatatttttagatttcaatccttttgtattttatttcttggaaaaaatatggaaaaaatgtttcagtaaaagcaaaggacttacacaagaaaaaatcaggaatttctgtttctcatttatttttaccaaggagcctatcagagaatttgcaggacgtgacattgtctgtccctggaaggcactagaaattgagggactgtaaatttgcagctgttgaaataaagtgttagattttggtttttaaataatactctattttgtgccaattatcttctttctccagatgcactctctttgcttctctaccctgctctgcaacccagaaggcagacctgcatggcctacatcaataagaggccttatcatttggtttggccaatgggaatccccagcaggtggcagggtgggagtagtgggtaggagtagtgggtaggagaagaagaaaatgtggttggggtatttatgtccccattgggtatttatactctccttgcaggggatcatctaaggctgactctgtctcttgaccagaggtagtttagtccttgataatgggctctaggcagcctactctttatgactctgtctaccttggttctagcaaatattccctcctctcttttgcaactcaccctaggttactgcagcaacccttacaattcttctacacctttgcaaataaactcatttgaactgcctaatttgagtgtgccatctgttttctggtgggaacccaagtgatacatgtatatttcagaaataaaaaaattaaacaggaacaatacaaatctaatccacttttatgccgctacatgaaatattatcttttaagattggtggaagaatagaatccatgttagctgtgcccatagaaaaatgactaaaaagacaaatcagagaggagaaatgcttagagggcttccttggttgtattcaagcaggtcttcccgttgcacaacctcaggggtgtcattcacaggataattcaggctaactttaggaaattttgacaaccagaactatttctgtttaatatatagagaatgagaggaaatcaagtacctttatttgggtgaaatgaggttaaaactggtactaacaagagccacaaagagaaaaagaaatctccaaacaactcagcttcttttggccttgggttttgctcctttagtgtaaaacttctgaaataatacagaccaagagtggtgattcaaagtaagaaactttggtttagaggtttgttcaggtcagaatacatgatatatttttttttctagcaccaattggcagaactaccagattcctaaggcttgtgctatatccttgtctaattctttagtcatgactgggaccaaagtttgggaacttcctgcatcctagtttgggaaagggtggatcatcatgatttcccattcctgaaggttgccgctgctcctacttgatctttgcaacagttgtgttctctgagaagtgtttctaacttctctcccaatgtctacccttctttttgatgctcctcctttttcacggccatgcttcccatcttgcgaacagggctgtgcctctatctcagcttggctttctctgaagtgcagctgtagcagtgtggagttaaaaataacgacatcttgtgagactaggaaggaggatgagagtggggagcaggaagcatgttcattaatggcttttaaatttccaaatgacccctctgagtcactaacagacttggctaagaacatctctgacaacttggagggggaaagaggtgtttctgtgttgtactctgagtgtgttatgagggtttatgttaacaaggagggaaaaaaatacttgcccatactgacaatgagctgaatttcatgctgtgagaaaccagaacaaactgttaattctggtgtaagtcagctgtccaagaatcctgcatcctgactgcttgccctggtatcacaatgttcactaattagccagcattcttactatgtgggcacatgttctatacacagggcaagccaaaggttctatagtgaaacctcactcattcatacctattggaagtggccatcaggcttaatgagaaatctcagttatgggatagttatttcaggtgtatagttctcaagaatacataataatataaatgcataacgtaagaaatgcaaagacaggtatttttccagccccgctttaatggataaaaatccagggttattcatgtatttagtgttaaaagaggcgtaagatactatgttttttaaacttaattttttaaagacacagtcaagtggagaagtaaatttgtatacaatcacatttagagatgatgagttccataatcagagtgtgtatggtattaatggtgcagagaagacacagtttggcttggtggaaagaggggcaagagccagggaatgcttctggaagggacgtgggagttgagctggagttggattagggtgggtactctaggcagagcaaatagcatgtgcaaaggtactatggcagggaaacagactgtacttatgttaactggtattttgtttgcagtttattcaaaataatggagaatgctctcctttaggggaaaaggtcatgaaagggctcctgcctatgtacaatgcttaccttaattaataagccaacactcacgtcaatgaactttagtctaaaagcataatgctttgaagaaaagaaaatttccaaatatttcctgaacattaaagacaggtgttatggctttgatagtttagacaaaatatagactgcatgcatttcagttcatgttgatacagatactttcaggaatctgaaaatatctgtactttcaggtcacagatgtgaacagaacacaagatgtctggaaaattccaccatagcacagaggcataaggaagtatgttgtgtgggggctgacaaacatgctcaatattggtgtgtctgcaagtctactaaatttatttcaaagagtttattctcttatcaaggttaaatgccttcagcatcttgttcaaactgtttattgcatagcaaacatttctccagaatggcagaaagataagggcttggagcagtgacggaaatcaaatgagctaatttcaaaccagtgcacttgcattccgcattagacattagagacaatttcttgaaaaaaagatctttaaactgttagcttgatattaatttaaaactactaaatcatcaatacattgtgccagtttccctgcttccctgcaggacatctacaatgatctgcactcctcatggctgctcactaagcaaactgtcagactgcactgggttattgaattggagtggaagaagcacaggctgagactgtcggtgagctgagggttgctgctcaggaaggcatgggcagctcgctgaccaggaatgcctctgcctccccttgctttgtttgagaacttggccctgctctatggagcagggcctccattttacttggggtacatttcactttttctgaagtgttgtgtaaagaacagaatttaggctagatatgaatgtatacagatctcattcttagttttcacactatcctgggttataattctggattgtatctgtagtacagaaaatttgggtgatttcctatgcattctgtttatgctttctggaggtcagagggctccagcagatagaggttatttcctcagcctgtactagagagagccagtcatcatgatatttacaaaacactcgcatcatccattcatctctgcatgcaaaagataattattgatcaccatgatgtgcctgacaccatgctgagagcagccatgctagctaaaatggcacctcacccatcaccaaaccgggtccagagatggtcctaaaattcaggagcaagtggcagcactgacactagaagctgtgtcttttgatcccagaccctgggctttctctgctccccacagggttccctgggagtgggctgggactgtacctggcaggcacctgcatctggaagccatgcttcagtgtctcttggctgggtattgcccttctggaaaaatcccttccactttcaaagttattttattatttacttgctcaaagaggacatggggtaaacaaattcgtgggtgggtgcctcatagtatgattttccacagggtttggtccaggaagcagagttggccaaatgcaatgtggaggtttcaaagattttttaaaagagagaaaaattcctttgtgaatgataatgaaatccaagctgtcaggctgtgtttggtgtcaaacagagatttgagatggtcctcagtatgagtgtgggcagtgaaaaaaggggtgcagtggagtgtcctctcatccatgctgagagaatattgaagaggagtcagaaatgagaatcaaattatcatgactgaaaattttcataccttattctggggaactatatatcaaagggggagaacaaaaaaagtcacaaaatgcattactaattagaaattgtcttcaaggtttgcttactgcctgatgcattccagcaaattattacttttgaacttgttaaataattatctgcaatggttaatatttgtaatatgcaaacatgcattagttttagatatatggccaatgcaatgggttggatttctgggtaatcatcagttgcttcgtctggatattatcaaaacaggtagatgcctttcagccctaatataattgactaaattctaaaatcaatctctcagcttaataaccccaggtcctatgccaatgcccacacacaggatgatcaattaagcactattgtggaaaaggcattcaaagggcagtttgttccttgctatcatattatgccccatgaagatggaaatagatgattcagtaacggaaaactcagccaatttacttacccatggccaagagactggcttactttgacacttctcataattctgtggtgattactcaaaggaaatgaatgactccaggaaactgagggatatgtctatctatgtgacagtccaggtggtgtctgaacttgtggcaggttgcccaacagaatttcttatctgagatgtggaaagcccagcaagagctgttcacaggaagaggctctgaggaggagctagaattggaggaagagtttgggctctcaagtcaaaaccggaagggaaacagggccagaaggggtgatgctggctaatgtggctgcacagagagttttgtcctccagatttcaggtatctgatgatactgatgagctctttactggggtgcaaggaagccttgtaagggaacttcatgatcccccaccatgttagttcagtgaatcaagcatcttcctggttcccagttttagtgatagttcatcctgtagatgcagctataggaggtggagtgatagaaagaacagaggctgtgtgcagaccagggaagaggcagtacattcttcacctggaacactcaagtccaagcagagaaaaattttctaacctttcccaggggtattttcagtttattgatctctctagaaaacttgaaaatcctcaaaggaataaagtgttagtgatggtttcagatactatgaaagatgatggggtagatttcttttatgaataaaaaaatgctgtttttccttcagtcattccacaatcaagagctaattatgaaatccctactatgtgcaggctgtgggccaggctttagagatagctacaatggagcagaaacagattggttggaggtgctcctggatgttactggctatgtgggggatgcgaagggagacaagcagacaaatgattgtaaactcacacccactaccaggtggcaaaggatgacacttctgactcctagagtttattgcagaggtctgacctaagcagctaagacctccagaaattgatgattgggttaaaatcagaagggtaggcacagaggggaggcgagcacttcaggcagaggaactgcaaggaagcacttctgggatgggaggagcttgaggaaggcaaagctctgaaagtgtgtcacatggaaagggcaagagggaaggtggtgagaagtgctgctggagcataaatcctgggaccttgtagatagtgcaaaattgtgaccgtgtcagctagatagtgcaaaattgtgactgtgtcaacagagtaagtggggaagccgtggaaggcttttaaggcaatgaggagtgatgtttcaaaataaagacactctgaccactatttggagaatagatttggtgggacgagtggaagcagggagatctgggccagatggaacagctcgcttagtaactaacaccagtaggatctggtgatgggctgagtatggggtaaggaggaaggtgctgtcctcctgtgtctgttagaagtgccagtattctcttagttacccaaataaaacaatgtggagtcctatcagtctctttcacttttttttttttttgtcttttgagacagagtctcgttctgttacccaagctgaaatgcagtggtggggtcatggctcactgcagcctcaaatttttgggctcaagcaattctctccctcagcctctggagtagctggaactaaaggcatgcatcactatgcctggctaatttttcttttgtagagacagggtctcactatgttgaccaggctggtcttgaacttctgagctcaagtgatctttctgccttagcctgccaaagtgctcagattacaggaatgagccaccttgctcagcctttttccctttcttaagctccatctctaataagttgcaagattctgccaaggccacgacacacccacattgctaaagtagcttctggggaaaatgagtgatgctctgctgtcctccatgcagggtggggattgttggggaaactcttgtcagccttgtcatctgcctttgttttggagactctggtcatatgtaataagcagtatcccttatctgtttctacctgtgacataagaaatttgtatttggtctttgcccccagttcctgacacagaggtcctaaaacccttggaatttctggagtgacaggagtgtcttttgctctagtgaggcaagtctttagagttcctgagtagcttcaggatgggaaggctaagccatgattagaagcttgggactttcaggcccatccactgtctaccagggaggggagaggggctggagattggattgataatcaatcttgcctacgtgatgaagcctccttaaaaatccctaaatgaagtggagagcttctgagttggtaaacatatccatgtgccagaaggtagtgtgccccaactccacggggacagatacccctgtgcttgggacccttctagaccttgccctatgtacctctttctctggcattttatttgtatcctttaataaactggtaaagtaagtaaatttcttttttagttttatgaaatgttacagcgaattattgaatctgaggagggggttgtgggaacccccaatttgtacccaacttggatggaagtgtgagtagtctggggaactgctacttatgattggcatctgaagttgggggcagtcttgtgggactgagcccttaatctgggggtctatgctaattgcaggcacttagtatcatctggttggcatccacagagaactggagaactgcctggtgtggaaaacccacacgttcggtattagaattgttgtgtgagtagagaatactgagtgttttcttttgccacccaagacaaaaatggaaagactcataaaaaatcagtccccaaacttcctgttattgctttcctttttggaagatggagagattttgtcagctgagagcagatagttacctgactgcagtgatctcaaggtagggcattcagctaaatgattccaaggccatctacaggctggaaaggatcaggaaaccacccgaccgtattcttgaatggtaacagaatgaaatgatttaacaagttttcacagctcaattgaagccaaaactaatttctcaaaacttctgatctagtcatgtcttcccagtgagtgtaataaaggttgaaacattcattcttgtcacgaggggataatgggattgatgtgtttgcacgaaacacatcaggctgtcgcccgccacaagcaggatcttcacacactggtctttcagggtgtacagccttccttggaaatgtctattccttatccacctctagtattattctttctttaaacctattacctatgagttaattgttaaacagataatcataattattataagagtaactaaattgtaattgttctcatttctgagtgcctacttcatgacaggctaagtaagttttctacattattttatttaatttttataacaattctgagaagtagggactattagctcatttgtttgagatgagaaaagagaagctatggaagttaggtaacttgcagaatgtattcagatattaatggcagaggtgggagtcaaacaaaacctacgctcttgagcaaggcataagtcatggagagttacctgtggcccgcaagcatcactcaattcaattgacatgtaatgacctcctagtatgtgtgcagtataagagacgtgagatggataaatttagtttcttcttgtaggccttaaaatctgttggggaattaaacctatacatccagttaatagaacaagataagttttatttcgtcctaaagtagaggtcaggcagaggttatgaaagtgctgaggtggtggaggtaaattttgacttgggggttggtggtacatgaaggcactagggaaagcttaggagaggtagtgtcctttcacttccatcttgaaagatcagcaagcatttggcagttggtggagacagacagggaattccacatagatgcagcagcttgactgaagaccctgaggtgagaaaatgcacagcgtgttcagggaacatccaccactgcagtggcatcacaggctacctggggaggaagaaagggaaggatcagagagaggctgaactgaggtaagaatggcctccactgctgcctacaggattcatatagaatgggtggccgtggaagatttttcgaggagagagatgacataattcctttcattatgtgggagagtaaagcactcagggtttgttagctggtgctcagtgtggtattagattgatttttatgaaattgctgacataggaccattttcaaaatacaaaaatcacaatttcatatggttcaacataacacagttcaagattttgctttgcttctggaaaagcctttggatatagtgggtagctacaaatttggggtctcctggccctcgcagatcctcagaagcactgttgaggtctgctgacttttattattttaacttaggcaatacgttaatgaaatagaatcttacttatttcaagctggaatttgattaactaaggatggtaaccttagctacttcatgctgatccaagcccttgattagttgtagatgaaatcattatttctagtatttatagggaggaggtagatgggaaatgaagatttaaaaggtctctgatggtaagaactactggctgctgcagattgctgctgaaagctggcatgaacataggcatgccatgtttccaggcaaccttgggtggtcctgggcttgcaattacattccgtcattcttcaaatgttttctgagtgcctaaatgttttgtgaacagttctaggcactgaagagatggttggaaataagctagataacttgtttatctggtccttaggttttccgcccaaactagaatgaataacatttgacaaaactgttgttaagaaagactgtctagtactaaccctgtgcatgaatgaggcagagtagactctgggggaagatagggtgggatgggggcaagaggaacattcagtagtccctacttagtgccagacactgggcttttaactcattttctcctttaaattcccctacttttggacaattaggtagttttatccctgcttgacagatgaggaaattgactctcaaagaaattgagaaaattgctgccagttgcccagcatgagggtggtggagcagagtttaagcccacatctgtttgtccagcacctgagttctttccatcagcatccccagtatgaagtgattttaggttttacatgactgacctggaggaacaaatgcttatttgttcagaggcttattttcttttcaactagagttgaaccgtacaagtgtaatcaggtccatttgttgacaatggcaaggcaggctgtagagatgaaattagagtgtcaaggccaggtgactgatgtttgccaaaggcatgaaaacagcattttacacccaaggtaatgatgccgcagattcctacacgtcaaacagactccactgctatgtttagagaaagtacaataatattgttcagagtcagcaaagataatgtgcatctggttccagttctgatgaatctgtaaaaattgcaatccagatgttgtgctattaatttgggtgacatgattattattactttggcctctcttttccaaatatgttaacaacagcaacaacaacaaaaaagttaatatgatttaaagtttcatgtcacattatgttttgagacatgcaatcaggaaactagagtgatatacgaaaaaaaatcatttccctagttttaaaaatgactttcttaagacctgagtaaaaagaggctgtcctgatgagctcattcactctcagagatttttgttcttttgaagtcattgcgtttccactatggtttagtatgaacaaagaaaatcaggaactcttttcttacttgagttccagggatgtagagactatagagcttattttcttcttgtcattttaaaaatgtaaagtcttggagctgctttggcatttattattgatatagaaagagtgctcattatttaacatgcctgtgcctccctccaggggatggcaaatacctgttatggtgtctctggaaacaagctggtcataatgtcccatttacaacagggagttgtgtacctccagttacctggaacaggtaacgccagtatcaggaattgaaaatctccagtctagggattaagatggcaaataggaggcaggactagcttgtagctcccactctgatggactgagtgatatgtggagactcacatcataaacttgctccaagaactaccgcaggaacataccagaaaagcagagggaatccacagacgctctgaaagaacagaatcactgctgcaggctccctgaaatgtggaaaaactgtgagtcagcttgctttcttcacagggaggctcgtggtctggggcaagttctcagccctggtcaccagctgccagactcggtgctgttgtggggacatggtgggaatgagaccggcctttaggactgtgggctgtgtgagagcggggtgaggccagtgactgctggcttttccccacttccctggtgacccgtatgactcagcagaggcagccataatccccctgcgaatataactccactggactgggaaccacattgccatcccccacagcagccacagcaagccctgccaaaggagaggctgagcccagacatgcctatcccagcccctaactggtggtctttctctacctgccctggcagctgaagacaaaggttataatctcttggtagctctatagccctgcccactgcctgagaaacctgaatacttaaccagttgtccctagggcaaatttgcatcatccctataggactgcagctgatgtactcttaaaagcgtcacctcctgtctggaggccaacgaaaacaaaaccagcacactaaacaaatacacaaccaaggacccttacagagtccacttcacttccctgctacctccactgaagcaggtgctggtatccatggctgcaagacctgaagacagatcacatcacaggactctttgcagacactccgcagtaccagcctggagtcccatagctctgcagggtggctagacccagaacagcaaaaaaaaaaaaaaaaataataataaaataaaataaaaataaataaataaataaatataaaaaaaataaaataaaaatcactgcagtttggctctcaggaagcctcattcctaggggaagggggagaacaccacatcaagggagcactctgtgggacaaaagaacctgaacagcagcccttgatctcaggtcttccctcttacagtctacccaaatgagaaggaatcagaaaaacagttctggtaatatgacaaaacaaggatatttacaccctgaagagatcataccagctcaccagcaatggatccaaaccaagaaaaaaatctcttaattgccagaaaaaggattcagaaggtcaattattaggctaaccaaggaggcatcagacaaaggtgaagtccaacttaaaaaaaatcaaaaacatgatacagggtatgaaatgaaacttcttcagtgaaatagagaacataaataaaatagaatcacaacttctggaaatcaaggacacattcagagaaatgcaaaatgccctggaaagtctcagcaatagaatcaaacaagcagaagaaagaacttcagagcttgaagactaggtttttgaattaacctaatccgtcaaagacaaagaaaaaagaatttaaaaaatgaacaaaacctccgagaaatttggactatgttaaatgtccaaacctaagaataattggtgttcccgaggaagaagaggaatctaaaagtttggaaaacatatttgagggaataattgaggaaaactttccagccttgctagagatctagacatgcaaatacaagaagctcaaagaacatgtgggaaattaatcacaaaaatgtcatcacctgggcacatagtcctcaggttatctaaagtcaaaagcgaaggaaggaatctttttattattattattattattattattattattattattatactttaagttctagggtacatgtgaacaacgtgcaggtttgttatataggtaaacctgtgccatggtggtttgctgtacccatcaactcgtcatttacattaggtatttctcctaatgctatccctcccccagcccctaaccccctgacaggccccagtgtgtgatgttcccagccctgtgtccatgtgttctcattgtttgactcccacctgtgagtgagaacatgcggtgtttgcttttctgtgcttgtgatagtttgcttggaatgatggtttccagcttcatccatgtccctgcaaaggacatgaactcatccttttttatggctgcatagtattctatggtgtatatgtgccacattttctttatccagtctataattgttggacatttgggttggttccaagtctttgctattgtgaatagtgccgtaataaatatacgtgtgcatgtgtccatatagtagcatgatttataatcatttgggtatatgcacagtaatgggatcactgggtcaaatggtatttctagttctagatccttgaggaatcgccacactgtcttccacaatggttgaactaacttacactcccaccaacagtgtaaaagcattcctatttctccacatcctctccagcttctgttgtttcctgactttttaatgattgccattctaactggcatgagatggcatctcattgtggttttgatttgcatttctctgatgaccagtgatgatgagcattttttcgtgtgtctgttggctgcataaatgtcttcttttgagaagtgtctgttcatatcctttgcccactttttgatggagttttgattttttcttgtaaatttgtttaagttctttgtagattctggatattagctctttgtcagatgggtatattgcaaagagtttctcccattctgtaggttgcgtgtttactctgatgacagtttcttttgctgtgcagaagctctttagtttaattagatcccatttgtctattttggcttttattgccattgcttttgatgttttagtcatgaagtctttgcccatgcctatgtcctgaatggtattgcctaggttttcttctagggtttttatggtgtgaggtcttacatttaagtctttaatctgtcttgacttaatttttgtataaggtgtaaggaagggatccagtttcagctttctacatatggatagccagtttccccagcaccatttattaaatagggaatcctttccccattgcttgtttttgtcagttttgtcaaagatcagatggttgtagatgtgtggtgttatttctgtggcctctgttctgttccattggtctatatctctgttttggtaccagtaccatgctgttttggttactgtagccttgtagtatagtttgaagtcaggtagcatgatacctccagctttgttctttttgcttaggattgtcttggctatgtgggctcacttttggttccatatgaactttaaagtagttttttccaattttgtgaagaaagtcagtggtagcttgatggggatagcattgaatctaaattaataaattaccttaggcagtatggccattttcacgatattgaaggaaagaatcttaagagctgtgaggcaaaagcatcaggtaacctataaaggaaaacctatcagattaacagatttctcagcagaaaccatagaagggattggggtcctatctttagcccccttcatcaaaataattatcagtcaagaattttgtggccgggcatggtggagactcacgcctgtaatcccagcactttgagggctgaggcgggtggatcacctgaggtcaggagtttgagaccagcctggtcaacatggtgaaaccctgtctgtactaaaaatacaaaaattagccggacatggtggtgggcgcctgtaatcacagctacttgggaggctgaggtgggagaattgcttgaatctgggaggcagaggttgcagtgagctgagatcatgacattacactccagcctgggcgaaaagagcaaaactccatccccccccgccaaaaaaaaagttttgtgtccagcaaaactacgcttcataaatgaaggaaagacacaatcttttccagacaagcaaacactgacagaattttccattaccaagccagcactgtaagaactgctagacggagcactaaatcttgagacaaatcctcaaaatataccagaatagcatctccttaaagcataaatctcacaggacctatataacaataacacaattaaaaaacaaaacaaaacaaggtattcaggcaacaaaaagcatgatgaatagaatagtacctcacatttcaatatcaacattgaatgtaaatggcctaaaatgctccgcttaaaagatacagaatggcagaatggataagaattcaccaaccaattctgctaccttcagtagactcacctaacatatgaggactcacgtaaacttaaggtaaaggggggcgggaagaagatattccctgcaaatggacactaaaagtgagcagaagtagctattcttctaccagacaaaacaaactttaaagcaacatcagttaaaaaagacaaagaacactatataatgataaaagaactagtccaacaagaaaatatcacaattctaaatatacatgcatctaacactggagctcccaaatttataaaacaattactactatacctaagaaatgagctagacagcaacaccataatagtgggggactctaacactccactgacagcactagacaggtcatcaagacagaaagtcaacagagaaacaatggacttaaactataccctacagcaaattgactcaacagatatatttatagaacattctacccaacaactgtagaatatacattctattcatcagcacatggaacattctccaagatagataatatgataggccacaaaacaagtctcagcaaatttaagaaaatctaaatttcatcaagtactctctcagactacagtggaataaaattggaaatcaactccaaaaggaaccttcaaaaccatgcaaatatatggaaattaaataacctgatcctgaatgattgttgggtcaacaatgaaatcaagatgggaattaaaaaagtctttgaactgaatgataatagtgacaaaacctatcaaaacctctgggatatagcaaaagcagtgctaagaggaaagttcatagcattaaatgcctacatcaacaagtctaaaagagcacaattagacaatctgtgtccggaattggtgggttcttggtctcactgacttcaagaatgaagccacggaccctcacagtgagtgttacagttcttaaaggcagtgtgtccggagtttgttccttctgctgttcagatgtgttcagagtttcttccttctggtgggtttgtggtctcactggcttcagcagtgaagctgcagacctttgcggtgagtgttacagctcataaaggcagtgtggacccaaagagagagcagcagcaagatttattgcaaagagtgaaagaacaaagcttccacagtgtggaaggggacccaagcaggttgccattgctggcttgggcagcctggttttattctcttatctggccctacccacatcctgctgattggtccattttacagagagccgattagtctgttttacagagagctgattggtccattttgacagggtgctgattggtgcatttacaatccctgagctagacacaaaagtgctccaagtccccactagattagctagacacagagtactcattggtgtatttacaaaccttgagctagacacagggtgctgattggtgcatttacaaaccttgagctagatacagagtgctgattggtgtatttacaatcccttagctagacataaaggttctccaagttcccaccagatcagctagacacagagcgctgattggtgcatccacagaccctgagctagacacagggtgctgattggtgtgtttacaaaccttgagctagatacagggtgctgattggtgtattcacaatcccctagctagacataaaggttctccaagtccccaccagactcaggagcccagctggcttcacccagtgtatcccgcactggggcacaggtgaagctgcctgccagtcctgcgccatgtgcccgcactcctcagcccttgggtggttgatgggaccgggctccgtggagcagggggcagcgctcatcagggaggctcaggccgcgcaggagcccactgcagttggttgggggggatgtgagactcaggcatggcgggctgcatgtcctgagccctgccccgtggggaggcagctaaggccaggtgagaaatcaagctcagtgccggtgggccagcactgctgggggacccggcacaccctccacagctgctggcctgggtgctaagcctctcactgcctggggtcagcggggccagccagccggccgctctgagtgcgggcccactgagcccacgcccacccggaactcgtgctggcccgcaagcaccgcacgcagccccggtttccacccgtgcctctcccaccacacctccctgcaagctgagggagccggctccggccttggccagcccagaaagaggctcccacagtgcagcggcgggctgaagggctcttcaagcacggccagagtgggcgccaaggccgaggaggcgccaagagcaagcgagggctgcgagggctgccagcatgctgtcacctctcaaatctaagttcttacctcacagagctggagaaacaaggacaattcaaacccaaacccagcagaagaaaagaaataatgataatcagagcagaactaaatgaaattgaaacaaacaacaatgtaaatacaaaagataaatgaaacagaaagctgattctttgaaaagataaataaaattgatagaccattagagagattaaccgagaagagagaagatccaaatgagctccattagaaatgaaatggggtatattacaactcataccatataaatacaaaacattattcaaggctgctatgaacacctttacatgcataaactagaaaacctagaggagatggagaaattcctggagaaataacctcctggattaaatgaggaagatataaaatctctgaacataacaataacacacagtgagattgaaatggtaatttaacaattgtcaacaaaaaaaagttcaggaccagaccgattcacagctgaattgtatcagacattcaaagaagaattggtaccaatcctattgacactattccaaaagatagagaaagaggaaatcctccctaaatcattctaggaagccagaatcaccctaataccaaaaccagggaaagacataacaaaaaaagaaaactacagaccaatatccctgatgaacacagatgcaaaatcctcaaagaaaatgctagggaaccaagtccaacaacatatcaaaaagttaatttaccatgatcaagtggtttcaaaccagggatgcagggatggtttaacatacacaagtaaataaatgtgaaacaccacacaaacaaaattaaaaacaaaaatcacatgaccttctcaatagatgcagaaaaagcatttgacaaaaatccaacattgctttatgattaaaatcctcagcaaaatcggcatagaagggacaaacgttaaggtaataaaagccatctatgacaaacccacagccaatattatactgaacagggaaaattttaaagcattccccctgagaactggaacaagacaaggatgcccactttcaccacttctactcaacatagtactggtagtcctagccagagcaatcagacaagagaaagaaataaagggcatccaaattggtaaagaggaggtcaaactgtcactgtttgctgatggtatgattgtatacctagaaaaacctaaagactcatccaaaaagctcctagaactggtaaatgtattcagcaaagtttcagaatacaaaattaatgcacacaaatcagtagctctgctgtataccaacagcgaccaagctgagaatcaaatcaagaactcaactcctttcacgatagctgcaaaaaataataataataaaatacataggaatatacctaaccaaggacttgaaagacgtctacaaggaaaattacaaaacactgctgaaagaaaacatagatgacatacaaatggaaacacatcccatgctcatggattcaatattgtgaaaatgaccatactgccaaaagcaatctataaattcattgcaattcccatcaaaacaccaccatcatttctcatagaactagaaaaaaatcctaaaattcatatggaaccaaaaaagagcccacagagccaaagcaagactaagcaaaaggaacaaaactagaggcatcacattacctgacttcaaactatactgtaaggccacagtcaccaaaacagcattatactggtataaaaattggcacatagaccagtggaacagaatagagaacccagaaattaagccagatacagtcaactgatcttgacaaagcaaataaaaacataaagtggagaaaggataccctactcaacaaacggtgctgggataattggctagctacatgtagaagaatgaaactagatatctatctctcacctcatacaaaaatcaactcaagatggatcaaagacttaaatttaagatctgaaaccataaaaattctagaagataacatcaaaaaacccttctagacattggcttagacaagacgtcatgaccaagaacccaaaagcaaatgcaccaaaaacaaagagaaatagatgggacttaattaaactaaaaagctcctgcacagcaaaagaaataatcagcagggttaacagacaaaaatctcagaaatcaccgctaaagaacttattcatgtaaccaagtaccacctgttccccaaaaacctattgaaatcaagaaaaagaaaaaagaaaagctcatctgcaaagcttgtgaacaactttccatgttttggcggggatccttttattccagtttcaggaaacaccccacagccaagcccagcactcctcctctctcttatgtaagcgataagcaccattaatagtcctgtcagtcttgattaattctgtgtacaatgatcaagagagtattttgactttggggcaaatcaaaccatggtggactatgacacagacataagggataaacatttactaaaagtaaaaaacacacagcctggagcttgtaaggattccatagaaataaaagcatatgaagaatgaattccaactatagattttttacaaagctacatgatgattaagtgcttttgggttattctattctataatatttaatggtttctaaatctaactacttcttcgtcacaatgttgtttttaaaaagttatccattaggtctttgtgtgaacaaatgtaggccattactccactgatcagtaactaatgcaaggaaaaagttcttttttatacttttacaacgtgaactccttttgatagtactgaaacgactggccatttgcaagaatgaaactaatttaaaaagcaaagacaaaggacattgttctcaaaggtatttaataggccctgaaagtttgacttagaaaaaaaagtgtttgaaatcacaatcaatgttgcaataaagtgggacgattccaagcagctaaaaaagactttctctccgatttcagtgagaattgtcttttctcatgatagtctgaatctagtgtgtgtgtactatttttatatgcaaattagtatacgattctcttgtttgattcaacaataggtgatgtaggtaagtcgacattattatatttcaagaaagaaggcaaatgagacccagagaagttaggaaatttgttcctggtcatgcagttagtaaacagggatgcttaaacctaaaccccagtcactcaccaaatgattctcctcttcatgtaacaggctcaaggcccccactagcaggcacagtggtaagttctcaccctaaactccggaaacgcccttttagggcaccatcccggttcagagctgtttaggcaaactgtgcttaaggagggacctcctcgtacacagctgttctgcttagacatggattttcctcctccagccctttctgccatgtcatcaatacaaggtcagaaagagacactgagtcagcaatgaatatgggaattatctgcacatttagcagtggaatcctagaggcacgggaagagagagcaggtaagtggtaggatccagttttaaacttaccttcttgttgcatacattgaaagtaaacatcagaaacgtcttccaccttaaaattttgcacaataatttattgtaccaaattggttcaattccattcctctgttcattcattccattccacacatctttattgagcacctccccttggcagtaactgtgtcggtgggaagtcagatgctgtccttgccctcagatagtgcacagtcttcagatgaaggggagaggagaaaagaagcaagtgctggttaggaggtgggatgaaagcttagattttgtgattcacaaaaagccatacacttcttgtctgcagccctaccgtgtgctttgaacataggagcagcagttgatggttttgcctccatttgactgttacagatcccagcccctgtgttgtttcctcaagcatttctggaagtccctgaaatgcatctcatgtgtggtcgaaagcaagcctggtcagccttcacacagcgtctgctgtttcttccttctcactagcctgcctcttcggggttctatcatgttccactagagaccgctgcaggtgtgctagagcttggaggtgggaagtggggagggcacctctccttctcatgttgccttccactgaaaggctccaaaggtttacagagtcttaagtgaaatagcttgttcaggttgagttccaggcttttcttacccttgacctaggttggagtcaatgggggatagatcagagaaaaacctcagtgacagccactatgtgattctcaggattgctctcctcttctgaccaccctatttctccttccacagacagttttctgtctatggccacatggccctttgtaggctggttatttcccactgtcaagattctgggcaagcccgcctctgagttccatggcatacctgaaccccagcggagactagggtttacacagagagaaggtgttgttctagtgtggagtttggggagagggcactagacataccccagaggcatcattcccctcttccttgtgtgtaaaggggagcctctgaggggtctcagccctgaacacagtctttttgagggagaggtttgaaactctgttttaaaaagaacaagactatttttctttctatggtgtattagttcattctcacactactataaagaaatacctgagactgagtaatttgtaaagaaaagaggtttaattggctcgtggttctgcaggctgtacaggaagcatggctggggaggccttgggaaacttataattatggtggaaggcacagcttacatggccagagcaggaggaagagagtggggagaggtgctacacacctcacagatctgtgagaattcacttatagtcaagagaccagcaaaggagaatctgtccccttgatccaatatcctcccaccaggcccctcctccaaccttggggattattacaattcgacatgagatttgggcagggacacaaatttaaaccatattatgtggttacagataaaagatggaacacaattatgttggatgcattagtggaaaggacaacacttattcatcctgaagtgtaatcaatggaggagtaagatgatatagagtcatttcctaagctggtaagaagatgggctcagaaaagcaggagggactagaggtcttaaatgaggggtatagagaggggtacagagaagagagacaatggattaacacagaaatgtatcgaagaccttccagttttgactgtgctaattccttgcttcctctccagttgggtgttggtaaatagcagctgtgcctagaggtacttgtttgggtagcaagatattgccaaccctgcaattataatttaaaaagtttttttttttaagagaagaccacattcctatgtaggaagagcctatgtctcaaactgtgatagttggcatagtatgggaaaacatttagttagacatctaacacatacttattgattgtttcattatgtttcaggcctggtgctgaatgttctacttgtaaagataagctcacaggcttattctttattatataagcttgacatccaaagagcatgaggcaaaacaatacttagaattgttatcatccagttttaagtttcttaatggctgcaccattttatcatatttgtggccttgtgttcatttatctattcatttaacaatacagtcatgtaccacataatgacatttcaggcaatgacagaccacatatatgatcatggtctcataagactatatttgtgctgtacctttttatgtttagatacacaaatacttaccattgtgttacaattgcctatggtattcagtagagtaacatgctgcacagctttgtagtctaggagccatgagatgtaccatatagcctaggtgtgtagtgggctatgccatttaggtctgtgtaagtgcaatctatgatgtttacacaatgacatgacaaattgcctaatgatacatttctcagaatgtatctctgttgctaagcaacatatggctgcatttattcagagatagattgttgtgtgtaatatacagtgacactgggtataaaacaattaataaagacaaggagcttgacttgtggaatttacatgagagagagagagagaaaacaaagatgtcaacatccaaataaatatacacacacagcttgtgctatgaagtaaacacgagggatgatgagataaagaataggaatgcagggagtggtttttcttaataagaagtcagaacctctctgatctaagtagtagacacaggatatgtttatttgtgagaattacatatgattgtgtatcttctgtgtgtatatatcagtaaaaaggtttatttacttttacaaaaagtttgcattacaattgtatgcacacactttagagagtcaacacatcctgaggatctgttgggagaaacagccttcagcctccctcttttccctcttctggagaaaactgccttttactcttagatggatctgtttgtaacttctgtgttgatgatttggggtatgatagctttctctcctcctcttgctctggtgcacaggtgtaccctttccatcctcctcttacagatttatcttcagtttgattacagcaatattcaagacttgcatcattttgaccacagttgagctgggattatttgtaatcacatatgattacttttcttttcctgtaacattaatgaggactaagctctgattttttattttgcccaaacttctatctaaggggtctggggagtcatgtcctacaaaccataaattctcatcagatgggttttatttgactctgtatatcatgacttactttccaatctgactctggcataacaaggaagaaaataaaaaatgttttaccccaaaatatatttccttgccatgccttgaaattgccctacaaaatctcttgtgggaaaaatccacattctatagagaatcccctttcttccctcccctcccctcccctcccctccctccctccctccctcccttcctccctttctcccttcttcccttcttccctccttccttccttccttcctagctccaggagataatcaactaagagctaggcacccttttaggtcttataagaaacattttacaacccgctctctctctgaagtccgctacctaagcaattcctctgcacaataaaacttggtcttcacaatcctttgccttaaccagaacattcctttccattaatcccaggtcttcagataaactcaaccaattgccaaccagaaaatgtttaaatttacctgtagcctggaagccgccactttgagttgtcctgcctttctgaaacaaatcaatgtatttcttaaatgtatttgattgatgtctcatgccttcctaaaatgtataaaaccaagctgtaccccaacaaccttgggcacatgttctcaggctgagggctgtgtcatgggccatggtcattcatatttggctcagaataaatctcttctcatattttacagagtttgactcttcgtcaacattaataattatattgtttttgaatctaatgttattttcccatgtatgtatcccttattcaacatcaaacacttcttcagctaaatatttaaatagcatctaaataatattacttagaaagtaatagtaagcattagccacctgaaaaaaggaagttagattaataatttgcctcctaacccctcccttcatacaaactctcatccccattggttaagtagaaatgtagatttgttttacatgggtggtgatcatatgaaaataaagttaaaatgtagatcaaactatactgaattctgataaatattaatttgcccttcaacaaagaaataccagatacttacttacacttctgttttggatttcaaagtccagggagctagacctttagacaggctcttatttgcttctgtcctgatgctttcgcacaggcaggccaattagtttcttgtttcttgatctataagaataaacacaatttcccagctaaactacaggcttggccaagagggcaaggatatggccagaacttttactactgatcaatgcacagaagcccacgccagatgaaggcatagaattactcttcctatctttgtggatgtccacaaggcagaaatgcaaaggtggtttttcactccaaagtgagacaataatattttccccaagtgtataggaattttaatctgggactatgatttttaaaataaaatgtattattaaggttttataaactatttggaaagaatgaagggctggtagtaatacagaaatactaaaatgccttagtcaccattctaaaaataaaattggaatataaaagtattcaattttcagaaaaacacagaaatagtagagaaagttttctttcattttttttcgcttcctttctgaattcctttccttgagctaagaggccgtgtggattatgataccttggattattatacctgtggattattatacctcttctagaggatggtccatgcctggcagaagtatgaaatctcaaggtccaactcttagattctttcaaaaaataatagttctgcactgaaatctgccaggtactgttttagacacttttggggcacaaaggggaatgaataaaacagataagtgtctttgctcctgtggagcttatgtgagtagccgagagtacagaaaataataatcattgtcattataacaatttaaatatgtaacatattagatactggtaagtgccaagaagaagaaaaataaaaccagaatggaggatatgggagaacagggggctgcaagtgtaaatagggctgtcaaggaaggtctcgctgagaagatgctgtctaaataaagacccaaaggagataggaaacaagccacacagaggtctttggaaacaggagtgtgtccaatgaactgaaggaccagcaatgaggtgggtgaggctggagggagagggcaggaagtaagaaacaacacgaatggagtgatagaggccaggttgagtagagccttggaggccattctaaggcttttgctttctttcatagtgagatgagaaggcctgagtagagtgttttagcatacagggctaaggtttggatgaggaccagcaagggcaaaagcagaaaggcctgttagaaagctcctgctgccattcagatggagaatgaggtggcccaggcaggggaagtatagtggagacagtgaggagtggtcaggctctggatctctcttcagtaaagagctgggaagacttgctaatagattgaatctgaggaatgaacaaaaaagaggtgtcaaggatggctgcagcgtttggaacctaacatgctggaagagtggcactgccttttcttgaggaaagaagactgtgggaaaagagttagagtaggagcaggaacttagtttggacttgtaaaagtggaaatgaccattatacacccaagcagagacatcacataagctgttgggtatgtgattctagagtttacgagagacacctgggctagagatggaaatgagggaggcatcagctcatacatgattctgacaatcctgaggctgggtggatcactgagagtgagcgtggacacagaagagaagaattccaagaattccccaggggctggggttggggagaggaggaggcaccagcattgaacagtgagaggaacagacagtgaggaaggaggaaaaccaggagagggagtgtcctggaaaccagatgaggaccatgcttgaaggaggagagcatgatcaactctggcaaatgtgtctgtgtgcctatgggaaagaccctgtagagaaaggaaacttgatactgtaagaaggagaagagagaactgctgcagcaatttccacaagtaccccagagactttaggagccagaacataagcagaaggcttaaccctacctagatgcaggacagttcatccataggaataggtgaaaggaagaggaaatgggcacccatttctacgtaggatgagaagaagcttcctatgccttctatttcttagcaaaataggaagtgaggtcaacgctgggagtggggatgggttgggggggtgtcctgagtgtttgaagatggaagacaaggtgtgaagaatgggaagatgaaaggactagggaagcagagtatgatttctgggtaccactaagggctcctaaagattaatgtcatgaatttaaagtgaggctgatcagtatggctgtgtggtttgctctagttgcatttagctacacaggtccatgtacagagcaggctgagttagatgtatacagagttaatgtttctccctgaaaatagactcctgatatcttcactcacatcagaggtcaacgtataccagagtttgctattataagaaatgtgaccataactatctctgatctctttcttttcatgtatattagcactgttaaatgtgaattttctagttttaaatttcttcatgtgaatactcaccacaaaagccatgagtaagagcagcatgcttacattcagatatagctgtggtgagggaactgggctccctcgctagctaagtgtttcactctgacccaccagccttgagtgcaagattcaaagtcatgtctcagaaaattttatttgctggtagaaaggacaactgctgaattcgtacacatcagtctctctactctcgttcaagcttgccatttaccttctttgatcaagctgatccacttgtgtgccacttggcctacacaacaaaagactgaggacccagcagccttgcttcattcatatctggcatcacaaccatggttcttccttcatgtcacctattttgtgtcctacgtctttcattctcaaatcttgcccttcatctttatctcctggctatagtctcatgttgctcgactaagcagcacctgacaaggtgccataaacttgactttccttttcagtaatggattactctttccctcccaactcagtccacattcagcttccctgggtgacagtgttacccagtgcagttcaagccttgaggttggtggcccacgtggctgacccaaatgtttggcctttttgacaagtcttcctggagcctgtgaaaagaaatcatcatggtggatacctaccatggcatacattaaagaaatattagcgtaaattcttttacttcttacttttgaaagaaaggttcctgtgaggtgcagattaccattagcttggtggcataaggcagaggagatggggtgggtggctgttctggatcagtgtttctggagggacaatccttgaattctctgcaagataactgcttgggttgctcatcaaaaatagaaattcctgggtccttccccaaactacagaatcagagtctctgaaggtgggggctatgatgttgcttatttgattagtacccaaaaggtacatatagtctaaagttttagggctaccagtatagagcaattgctcccaaacctggtggttcctaaaccacctactggagatggtgaaagtgcagattcaaagacttcatcccagatatattaaatcagactctggtgtggcctgggattctgaatttaaaaaatataataacaataacaataatcacaataataattataacgattctgatgatcagccaggttggaaatgtaaagcatcccttatgccaaactcttttcagctcatttgaaaaagattctttgtgctggaaaactctctcacttcataagagagcagcagctctggatgctgactgccgttcagctcctgcaaagttgcacctctgggatacatggctaaactgagggcttgccagctttgctcttttaaagctaggtctcccaaacctagtcgcatcacctgggggagatttgcaagaacatggattctgaagctcaacccacacttattgaatcatggtctctaggagtggtgtccagaatccctattttgagaagcattcagatgataattaagatgagacaaatttgggagccataagtctatgaccgtggagggaactgccaacctaacagccatttgggggtgctgcagcagctgaacggttgatgaaaacataagcatgctctcaaactactgattacatcaacttgatactttgcactgcctcttacctaaaaactcagtgaacatattctgcagacttcttcttttcttgccttatctcctagcctccttctgtttgtctaccaatgctgccactgcctgccctctggcatggctacttccagtactctgtcaccatggtgtctggttgctggcagagacctgcctgaaactagaattgtttatttgccagaattatatacccagtctaaggctgtaggattctagcttttatagttaggcatgcatgacttcttagttgttttcaacacactaaatttaataaatataacaaaagtcttgcaaataggatctagtaaaaggctgagttaaaagaatgtttttacagaattgcagtgttattgctcttgagtgtaggcgatgaactggggttagagactggggctaggctctttgtaaggacggatgcatgtagacaactgtttgtcctcagtacacacaatgtttgaacaggaaggttagaaaagagtagcttgaaaggagtttattggttttagcccctcatataaatcattttctttgaattacttctaaataatgtactttcatagatgatagcatgaaattttcagtccagtgtgtctagaattatctcagattttgaattttaaaagtctaaatgaagtttactaaatggataaaattgccatttttttctttgaatgtgtattttatttttcttaagaaagtaaacagggtttttcagaatagttgcgttttaattacatcagtagcttaatgttaattgaagaaatattagaaattacaagaaatggaaaaacgagaattaaagttgccttttttttttgttttgggaaatgactgttgacattttggggaatagccctcttgcttttgaattcaacacccccacctcgctcaactatacgtattgttttgtaacttgtaaacacaatgatttgggggattggaagttttttgcatctagctctactgtgtctattttctcttccacctcagggcctttgcacatgtgctttcctttgcctgaaatgctttacctacctcctccaagtggctgttttcttaacatttgtgcttcaggttagaggtcacatcctcaaggaggcctttcctgacccctcaatctaaagcttcaccccattttcaaatcattcctgatcttcttttttacctccgatgtgactttcttaatagtttggtttatttgtttcctgtctgtcttctccaccacagtgcaggtgccatcagaaccagggccgtttctgtcctattctgccctattctgtcctttctgtacactcatttcctagaacagtgctagcccagagtaggggttggatagacatttgtagaatagataaggaaatgactgacagactgactactgagaggatgaatgagaccgttggcctgggagggtggaagtcagagccacagctgagaaggtgagctgagagtccatggctggccaaacagacaaagcaggatgtttaaaaatgggttgccggccgggcgtggtggctcacgcctgtaatcccagcattttgggaggccgaggcggcggatcacgaggtcaggagatcgagagcatcctggcaaacacggtgaaaccctgtctctactaaaaatacaaaaaattagctggccatggtggtgggcgcctgtagtcccagctcctcgggaggctgaggcaggagaatggcgtgaacccgggaggcggaacttgcagtgagccgagatcacgccactgcactctggcctgggtgaaagagcgagacttggtctcaaaaaaaaaaaaaaaaaaaaagggttcccttttaacaagcccagagagatcttaaaggcactgtttggaccctaacaaatggcaaatagcaaaacctgaaaaatgtttctttaatctcagatccaaaatgagagtttgatagaattcaaatgattctacaattagctcagagcttttagattcatagcctctttgtttttagttagtttgcctttttcagtttaattgtttagactgaaagtttgtaatttcttaccagttttgagtagttgactctagaataacatgagtaatttttctaaatagcattgcttgttgtgtcattgattcacctcactggcacatccttgtctctgatctaaaattgtgaaaaatgaacaatatgttgagatatgaaattatgcatgaatcttcaagctgtaaaccagctagctgacagtgaggttattactgtgagaaatgtctacaacaatacttcgctttcatgtcacataagtccttgacttgaggctgctaggaaattaattaattaaagaaacttaagtttccttaagtttcgacacctttggggaaaaaagagcagatcgttacctttactcagagataagacaattgagaaacaagtattttaatcagaagtgttggtgtgaaaaaccataataaatttgaagaattttatttaatattcagatctctcttgaaggtacacactattttacatgtggaatacataataaatttgtcattctgacaaacttttgatagaattcaaatatggaatacatgataagtttgtcataataaaatttgtctttctgcttctttcttgggtattttgtggtcattgggcagcacactgtttctttttattgcctttcctttcatgttaaatgtaaagatagaaaaatgaactcaaaggtagtagtttgtatttctctatgcttgttaaggaaatctattagtagttcacaggagcttcttagcagataggcagtgagtcagtccttagcaaattgtagaagaggtcaacctttccccattcctcttcccactaaagctgcttttctcttcccttcacctaggtctccttctccagccactactctgtggtggttgcaacctcatccatgttgaaaagcccattctgacctgtggctttcagcgctggggcctctgggaatgtccaaccagtagcacctgcagtccttggagagccgacactcaccacactgtctacagcacccttttgcacttgctcttaattatatcctaccatttattccattcgacgtatttatcataatttgtatcttgatttctaaaatttgttcatgtaatatcagtccttgggaaaggatgtaagtttcataaaagaaaactccatcttcttcatctttcatgtctcctgtaccccaaatccatgaagacttgagtctcttcccctcacggagagtatttgcttagaaaagggattaaaaacacctgtgatgggttgaggtggaaagagcttcacaagctagagatacttttaaacttgaaagctacaggaaatacatcatgttagggagattaaaaaaaagaagaatgagaaacacatacacactaatgaggtcatttacaacttaagtgactaatggaagacgtatttcattgtccaaaaatatttcctacaatagacacgttttatgacttcatggttctcgaaaataaattttcctagctttggatttaacataagccttggggttaaggagttacagtccagctgaggaaagacagcttaaaacataataacacattttgacatttctaagcgatatggcctcctttgtctttctcctttttaaattttcttgccctcttcctctctgatttttccttccttcattcctttctttctattttttccttcttttcttccctcaattaaattaaatcaaaatagtacatactagtagtaatgctattaaaatagtaatactattaaaatgacgtaaagagtttatatatgaaaatacacaattcctggtcccaacatgttcgttctcctgactccctctccacagagacaaccacttttgacgctttaacctgttccttctagcattttatgctttcaaataatatgtgaatactgctctcctttgattcatcaatttagacataatgtattgagtttctaatatagcagatgaggatttaactcccttatattaccatcctatccgcttctcctcacttattctcctggtttaattatgctccaaattttggttaagtatatactcaacgttaacattactatgcctatccaagttttattcacagctgaaaactgtaatatctgggtttccaaggatcaggccctgagacaaggattcaagcacaagcagttcatttgggaggcacaggaaacaccagtaggggaggaaggaagtgataagcggaagaaaaggcagtaatcgagggtgcgttatcaagaagtaaccactatgggtaattggagcttaattctgtgagggaaactctgggaactggtgtaaaactcataattcagtgccatcccacctgaaaggtgagggagctggggtatttgtataccagtttctatcagccacttactgaaggctgctcccaagggttgttagttccccaatacttccagcctgccatgtgcaggcagcgtggccttctgaagcttttgtgaaagtcttctgcaaagagatgccaatgctgacagttgaaagttagccaagaagacaaacttataatgcatcatgattatgttttccttctttttgtttctttcctgaaattaataactgccttttaaactttccttagtgttcttgatacttattgcaaatcttcccatacctcctaatagtttctcaacacaatgttttataaagttaatcatatcaggtaatttgccagctctaatttctttttcttagagccatccttggaggcctccattatgctctatggactgtatgcactcaaggtcttctacacagatgacaccctaggacagctgtgctgtcatctcaggaatattctttgccttctgagttggattcctttgtttcctggtctgagtgtttctctttcttggttgacttctggttggaccacatcattctgagtataatcagactcagttcagtggtagagggtctgtctcttgggtaatgctgctccccctggggctgcgtgcttctgtggtgctgctcttctagcatttcccttccctagcacctgggagagttccttcaggactctattgttttgaagctcctctgtttttttaaatttattttttattattatttttattcgtgttttcctttttcttggtttgtttcttcattttaatggaataaactttccagtgtctaagaaaaggtgactgggaaataaatttttaaaaaccttgtgtgtctgaaaatgtctttattttccccttgaactgattggctggatcaagttatatgttggaaataatttaccacttcagaattttgaaaatctttcttttctatcttccagtgttgccattaagaaatatgaagcaattcggacatcaacaccctcctatttggcctgttgttgttgtttttaaatctctggaagcttatcgaatctctttttggctctactattctgaaacgttatcgtgaaatcacttagtgtgggctgatttttgtccattgtgcagtgtgctctgtggggcaggccctttcaatctgtaaactctcatgtcctcattcctgggaaatgttcctaaattattttgttttattattattatttgctacattttctccattctcttgctggtgcttctgttattctttattttaattttttaattttttatttccctaagttttgggggaacaggtgatatttggttacatgagtaagttctttagtggtgatttgtgagactttggggtacctgtctctccagcagtacacactgaacccaattcgtagtcttttatcccccacccgcttcccacatgcttctgttattctgataatgaactttctgccctgcttctctagttgtcgtatatcctctctcttgctttgtatctctctcttttatacactttttttttctgaaaaatttcttccactttattctttaattcttctattgagcttttcattttggatagcatgcttaaatttctaaaaccttcttttggttttctgaatgtttattcttctaaagcatcttgtcagtaatatttcaaagatgcaatatttttctcttaactctaaataaaccagtgattccagttgttatcattgtgtcatattttcttctctgtgaacagtctctattttttcaagttttttttttttttctgttttgatactggcttttgtgttttgacatttttcatgttcaagactttccccagatgtctgatcatccttgatggtgtgcttatttattatttattttttattttattttattttatttttgagatggagtcttgctctgtcacccaagctggagtgcaatggcacaatctcagctcactgcaacctctgcctcctgggttcaagtgattctcctccctcagcctcctgagtagctgagattacaggcatgtgccaccacacctggccaatttttgtatttttaggagagacagggtttcaccatgttggtcaggctggtcttgaactcctgacattgtgatccacccgcctcggcctcccaaagtgctgggattacaggcgtgagccaccgcacctggccgatggtgtgcttatttttttaaattttttatttttcagacaaaatctccctctgtcgcccaggctggagtgcagtggcacaatctcggctcactgcaacccccacctcctgggttcaagcaattctcctgcctcagcctcctgaatagctgggattacaggcctgcgccaccatgcccggctaatttctttttgtattttagtagagacagggtttctccatgttggtcaggcttatcttgaactcctgacctcaggtgatccgcttgccttggcctcccaaagtgctgggattataggcatgagccaccacgcctggctggtgtgcttattttcaagggtgagaaactaaaactttgatggaagccctaaacataggagtagagcttgttgacattgaactttgttgacaggtgagctatctgagtcttttgtagggaaactcctaaagctgggttgtgttttatcaccttagcactactacttctatttaagattaggaattgtcctttccagaactccattttctctgtgattagatttggctaagagaaaaacttgtacagaatttggaaagcagaggtaaagcaggagccattactttcagaaggtcacagtaatcagggaatgtgccatctagatgcagagatgcctagtaggctgtagcctcccctcccaactactgaccccacaggccaagagtgactccaagccaccaaatgcttgactgcaatttctacagaggctgtagcttccatggacctgccataacctcctcacccactattccacttgggtggccaaacatccagtctttctgaacatttcccacatactccatccacacccatgctttaagttgttgtaggtgtttcctagagctgctgtaacaaatgacaacaaatttagtggcttaaaacaacacaaatttattctcttacagttctggagctcagtagtctaaaaccgaagtgtctcctgggagcttcaggagagaaatccacttccttactttttccagattctaaggtcacgtccatttctttggtctggctccttcttttatcttcaaagtgcatcactccaacctccagttctgtcttcacctctccttttctcactttcttcctcttgtctctgttttataaaggctgttgtgataacattgggtccacctagctaatctgggattatctccccatctcaagatccttaacataattacaccaccaaagtccctttttgccatgtaaagcaacatattcataagttctggggagcaggatgtggatttctttgggggtcactgttctgactgccacagtaggtaatgacttccttggatcctctgagtcttctcttccagattcctacttcctcagctcttcccacacttgtgcaagctctaattcctagagtaagccgcttactcccctaatacacttttagtggctctgattttctgacttaaccctgatagatacacccccaatgtcaatatctctatgtatttcctctttcagattttaccagagttattctagtttccagcctagaggataaagacttggctgccaagggtctgagggccaagataatgaaaatagtagaggggtctttgttggtcatatcaattcattgactttattttgctattttcagtttggttctacctcatttgcctgctgtaggagtccccaggacagatatcctttgcattatcgcctctagagagcatcgctccaacctctggccacgtacagaagaaggagcagaatctcaaggtcaggcaaaggggagaagctctagggatttcactgtttctaaaagggtcattatcagattctgcttttatttaccatcacctcttcttcactccatttccagaagcctgttgctatcagtttccaatgtttcagagattctatggttaaataaggttgcttctcaactgtccttcctgccatcttagaatttaccttctagagttagctaggagaggtatctcctagcgatctgcttgattgcttctaaaatttttatcgacgttatccattctttttcttcctatttttacaggtttctatttttaaattaaacatattattttgagataattctagattcacatgcagttaaaagaacgataatcattcagggaaaccacatacccttcccctaatcataacatcttgcataacatggtacaacattagaaccaggaaattgacattgatataatccactggttttattcacatttcaccagttttacatgcactcatttgtgtgtgtgcacgcgtatgtgtatgtgtgctcatgtgtgtatttacttctatgcaattttgtaatgtgaattatatatgtatatatttaaggaaaaattccctttactatataatatttgaaacatggaaaattagatgctatatcccatgtgccatcttcttctgaaagctgaatgactggaaacgtaacgaaaagtatcttgaacttgcaaacaagagcagagcatgggtaaattttatcttctttacaaccttgcccatggactgtagggtcagctaacaaggctctttgtttagctcactgtgttctaaacattctgtatccttcctcccctttaaaaaatcagcccagagaaaggcatttagcaacagaaaagagaataaacagactttttaggatcatggtgttgagttgtttctgtgccaagcttcttatccatacagaattataactgataggttattttaatcaatattggtaaaaaaaaaaagactaacagcatttaaaaagaatcacattctcttcttggagagaaaaattatattttctgatttctgcagagatgaagaattaatgaatcaacagcatgcgtaaatagagaggcgatggagatctgttttgtaatatgtagcgttcctgaatcccctataatcatagctggtagttgggcactcagataattaaattgccccaataggtcatttgcatcaaatttaatgcagtcatggaaaattcgcaatatatgtttgtactcagaatcaggtagtaggagtgagagctgtatgagactatcaaaaccaagcaacatctagtctaaaagttaacataggccaggcgcggtggctcacgcctgtaatcccagcactttgggaggccgaggagggcagatcatgaggtcaggagtttgagaccagcctgccaacatggtgaaacctcgtgtctactagaaatacaaaaattagccgggtgtggtggcgcatgcctgtaatcccagctacctgggaggctgaagcaggaaaatagcttgaacccgagaggcagaggttgcagtgagccaagatcatgctactgcactccagcctgggcaacagagcaagactctatctcaaaaaaaaaaaaagttaataaaaaaaagcagcaaaaaaaaaaaaaaaacccaacattttatgttagtcatttatatatattgtgccatattacaaaatgtatttaggtgagagaaagggatactattttttcctattctctttttagtgggctcttctgggaggttgtgtttgtgagataactgtggtttcatctgctgtatttgatcaggaacaggcaaggtaggtgacaaaggtagtgagtgtttataaacaagggataacaggaactttttttgtgtaagtgctctgtaaccttttgcttcagtctatctgtggtgctgatttagagcatgagaactatatcattataaattcagattggaaggagctctttcagttatctatcaatgcataagaaaccattccaaaatatgttggcttaaaacaaccatttattcttgctcatgaatgtatgattgactgggaaaaaaaaactagtgatgttggccaggtcagactgatcttggctgcactcagccatgcatctgcagtcagttggcagactgtctgccgactggctggtatagaaaggctgtcttcctcgtggttgcttagtctccagaaagctagcctgagctcattcatatggtggttgcaggggtctgagatagcaatggaactatgcaaagccttatgaagactaggatagcaattggtacacagtcacttctgcagcattctactggacaaaataaatcacaatgctaattcgtgttcaaagctgatcacaatggctaaaagaaaaatgctaacaaaattacccaaccaatatgttcacttggtttttttttgtacctggtaagagatttttctcttatattcttgtgcaactcttactcatccttcaagtctcagttcatgcaccgcctcctctgggaatctggcctgtcctttcttccagcagactgaaccacagtatttttttgcgggggagaggaagatagtgtcttactttgtctcccaggctggagtgcagtggcatgatcatggctcattgcagccttgacctcctgggttcaggtgatcctcccacctcagcctcccagatagctaggactacaggcatgaaccaccatgccccactaattttttgtatttttttagtagagacagggttcgccatgttgcccaggctggccttgaactcctgggatcaagtgatctgcccacctccgcctcccaaagtgctgagattacaggcaggagccatggtgtccagtctaggacagtctttttttttgtgtcaccagcaactgtgtttctattgtctgtttacagttctcaattccttgagggcaggaatcaactcatataaccgtttctatatctccagttcctagcacagtgcttggctcaacaaatatcttctgaataagtgagatgatggccatttctccagttcttttatctccccagttcatattctcttgatgctgtcaccttgagaagactttgtccctcctgttaatttctcttccttaaagccttaacaaattgcactatttgttaagttgtaatcaatgcaccaatgaaactatattccatattttgcagctagagttttgagcttttgtgatgtttactaattgcaatgtagcattgttgctttaactgttctgttttggggtggcttccttttatatcctttttttggtacagttgcaagtgcctaggttcctagcatttacaaacacagaaatgtttatggtcaaatgttcaaaactccccggtagttctgtaagacatagctcttaaagtgcttttctttaactggcaatttgatgccatgggaagttgttacatagttgtggaggcctgtaatgagatttttttttttttttttttttttggtaacagacccctctgtttctgagcatttacctcttatttcatgttattgcttacagatgtaagtactatagaatgaatgccattagttaagactctctggggttgagaagagagataatacctaattcaatataatctcattgcatataaatgacaatggaggcccatggaggcaaagtaacatatccgaagtcacatgttgactttacggttttagaaacaggatttgtacagttagaatagttcagaaacatggtagacaagcttgctgcccagcaagatagtattttccccctggttaagccaggtgaagctccacgtgatatgagccctttcttaacagagattcctctttgaaaatgcaccatttaccttccaggtggccgagtgtagagggcagtacctctttggctggactaggagtccatgtgcctatgtttggtccacttgggttagaattatctggctaaatgcagattactgggcactaagacctcttgaagtcttggagatttcgatagaaatctggttgtgtttttttttttaattttttaatttttttattttttagcaagtactcagttgattctgatgcacctggaagtcagaataagagaatataatataatgttaggcaatgaaaagtgctatggagaaaaataaattaatttgagggatgatactatttggatggattagttagtgggaatgactttgaccagagacctggaaagaagtagctgaccatgaaaatatctatgggaagggggaacaagagtaaacacaggctgggcgcagtggctcatgcctgtaatcccagcactttgggaggccgaggcagatggatcacctgaggtcaggagttcgagatcagcctggccagcctggccaacctggcgtaaccctgtctctactaaaaatacaaaaattagccaggcatgatggtgcgtgcctgtaaccctagatactagggaggctgaggtaggagaatcacttgaacccagaaggcagaggttgcagttgtgccactgcatttcagcctgggtgacagagcaagactctgtctaaaaaaaaaagaaaaaaaagaaaaaaaaagaaaaaaaagtaaatgcagaggacctgaccagaaatgagctttgcagtttcaaggaggagaacggctttactataaaccacccagttgcctatcaatcttagaataaaatccagtctcctttccatgctctataagaccttatacaatctgatcattgtcaaggactagtcacatggccacatgtgctagtggggccagaaagagttgttggaaaatgtagtctctagctcagcaggcttctgtcaacacaggctccacactatggaaaggggagcacaaacctttggggatatcttcttcagtaagaccttagcaagatgagccaaaaactgaccactggatttggcaaaatgaagatcattaatgatttgacaaaagctgtttgaatggagtcaggggaaactgattggagtgattggtaacttttagagacttcctattatatatgagtgaatagcatgttggctagaaggatgcgggctctgggagatctttttctaaattggaggttttatagcatctttgaaagctattaggattgatcaagcttggagggagaaattgacattgtaggagacaggaaagaacaaacattttgagaagggaagagcagaaggaatccaatgcaccaagggagttgttggccctagaaagcatcagggacagtccatcctttctaacaagggagggcaagtccagagggcttataaggggaggagtcatgatcctagtcaattcttcttcaaagcctgttttacaaatttgcccaaggccagctgtgttcaggaaaaagggatttcattatttttctcctcctcctcctatcccttctcttcccattgtgtgccatatggtcctttgctctcagaacccgtagttctagctaataccatgtattcattcagcaagctttttgtgcacccactccaaaaaatgtgatgtccccaaatgtatggtgtagcatctgggttacggcttcttaccatcagtgagaagacattctctttttttacccttgatagagtagttatcagagttcctgggagagctgatgattttgactagctggctacattcctgggtctgagcctagaaggggtgtcctctctgatgattgggtggcctcaggagatgatgtggaaaggggatttgccctgtcagctagatgagctaaaacaccccagagataaaagagtgacaaaggtcatagtcagatctctctcaatgcccaggctatcatcaggttaatgcttttatgtcatttaaccagaatattcctttaaagactggttatcttgctagacattggcaattgattttatgaatgtgggagggagcattctttttaatatttttttcttttatctgcccaggattttcttaagtcaactttatttcgtaccattctttgatgcataactaagaagctggaaggtacccagaggggaatttttatgaaaaatagaaactcaaataggatacccagctcattgaagagtttgagttactgatgaataacttagtatgtaccaagtaaaaacctgatgctagaagacatggccagcaaagagaatacttgagtatgcttgcaaatatacaattaagtaggcttgtgtgagatggaggctttaagtaattcctgtggtaaaatatgttgtgagtttcacacaaggggctttaaaccaaagtcctgaaatacaaatcacttgagagtaagtatgcttgattgtctaattgtccttattaccaatatgtaagattattaacagaaatatatgaaggattcagggtagggtgaaaggataatgaggaaaggacgacaacaccagggctaaggttggtacagacaaatatatgacaagtgctgagagtactgaaactatatggaatatctgggtatatattatatggccagcagacacacggaaacatatttacccctggagagagtaactgtcagggctcccaggacagctgatggcatttgctcatttggtcacattcctgggtctgggcttgggaggaggggtatcctttttcttgaatgggcgggctcaagggatgatgtagaaaggagattcccactcattcattcggtagctttatactgactgaaaaatttaattgtgtgttctaaaatacaaaggtacagccaaagaacaagaggaatcccagaattttcataggtatgctcctcgagatgttctgtgcaattgaaatttaggctgctaactatattttaaacctgtctataaagatttatagttttcctgatctaattagattgtaggtcaaatgctgctgaatatctgtcaaagctatgtcagagatcaagtgcctataattttcaagaagtgactgagaaagaaactgttacttccagtcatgactgctgcatgttcctctgttctcgcccagtctggtgacagttctagtttcctcctgctgatgagttgggcctttttcctggactgtgatgacccccaggaaatggagaggtgtcttacatgatgggcatggcaagtgagaagcacctggctccccctgacggagggcatcactgggccatacagacattgggatattgccttggcatctctgatgcaggaaacatgtgctcaggcactaaacagcacacatgtgaatctgttccctggcacacgcttaatgtcattcgtagtagaaccaaatcactcagctgaaagtggtggcttttcttttatctcttattgctatttttccccctgtttgctggctgagaggaaagtagagcaatactgtgtacatttgataaaccaacacttttattcttttattgttttttcttttggtgtttctaattctgcctgaatctacaggagaaaggcacagctaatggatttgtttttgacagcactctatttcaagaagctgatatcctttggttgaaataaagtattaatatggtatgcaatatattttatcttccttcaatatatgaagtttctgaggctgtcttcaaagttgcaagttccctagaattggcacatagattagaagtgactgatggctcactttaaatatataggaagaaatacccacagtgataaggtgactgtgggaagctgagtgcccaagatgcattacttgtaacactcctcatcctaatccccaaagcactcaggacaggctttcttctcagtgcaggagcttacacggggacttatggcagaagagagtcagcagctttccaacgcgcattgtcttaaaaactttcatatccagcctactgggctgtgtgaacaagaaagctcactcatcagcaatttcacctctgaattctttcaaatgaccttaggcattctttcctaacataacctgtagttaaactccaaagtaatgagatttaaaattaggcttagagaaaagattgtcttgtgaggagcagcaaagaaaagaccaaattaacctattattgaatggttgagtattctcatggagcagtaatatttggcccaattcatagcataattttaactaaatccgtgggtgtcatggcatatacatagaagatacataaaaggtaggttgctgcaccaggcctgtgtttaagaagactgccttaattcaatttaaagaaatagtttaagagtagcagttgttttgttttctttgttttgtttcaccatgtcatctcagaaaatggaagtacttcctctcaagacactgaacaggagtgagatacgtggctgaaacaaaggctttcacatcccctccccacaaggtcctttgggctccagggctgatgagccattggccatttctagtgttagctctgcctcagttctattcctgggcctgttaggagcagcagggctgagtgctattaatcaggtaagcaagaagccagaatcaacacagaccacaaaagattaccattttgtgaagacaagattcagtggattccaacccagaagattctgatggttgccattcatcagccatacacctactcttttccttgctaacagaacactgattttattccctttcttctaagcagccatgtgtttgaggggaggctcagcttcttccctgaacctaagagtgaaacttgctttgtctaaaccacattgttaatgtgtgggctggcagtgtcaacatcaacctggaaacctgttaaaaatgcagattcttaggtcccatcccagactgctgaatcagaaattccagggaagaggaccaggcgtctgttttaacaagtcttctgtgtgattctgatgccagctgaagtttgagaaccatcggtctaaaccaaacatggaggccatgcccccagcgatgtgatggctttaagtgggggtatatgatgcatttctggttgatgagatgtgaggggaagctgaggcttcttaaaagagacagaagacaggtatgttcctcttttcccttgcttctggaggttgatgtgtaaggacacaatgccctctgcaaccagagagcttatgatttttacaaccagagaacttacgatttttatgaacaagaggtattagtaaagaggtttgacaaagagttatgtctttgaaatgataaaatgttaaaaataaaaagagagcagaggttagatgtagtttatgtgaataatttatttggaatattctggctaagtgagatcttgtttagctacctgccctctgcaggtatgcctcaattggcccagaacctcactcatgggatgtcaccttgaggtcaggcactggccacaggaatggggccatccactctgtgcagatcccttgccaaacactctgtctctcacaggagcattttcccaggatggtgaggaatggttaggcttatatgtcactcagctcacccatgctaagacaaagagggcccccagagttgggtttgtagctgcccaatggccactgctcagaccaagagcagtgtttgcagagctcagctatttctcatcaaggattatttgcagttctttccaggcttatgagaagtctcattgtgaactctgcagaagggagtcacaatatttgatatttagttacaaaggctcacagtagaaaatgtgacctttcgttctgttttattttcttaactgagccctaaagcacaagaagtgttggttgctgagagttaggctagggactttgacttcctatccatctaagttagagttaactttgtaatggttggtccgatttcatacaacctcctttccatcctccagtcttctgtaacatcaaaatctcaaagcatttcctgatttggcctttgggcttaggtaatataccgtataaagcaggcagactgattttgtttcttttcatttttaataccaattgcccagataaaaaggaaacttcagtgaattttattgcaacagcagaatgtggagattaattagcaggctccctctcttttccctgccgagttgactatgtgggtgacacgtgggctccctctctccactctcactgatttagggagcattcagcccattagttggagggcctttcagcaacacggcctatctgtcccagtgtgactatttataggctactttgttccaacaaaccgctttcattctagctccttcatctgaaattgttggtagtgaactatttccattatccaagagggtgctatgagccggatcttattttcaatttgaggtcattaatatcattaggttgaagtgatttaatgtggcacagtagggatgaatgcactacagatgttactgtcatggaagcaaattgggcacagactcaaggcgtaagatagaactgctgtagactgtggtgttcaaaataatgcatgtaacatttattccaaaccagatgtggccccagtcagagtccctgctgtttcctgaattgagtttagtaagctggcattaaggtttttcctgctttgacccgagcctctctcctgctccatcttcctcttacactctcttttaccactccctcggaatgccccacactgcctgctgtggtctgcatttgcccagtacttcatgtatccatgtctctgttcatgccctaccctgacttgaaatgtccttgttttatctgtctaacaatgggctcatgtgtcctccgacaatattctactcacttttcaaggtccagagtaaatatcacctcctccatgcagccttctctggtttcctctcactcagaatgaatctctccttggcacccacacaaactcgccaagcagattacctgcacttcttttagcatgtatgtcattttgccctatattgtggttagctgtttttatgtctgtctttctcatgtgactgtgtaagctgcttaaggggaaaatgggtcttatttattttgaaatgtttcttctgttcctagcacctggagcagcgcccagagtgcggtaggtgttcagtaaatatatgcttaataaatggaagactattatgatttttcttccacattagattctccctagaaaaaggcagaaaaaaagcagccatagtttgactgcagagtttgaataatttcagagaaattgtttgtttctttaggttttttgtggattaattttaaattaacaaatgaaaaagtgttatgttttcagcacctaattgtattcctgatttaatcttaaatataagacaatgctcccagaaatctggcctttctcttctataatatttttttcacttcttttcaaacacaatgttgttccacattttgattaaaaagaaatatatttgactgaaagaatggcactatcccgttcagctatctcttaggaaacgcctgaaggatgatgtggcccagcatttatggctgatgccactttacacagaacactcaggactgccctccctccccagggtcactgtgcagtgcttttaatggaggaggtggtttcctatttcatgatatcctcaggcaggacagcttagccccaccaatgtgagtggatgctcactgtctcctcaggcatcgtcttctgttttatgctaaaagcagcgttgaatcagcccattccactgaagacttaccagtgggccactagattttgagatatttttgcccacttgagagaaaatgtagcttaagtattttttttaccccatgtgtgctgaatatttttaatttactcctccagatatacttcctaccatttttctactctgctttgtgccccaggaggctgtcctgtgcttctttggtctctggcttctagttgggttcagcccattggcaggagattggaggaaggtagggagggagttgggtatttattctctgagcttcttcctgtgggctggctatgtccctccattgaaggttacagtttctgtggtggccccggccacagagctctctatgtgtctgggttctggtgaccactccttccaattgcccctttaggctgagaggtggtaacagacccagccattactaggcctcagctatctcatgttttagggatacttttacttcccttcagggacattcccattataccttgtcaatagtctttgtgttaaactttcctcatgacccatgagtgtaccatcattttcctgccaggacttgattgaatcacagtgtcatatcagacacacctggagtgtcctagatttggttttgtttttaaatctccttctccttgtgaaaaacttgtgctccagactttagtgagacaagaattgggtagtaagtgaggaaaggaacaaaattcatggggctttctgcttagcaacttcctttatcaattcttctgggaagcatctcaatgttaataaaaacccaaacaaaatttctcctttaaaaagagaattttataataaaaaggaactggagaacctgaaaatgggaaagaaccttggaaattgtctggggagggatccggggtgctttgcctgttctatgtccagagccctactctgaggacagcttctaccctacaatatctttacacaataaagaagtttgaagcaggttccttttgatagatctaaaacttttactagtcatcatggagcactttcactatagggagcacacttttctttataatgtatccccatgatcacagggagttggattcaggattgatgccttacacaaagactgccttccatccatggtggctgcttatgagagtcatagtttactgggggatatcacatggatggtgactggctggtgcagtctcagaaaggacctgtcaatcctttctcttggggaatttgaataggagttgtacagttattaagcctgtagacctgggagcagcggaagaagggaccaagtagctgaatcactgtgacagaataacaacagaataggaaagagaagacattatctatggagggagaccaccagaagcagtctgctacagcatacatccttaatgactttccaacttattctcaagcaggtcctttccttgcaataaccctaggcagcattaggcttaactaacttcaagtacagaagaaagagagtctctcttttctaataaaattcccaggattgagtctttttggactggttagagtcacatgaccaaccctgagctaatcactgtgacttgggaaatggaacactctcattgatggagctgggtcacatatacacacccagagcctgggaggagcgtctatcttacctgaacaatggaatgctattttcagaagaaaggagaagcctggacaggccaaaagaacagactgggtcattttagcacatttcagtttcttactacctgaaagatcctgcctaacataactaccattcagaaaagcaaatcctcttttttctatcatgtactgtcatctagtcctatgggcacaatttgaatactttcagggacagcttactaaacctccaggtgggctgcctgatatgctgttgaacagcccacaccgtagcaagtccctcattcatatgcatccacctgcctgctgccaattctccttggtcctgttctgtcctatgcaacaacactcccaaatgtcctccctcctccacatgacagccttttgaattttatgacagttaagaattaagaatgattacagggaaattaaaatcgggcaatcatttgctggaaagaacatatttttctcatttacctacatgcaacgttaaataactcactcctactcaattaaaagccccaagccaaaaacattaggactccaagtgctctctctccccttcccccacatggaagattttataacagacaactatattgctataaataatgtgccttgctgttgagtgagccagcactgggcctaaataatgactttagctgtagaatggcaaatccccctctgcatgcagaacataacagacaatccagtctgatgagcagggaaatggaacgattcggcttccaattggtctttgtttaatgttgtctctctttcaaatgtcacttaaagtgtcacaaattgactaattgatctgtaaatgaacctagcaacatttagagtttaaacctttgaacacctttgggatctagtgactcaatgctgtagaagcaaaccatttcaacaccctggcagctaggagttttgcctgaggttaatgagaagattccagtggtaagaagacagtggcccagccattatctctgggcaccttgttctctgccctgacccccttaaggggtcctgactctcaaggagacttcctaatctgataaagtgagattcctttcaactcagaagagttgactattaattagggatataaaatgttctttctatcaagtcaacctgggaagcctgagatcaaaagtcacatcactaaccctcagctcactgggagctttccacaccctgcaaatgtctgccagcgggcagcaaaaggagatatttctttttgttttggactgtcctcatgttgtctaaagctcttagttctgctaagggctgggagaaacaaacactcctgaacttgctgtttcaaggtaacccatccattaccgaaacaggagcgttgctagtttaaagttccaagtccctaacatagctgacttttatgccattgcctaggttttgttgctttcctctgagttgttccttgcccatctggacctgtgtgtcctaaagctgtcctgccttgtctttgggacactctgctgtgcccagtatctttaactaaaaaccttgcactgctcagtatcagctctcgctctgtgacctccatgatgctctggaggtcctgtttatgccttgactgctttgtcgccccatcccacaatgtgggcaactcggtgaggctgcctctgcagccattctccactattgctgctctgccatctctgcgtgccatccagacccagtgttatgcccaacggggaacgtttctggatgcccctggactctccctcacccttgttagggatgtctagtatctcagccttgtaatgcaggatactcagacttttctcaagaaccccccagcaactaaacgcattgttctttctgatcctgccttgaaacttctgtctaggacttcccagacctctgacctctttctacagcagcttgtaatgaagtctgcattcagacctccaacctttgcttctgacgtgtaaaggaaatctggggcctttaaaaaaataaaccttctctcttagcaaaccatgttctgttgtgttttttaaaaacagttttattaaggtataatttatataccataaaattcactcaaaataaatgtacaattcagtgattttagtaaacttatggaattgtgaaacaataaacaaaatcagttttatgatattctcctatcctcaaaaagttcgctcattcctgtttgcagttaatccctgttcccactcccagccccagcaaccactaatctgttttctgtctctataaatgtgctatttctagacatgtcataaaaatagaattataaaatatatagtctttttttgtctagctcctttcacttagcataatgtttctgaggatgattcatgtagttgcatgtatcagcagttcattccttttaatcctgaatagagttccataaatacaacacattttgcttttccatttgccatttgatggactttggataatttcctggtttggttattataaatgttgttgtgacattcatgtatatgtctttatgtggacacacattttcatatctagaagtgcagttacttggttgaatgatatacttgtatttaagtgtttaaggacttgccaaactacttttcctagtggctgtaccactttacattctcaccaggaagcatgaaagttccagtttctccacattttcactaattcctcgtactaaaaaaaaattattatagccattctagtaagtgtatagaggtgtctcattgtggttttcatttgcatttccttaatgactaatgaggttgaaaatcttttcatgtactcattggccattcacttattctctttggtaaaatgtctactaaaatctttcatccagtttttttagttgggttacatatcttctttctattgagttattagtattctccatgcattctgaatacaggtcctttatcaagcataggatttgaaactatggcttgtcttttcatttacttaatgatatcttaagtaattgttttacttaaagtaaaataatttttatttttaggaagttcaattaacctttttttcttttatatattttcttttattggtgtcatagctttgccaaagccaagatcataaagaattctcctgtgtttccttctagatgatttagagttttaactcttaactttaggtctgtgatccattttgagtttatttttgtgtgcagtttgagggaagggcctaagtaatttttttctcacatatggatatccaattgtcctagcactattttttgaaacgattatgctttctcaattgaattgtcttggcatcattgtcaaaagttaaggttatagtccataaatgtaagaaattattactaagtctcagttctctcctattaatctatatacttatcctttgccaataccacactctgttggtgactatagctttggagtaagttttaaaattagatcatgtaagttctctttgttcttcttcaaattgttttggctatttaagttccttgcatttccatacacattttcaaatcagcttgttaatttttacaaaagcagttgctgggattttgatagggattgtattgaatttctagatcaatttggggagaatttgccatcttgacaatattgactatgccagttcaggaatatgaacattatttagatctttaattgctcagtaacgttttgtagtaatcagtatgcaaaatttgtacttctttttaaaaatttatttctttgtatttgattcattttgatgtttttatgacaaaaatctttcttaattttgtttttggctgttcattgctagtatatagaaatattgatcttatattctgtgatcttgttaaattcatttattctagtagtttttttgatgaataccttgagactttctacataacagattatgtcatctatgaataaaaacagttttacttctccctttcaagtctgggcatctttaatttccttttatttattttttattgcattagctaaaacatcctttacagtgttgaaaagaagtggcaaagtggcattgttccctgtcttaggggaaaaacatttagtcttttttaccatttagtatgatgtgagctgtggatttttcatggagacactctttcaggttaaggaagttctcctctagtttttgcttgggaaagttttatcatgaataggtgttagattttgataagtgtttttttcttcatctattgagctgattatgcattcttttcctcttattctattaatctggcaccttacactaactgtattttgggtgtaaaaccaaactacagaccacttagttatggcctataatccttttacaagtcgctggatttgatttgctcatattttgttaaggatttttacatttatgttcatgagtgatatcaatctgtagtttcttcttttttggtatctttgtgttgttttggtatcaaaataataccttaaagaagaggtgagaattgttccttcttctgttttccaaaagagtttgtaaaggattgttactatattgtcttaaaatatttaagaaaactcactggtgaattctgagcctgggcttttctttgtggaaatatttaaaattaagactcaatttcttcacttgttatagatctatttagattttctcttcttgagtcagttttggtaatttgtgttgttttaggtattcatttcatctaagttgtctattttttgttgtgaagttgttcatattttcttatatattttttaattctgtagggtcagaagttatatcccccttttaatttctgatttgggtaatttgttttcagtcagtctagctaagttttgttaactgtgttggtaattcataaaaccaacttttgattttatggattttatcttattttcccatttcattgatttctactctaatcttcattaattcttttcttttacttggattttgtttacttttcactttcttttttagtttcttaaggtgacagcttaaggtgacagcttaggttattgatttgatactttctgatataggtgtttaaagctctcagttttcctcagaatgctgccttagctgcttcccataaattattaaaattttattttcattcagttcaaaatatttttaaatttcctctgttatttctttgttgaaccaatggtttatttagaatagtcctatttaatttccaaatgtttgaaaatttcctagtttattctctggtttagatttctaacttaatttcattgtgtttgaagaatatatttttatagcatgaacccttttaatatagtaagacttgttttctggcctagcatatggtccatcttggagaatatttcatatataattgaaaagaatgtgtgttctgcagtcattgggtatggagctctattaagttttccttcagaatccaccagggattgttttaggatctcctggtgctcatatcacttatataaattagtgtagtatttgcatacatcttatgcatgtcctcccatatactttaaatcatctttagattacttataatacctaatacaatgtaaatgatatgtaaatagttgcattgtatttttattgttgacttgctatttttaattgttgattttttcaaatattttcaatccacagttggttgaatctgcagatagggagggccaattgcatattgctactcacatagagttgattgacagtattgctcaagtcttcaatattcttgcaattttgcaggggaggatctggttgttctatcagttactgagagtgaggcattaaaatcgccaagaagaagtgttgaattgtctatttttcctttcaagtctattgtttttgtggtattttggtgctctgtctataagtccatatatacatttataattgtcatattttactaatgtactggcagttctatttttataaaatgtccttatctttgataacattttttatcttaaaatttgttttgtttgacagtaatatagttattgcagctctcttatgtttgcatggtctatctttttacaatatttttttcaacttatatttttcgttgaatctaaggtgtgtctcttatacacagcatatagttggatcttgatttttcatgacaatctttgtcttttcatttagactatgaaggtttaatgcatttattgatatgatttaatttacgtttactgtgttgctatttattttataaatgtcttctttcttttttgtcactctgttcctctttgattcttttgtgttaaatacatattttaattagcttgttcatttttaaaaatatttctgtgagttattttcttagtgatattgttctagtgattatgatatgcactttaacttatcacaatatacttcagattaacataacttgattctgataaaatgtagaaacttcgctccaatatacttccattcattccttatcctttgtattatattttgtaatattatatatatacacacatacatacacatgtatataataatgataacaacacagtattaaaattatttattcatgcaatggtatgtcttttaatagtaaactaaagcactttacattccctgcgaatcttgttttatagggaataaaaagctctttggtttaacattttcagagttatctttccatttcagtgtctgattcactttaacctcagtgaccacttagcttatttggttccccaactactatcttgagttgtccagattccaggctttctttttaatgagaaacactcaattcttttgaattttagtgtctttcccagctccttgaccttaccatgagtcacatgcctgtaatcttctatattcagaattgaatctgagatctgagttccagttgaattttgagccattctagtcctggaccacctaatactatgacttccagattttaatgtctacatctggggacatgatagttcaagctttcacaaacaagaaaggtattcatttaaaaacttggggtactcttgcttaggaaaatggtgaaaataataacaaacccataatttttaggggttttatcattgcttgctattttctccacaacttgcatgtttatagtttccatcctgcttccatccagctacttcttctccctaagcttccatctggctacttctacttcccaagtaggccatgtgtcattatctccccatccctgggtcaatgctgctcccaaagaggccctgattcagtgggccattccattttcaccatgagtgtggtgactggtgatcctttcatgtggattctttcatgtggacgtgattctccatacctgagccaacactgctgtccctgggaaaagggcctctgtgtggggtatgggcaggctcacctgcccttatttgatttatgggaattcttctatttacccatgctttccccaaactgactatagttaattggatggtagatcccaaaagatatgcctgtatcctaatctctaaaacctgtgaggccgggtgcagtggctcatgcctgtaatcccagcactttgggagtccgaggtgggcggatcacgaggtcaggagattgagaccatcctggccaacatggtgaaaccccatctctactaaaatacaaaaattagctgggtgtggtagctcatgcctgtagtcccagctacttgggaggctgaggcaggagaattgcttgaacccaggaggcggaggttgcagtgagtcgagattgcaccactgcactccagcctggtgacacagcgagattctgtctcaaaagacaaaaacaaaaaacaaaaaaaactgtgaatataaataatatcctaaacttttcccaaaactgaccaaccacctccccttggaatttagtgagcagattaagcttaagctttatgcctctcttcaaatcttctcctacatttgattttagctcatttttttccccattgttccagccccttcctcattcctacccctctgccaatattctgaacatctacacagaaataccatactgcattactcccattttctctccttcattactatagaactatgtaaaatcaagtagagggaagggcaaagaataaaagcaaaaaactggggacacactaatgttattagagataacgtagaaatcttaacataatgattcaatttctacatagactattcccatccagttatgtcactatcccagaggttggtttaaatcccttttttcattcaataggaattcaaaaagcacctctctgcacagctgtgtgatagattgagaaatgtcctttgctcccaaggagctcagttcacattaccttgattaactatggactaaagcttctcttttctttactagaggccaactatagagagggttaaaaagcctcagttattagaattcacaaagtcactattgcataaaattcctttaatattccatgcataattattgctgtccttagtggatcagaccactccctgcctgacttctcaacagtaatccatatcagatctatagagaatcagttacacagtgatgtgacttggtaaattcttccacatcagtcagcaaagctcagcggtcatattctggatagtctgtccccagatgcttgtttattataaagtaaactgagtctgcccagtgaaatttatcccacattactagatgtggtgaaataaacagaaaaaagtcattggtcttcccttcagaatatgtagacctacaggctccccattacagaaagcattatttcttttttctaggtatgactttctttggttccaaatgcaaaagtgatatgtactcaagcagaaaaaaaaaatacaatactaacaaaataaaggcactaaaaattgcccctaatcccagtatccacacagataactactgataatatttcggtatatagtatatctttttttctctgcagagatactttttgcctatgtcaaaacagtgttacactgtacatattattttgcgggctgctttttcagctcatagtgcatagtgaacattttcccattatattcatgttagaactggcagtagaagcatcgttcttcctttaacagattttaccttatggctggctgactctagttatctcctcctggtcttcctgctttgagtcttttacactccctggccaccctatgcctgtttacaagattgatctgcctaaaatactatttgtacccttgacccccaaccagaatccttgatacaactttttccttcattctgccccaattgcctagagggaggagttctcacctagccctttattccaggctgtcctcaacaagtccaagatgatttatgtacattgttttgcatcacttattacataaatcctttgtctaaatgagtttccatcccacatggtttgctcattattccctgatagacaactcaacctccccattgaagccgctctatctgctggtagagtcttcctctcctattctctatctttgcccaggttcttttctgcccttactgcccagatgttttctttgctttttaatttttttaaaaaaattttatgggtacatagtaggtgtatatatttatgaggtatattggatattttgatacaggcatgcaatgtgtaataatcacatcaaggtaatcaccttgagcatttatattttgtgttacaaacaatccaagtatactcttaattattttagaatgtataattaaatcattattgaccatagtcacctgcttttgctataaaatactagatcttcttcattctttctattttttttaatccattagccacccccacttcctccccaccccccattacacttcccaacctctggtaaccatcattctattctctatctccatgagttcaattgttttaattttttgatcccacaaataaatgagaacatgcaaagtttttcttcctgtgcctggtttatttcacttaacataatgacctccttgttgcaaatgatagaatctctttattttttatggccgaataaaattccattgtgtatgcgtgccacattttctttatccatctatctcttgatggacatgtaggttgcttccaatcttgactattgtgaatagtgctacaataaacgtgagagtgcagacatctcttaaatgtactgatttcctttcttttgtgtatatccctagcagtggaattgctggatcatatagtagctctatttttagttttttgagaaaccttcaaattattctccatggtagttgtactaatttacattcccaccaacagttataggggtttccttttctccacaccctctccagcatttgttattgcctatcttttggataaaagccattttaactggggtgagatgatatctcgttgttgttttgatttgcatttctctgatgatcaatgatgtagagcaccttttcatataccagtttgccatttatatgtcctctttggagaatcagatattttgtccattttcaaaatcagattattataatttttcctctaaagttggttgagcttcttatatattctggttattaatctgttgtcagatagatagtttgcaaatattttctcccagtatctcttcactttgttggctgtttactctgctatgcaaaaagctttttaacttgatgttatcccatttgtccatttttgctttggttgtctgtgtttgttggggtattactcaggaaatctttgcccagtccaatgttctggagagtttcctcaatgttttcttgtagtagtttaatagtttcaggtcttagatttaagtctttaatccattttgatttgatttttgtacacagagaaaaataacggcctaattttatttttctgcatatggatatccaattttcccagcactatctattgaaaagactgtccttttccccaatgaatgttactggtgcctttgtcaaaaataacttcactgtagatgtatggatttgtttctgggttctacattcagttccattggtatatatgtctgtttttgtgccagtacaatactgtttttgtttcaggagcatattgtttaatttccatgtgtttgtatagtttccaaaattcctcttgttgttgacttctagccttattcaattgtggtcagaaaagatacttgatattatttcagttttttgaatattttaagacttgtcttgtggcctaacatatgcgtattgtctatccttgagaatgatccatgtactggcaagaagaatgtgcattctgtagccatttgatgaagtgctctgtaaataactattaggtacacttgacctatagggcagattaaatctgttttttctttgttgatttttttgttctagatgatctgtccaatgctgaaagtggggtggtgaagtcttcagatattattttagtgctaataatgtttatttatatatctgggtgctccagtgttggttgcatgtatatttacaattattgtatcttttttctgaattgactcctttatcattatgtaatgacctttgtctctttctatagtttttgtcttgaaaagttattttgtctgatacaggtgtagctactcttgctcttttttggtttccatttgcatggagtatctttttccatcctttattattttcagtctatgtatgtctttatatatgaagtgcatttcttgcaggcaacagatgaccggggcttgcttttttttttttttttttttgagacaatgtctcactctgtcacccagactggagtgcagtggcacaatctcggctcactgcaagctctgcctcctgggttcgcgccattctcctgcctcagcctcctgattagctgggactacaggtgcctgccactacgcccagctaattttttgtattttttagtagagacgaggtttcaccgtgttagccaggatggtctcgatctcctgacctcgtgatctgtccgcctcggcctcccaaagtgctgggattacaggcgtgagccactgcgcccggccatatcttttttaatccatcgaggcactctatgtattttgactggagagtttagtccatttacactaaatgttattattaataaataagggcttactcctgccattttgctatttttttttctagtggttttgtggtcttatcttccttcttttctttttttctgtgttccttttagtgaaggtgattttctctggtggtatgttttaatttcttgctttttattttttgtgtatctgttgtatgtttttagatttgaggttaccataaggcttgcacttaatatcttataactcattattttaaactgatgacaatttaacttcgattgtataaacaaactaaaaaacaagcaaaaagaaaactaataaaactataattttgtctctctgctttgtaactttttattgtttctatttatatgccattgcgctgtcttgaaaagttctcgtagttattatttttaaccatttcatcttttcatctttctacttaagatatgagtagtttatataccacaattacagagtcataatattctgtgtacttactattaccagtgagctttgtatcttcacatggtttcttattgctcattgatatctttttcattcagacaaaaaaaaaattccttttagcatttctcgtgggacaggactgatgatgaaatctctcagcttttatttgtctggggaagtctttatttcttctgcatgtgtgaaggaaattttcatcaggtatactattttaggataaaagttttctttccatcaacactttaaatgtgtcatgccactctctctgagcctgtaaggcttctactgaaaagtgtgctgctagacatattggagctccattatatgttatttgtttcttttctcttgctgcttttagaattctttctttatttttgacctttaggagtttgattattgaaggttttgaggtagccttctttgggttaaatctgcctggtgttctatagccttcttgtacttgagtattgatatctctctctaggattgggaagttatttgttattatccctttaaatacactttccacccctatctctctatctcctttttagggcctataactcttaaatttgctcttttgaggctatcttctagatattgttggtgtgttttattcttttttattcattttcttttgtctcctttgactgtgtatttttaaatagcctgtcttctagcttattatttcttttttctgcttgatcaattctgctgttaagagactctaatgcattcttcagtatgttaactgcatttttcaactctagaatttatacttgagtattttaaattatttcaatttctttgttaaactcatctgataggattctgaattccttctctgtgttagcttgagtttcgttgagtttcctcaaaacagctatttcaaatgctctgtatgaaacgtcaaatatctgtctctctccaggattggtccctggtgccttgtttagttcatttggtgacgtcatgtttttctagatggtcttgatgcttgtaaatgttcaccagtgtctgggcattgaaaagttaggtatttatcatagtctttgcagcctgggcttgtctgtacccatccttcttgggaaggctttccaggtatttaaagagtcttaggtgttgtgatctaagtttgtggtcactgcagccatatctgcattaagggacctctcaggccaagtaacactgtagttcttatagacttgtagaagtactgccttgatggtcttgtataagatctaaaagaatactctgaattagcaggcagatactcttgttctctttccttactttctcccatacagagtctgtctctctctgtgtgagctgtgtggagctgggggaggagtgacaccagcacccccgtggctaccaccactgggattgtactcggtctgacttggagccagcacagcactgggccttgcccaaggcctgctgtaatcactaactggctattgcctatgtttggtcaagggcctcaggctgtacaatcaattggtggcaaagccaggcagttttttgtccttcctttcagggtggtggcaagttcccctgggccccaggtgggtccagagatactgtctaggagtcagggcctggagtcagataccttagaaatctaggtggcactctattctactgtgactaagctagcaacaaaaacacaagacaaagtttttccaactcttccctcccctttccccaggcagacgagtctcgccatgttcaccactaccacggccctgtgtgcaatactcccgggctaccaccagtgttcccttaagacccaggggcttttcagtctgcttgtggtgaatgctgccaggcctgggactctaccttcatagcaatgagttctcctctggctcagggtaggttcagaaatgctttccaggagccaaggcctggaattagggatgccaagagccctcttggtgctcctccccactgtcgccaagctggtacctaagctgcaagacaaaaccccttttattcttccctctccttttctcaagcagaaggaatctcttctcatagctgccacttctgtgaatatgctgggtcacacctaaagccagcatgtctcagagtcttaaccaagcccatggtgtatactacctggttactgctgctgattattcagggttcaaggactctagtcagcaggtggtgaatcctgccaggagcagttccttttcttagaggcaacaggttccatcctagcccagggtttgtctagaaatgtcatctggaagctaggtcccggaaagggggccttgcacctctgcctgctgccctatctaccatggccgagctgataccctagttttaaaacaaagttctctttactcttccctctcctctcctcaagtgaaaaaaaaaaaaacgggtctcttttggaactatgagctatgctgcttgggagtggggaaggggtggaacaagtactcccttagctgctctggcagatgtctaattaggttacacgccctccaaatccactggctctgagcacagcatagcattcagacttgcctaggaactgcaggctttatggcctagactgcctttcaagtttatttagatcccatagcactttaccccctggcagtgaggcttgccaaaaagcaagttccaactgctgggatgggtaattcccctctggctaggcctggtctaaatgctccttctgtgggcattggctgagtctgcccaatgtagctttccgctgtgacagcacagcactgggttccaatacacagttttacaattgctgcactctccctcccctaagcacacagatgctctttccatgccatgcagctgctgctgtggggtgggagaagggtggcatcggcaattcaccgctgtctttcctactctcttcactgcctttttcagcgatatgaagttaaaaccaggtactgtcatctctcagctgatgtttggttcttaggaaggtgctttttttgtgtagatagttgtcagatttggtgttcctgtggggaggatgatcaatggaggcttctattcagctatcttgctccacctcctccagatcttttctgacatcactgtagtttctctaactgccccaacccacagttgtctctccctcttcctctaaagtgtgtatcagctattgcacttattctgacgtgtagaatatacagctagtcatccatgaatatctgtgtactccccaggtaagaagtgagtcccatgaaaagggctgaattttccaccttttttcccttaccaaggtatagaatttgtcacccaagcaacaaaaaatgcatatggatgttggcgatgacaaatattaatagctgatttaaggatagatgatacacaaagaggaaaaaacaaatggacaaatagaaaacaaaagcatggggtaactgatacataccttgaaaaatcctcaactacacacatgaacaacaacaatatcaattacaacaaccacaaaactatgcatgggaaataaacaccaaaaccaagaagacattgaaaatctggattacttaatgacattttctccttctctcttccatgtatccctgttcctgccctgctctgtaaccaagtttcacacatggttaagagaaattacctatgctttctcaatttttccattaggaacttgtgacacccttataataaaatacttatttcatttgacttacaagagtaattacatggacattgtaaaaaccagaaaatacagtacttggagcataaggtaagaacttttttttttcttttaactaggaaatttatttgacaaaatcttaatgacagatttgaaggttttaaataaaaaaataactatctctgtgatgtagtcaaaagtgtctttgaatatcagtcaggatacctggatgatggctcaaactctaccattaagtagttttgtggaaagttatttaacatttcctgggtttttgttttacagatttatcgtggtataattgacaagtaaaattacgtacatttaaggtgtataacttgatgatttgacatatgcatacattgtgaaataatcaccacaaccaaggtaattaacatatttgtcatctcacatagttaccatttttcttttatttttttctggtgagaacacttaagatttaatttcttagcaaatttcaagtatacaatgcagtattgttaatttcagtcaccatgctgtctgtggatctccagaacttagcgatcttgcgtaacagaacctttgtaccctttaactaacatgtcaacattttccttgtcccaggctcctggcaaccatcattctactctctgcttctatgagttttactatttcagatttcatgtataagtgagatcagacagtacaggtatactttgaagatattatgaattcagttcacaccactagaataaagaaaatattccaataagtttgtttatttcccagtgcatataaaagttatgtttacattacactgtgttcatattaaatgtacaatagcatgtctaaaaagtaatgtacacaccttaatttaaaaatactttattgctaaaaaagtgctaatgaatatctgagcattcagtgagtaatctttttgttagtggagggtcttgctttgatgttgatggctgctgactgaccagaatggtggttgctgaaggatggggtggctgtggcaatttcttaaaataagatgacaatgaaatttgtcatatcagttgactgttcctttcatgaaagtgttctctatagcaagcaatgctatttgatagcattttactcacaatagaacttctttgaaaattggagtcaatcctctcaaactctgccactgcttgatcaaccaagcttacggaatattctgaatcatttgttgtcatttcaagaatattcacagcatctttaccaggagtagattccatcttaagaaactactttctttgctcattcataagaaacaactccttatctgttcatgtctgaccatgagttgcatcaattctgttacatcttctgcctccactattaattccagttttctttgctatttctactgtatctgtagttacttcctccactagagtcttgaacccctcaaagtcatccatgagggctggaatcaacttctttcaaaatcctgctaatgttgatatttgacatcctcctataaatcacaaatgttcttaatggcatctagaatggtgagttttttttttcaagaaggttttaagtttattttgcccacatccatcataaaatcactatgtatggcagctgtagccttatgaaatgtatttcctaaataataagacttgaaagtgaaaattactccttaatccatgggttgtggaatggatgttgtattagcaggcatgaaaacaacattaatccccttgtacatttctatcagagctcttgggtgaccaggtgcattgtcaatgagtggtaatattttgaaatatgtctttttttctaaggagtaagtctaagaagttggcttgaaaacattcagcaaaccatgttgtaaacagatgtgctgtcatccaggctttgttgttccatttagagcacaggcagagtagatttagcataattcttaaggaccctagggttttgggatagtaaatgagtattggcttcagcttaaaagtcaccagctgcattagcccctattaagagagtcagcctgtcctttgaagctttgaagaccaacatttacttctcctctctagctatgaaagtcctagatggcatcttcttacaaaagaaggctattttgtctacattgaaaacatgttgtttagtgttgttaataattatcttagctagatcttttggataagttgctgtagcttctatttagtacttactgcttcaccttgcacttttatgttatggagatggcttctttccttaaaactcatgcatcaacctctgctagctttaaacttttcatctgtagctttcccacctctcttagccttttgaattgaaaagaattatggccttgctctggattgtgctttttattaagggaatgttgtggctggtttgatcttctatccaaaccgctaaaactttttcgctatcagcaataaggctcttttgctttcttatcatttatgtgttcactagataagcacttttaatttccttcaggaatttttcctttgcattcacaacttggctgtttggcaaaagtggcctagcttttggcctgtctaggcttttgacatgccttcttcactaagcttaataatttctagcttttgatttgaagtgagagatgtgtgcctcttcctttcactgagaggccattgtagggtaattaattgggttgatttcaatattgttgtatctcagggaatagaaaggcccaaggaaaaagagggagatgagggaatagctggttggtagagcactgagaacacacacaacatttaacaattaaatttgccatcttatatgggtacagattgtggcacccaaaacaatgacagtagtaacatcaaagatcactgatgatagatcaccataacagatgtaataatagtgaaaagtttaaaatgttgtgagaattaccaaaatatgacacagagacatgaagtgagtgtatgctattggaaaaatggcaccagttgacttgctccatgcagggttgttcacaacttttcagtttataaaaaatgcagtatgtgtgaagtgcaataaagcaaaacacattaagatgaggtatgcctgtatttgttcttctgtttctagcttttttcacttagcatagtgtcctccaggttcatctgtgttgttgcaaatggtggaattttcttctgtttaagggctaaataatattctattgtatatataccacatttaaaaaaacccattcatccattgagaggcactcagattgcttccacatcttggctattgtgaatagtgctgcaacaaacacaggactgcagatatctcttcaagatgctgatttcatctcctttgggtatatacccagtagtgggattgctgggttacttagcagttctattattagcttgctgaagaacctccatatcatttttccatagttgggcgtactaatttacattcccaccaacagtgtacaagagttcccacatccttgccaatacttgttatctcttgtccttttgatggatagcaacaggtgtgaggtgatagaacatttatgttcccaaaatgcatttcattttacctgtgatgaaaagctgagggcgtctcctacattaactttctgtgatctgacaaatttaagaacttaactgttacagaatttcataggatcttggatctgccctttttacaacattcttccttcaaaaatgaatggaataaaaaagaagtgagaaaatacgcctatttataaaaatatattagatgttatgagataaagagacatgtaataatggcttttctcacccgaagaagatgaacaaatttgaacagaaacaaatagattttggcttattaacttatttcttgaaagaccttcaggttagatatttttctccatcccatcatgcgaggttagctttatgtgggaagctcctccagagtctggttcactgtagttttcaagggtgaagataaatgtttatgtaactccacctatagaatagttacttttgagtccaattagactagcttcacgaagtctattttttccccctttcctttgaaatgagataatggatgtggaagtttttaacacagtgcttgcaacatagcgggtgctcaaaaaacattttcttttttccttccctccttcatttaatttgtagtattttagatttaaattgccataaaatgagagttcgtaatgtaccattttagaaatcatcatagttcatcaattctctgaagcatatttttaaaattttgctgaaattgtgaaatcatttttaactgctgctggccaggcagctgtcatgatctggttgctaatgcctgtaagtgagcatcaaaactcgcagagtcggtgtcaccagattggaaaaaagtctcagagacaaaagttcagcatgctttcaaaaaaaaatgctacatcatcaacacaaaggatggctgggtggaaagacatggacattaataatgctcagtaaaacattcataatttcaaattctgaatgtaaacaaatttgggaatactttattttatttttttatttatttttatttattttttatttttattatacttttaagttttagggtacatgtgcacattgtgcaggttagttacatatgtatacatgtgccatgctggtgcgcttcacccactaactcatcatctagcattaggtatatctcccgatgctatccctcccccctcccaccaccccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatcccgtctatcattgttggacatttgggttggttccaagtctttgctattgtgaataatgccgcaataaacatacgggtgcatgtgtctttatagcagcatggtttatagtcctttgggtatatacccagtaatgggatggctgggtcaaatggtatttccagttctagatccctgaggagtcgccacactgacttccacaatggttgaactagtttacagtcccaccaacagtgtaaaagtgttcctatttctccacatcctctccagcacctgttgtttcctgactttctaatgattgccattctaactggtgtgagatggtatctcattgtggttttgatttgcatttctctgatggccagtgatgatgagcattttttcatttgttttttggctgcataaatgtcttcttttgagaagtgtctgttcatatcctttgcccactttctgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccattagtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacgtatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagcgttgtagtatagtttgaagtcaggtagtgtgatgcctccagctttgttcttttggcttaggattgccttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctctttaatttccttgagcagtggtttgtagttctccttgaagaggtccttcacatcccttgtaagttggattcctaggtattttattctctttgaagcaattgtgaatgggagttcactcatgatttggctctctgtctgttgttggtgtgtaagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgccagttttcaaagggaatgcctccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtacattgaaccagccttgcatcccagggataaagcccacttgatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccaattcctccttgtatctctggtagaattcggctgtgagtccatctggtcctggactctttttgattggtaagctattgattattgccacaatttcagctcctgttattgggctattcagagattcaacttcttcctggtttagtcttgggagagtgtatgtgtccaggaatttatccatttcttctagattttctagtttatttgcgtagaggtgtttgtagtattccctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgctttctgctagcttttgaatgtgtttgctcttgcttttctagttctttcaattgtgatgttagggtatcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgcagttgagcggttttgagtgagattcttaatcctgagttctagtttgattgcactatggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctgttaggtctgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgagggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcggctggtactggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagagtgttgaatattggcccccactctcttctggcttgtagggtttctgctgagagatctgctgttagtctgatgggcttccctttgagggtaacccgacccttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaagttggttccattctccccatcactttcaggtacaccaatcagacgtagatttggtcttttcacatagtcccatatttcttggaggctttgctcatttctttttattcttttttctctagacttcccctctcgcttcatttcattcatttcatcttctatcgctgataccctttcttccagttgatcgcattggctcctgaggcttctgcattcttcacgtagttctggagccttggttttcagctccatcagctcctttaagcacttctctgtattgtttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcattcctttggaggaggagaggtgctctgctttttagagtttccagtttttctgttctgttttttccccatctttgtggtttttatctacttttggtctttgatgatggtgatgtacagatgggtttttggtgtgggtgtcctttctgtttgttagttttccttctaacagacaggaccctcagctgcaggtctgttggagtaccctgccgtgtgaggtgtcagtgtgcccctgctggggggtgccttccagttaggctgctcaggggtcaggggtcagggacccacttgaggaggcagtctgcccgttctcagatctccagctgcgtgctcggagaaccactgctctcttcaaagctgtcagacagggacatgtaagtctgcagaagttactgctgtctttttgtttgtctgtgtcctgcccccagaggtggagcctacagaggcaggcaggcctccttgagctgtggtgggctccacccagtttgagcttccaggctgctttgtttacctaatcaagcctgggcaatggcgggctcccctcccccagcctcgctgctgccttgcagtttgatctcagactgctgtgctagcaatcagcgagactccgtgggcataggaccctcggagccaggtgtgggatatagtctcgtgatgcgccgttttttaagcccgtcggaaaagtgcagtattcgggtgggagtgacccgattttccaggtgcgtccgtcacccctttctttgactcagaaagggaactccctgaccccttgtgcttcccaagtgaggcaatgcctcaccctgcttcggctcgcgcacgatgcgcgcacccactgacctgcgcccacagtctggcactccctagtgagatgaacccggtacctcagatggaaatgcagaaatcacccgtcttcgtcgctcttgctgggagctgtagaccagagctgttcctattcggccatcttggctcctcccccggggaatactttaaccaatttttttctgtcgtattttctttttatatatgtacaagagtgaaactggagggaggcagcgtgagtttaaaaagattcttttgattaattgaaaataaacaagggataagaaagcattatgtcataagtgaccacatttttaatattagtgatatataaaataaatgtgtactcgggttgatattattttacagtagttgaaatataataattccacttatctttgaaaacaaattctctgtgagttaaggtctttagataaatctcttatccaaagacatggccaatatttatgccatcttgttctaacataagacaatggcaaaaattatactaatgactaataatttaggaaaaactaatgacagttgtaaaaaataaactgaccatgtgtccctgtctcctctcagtgctatgtccaggttccagacaagcttatgagaagttaactaccatgaagaggcctgaacaaaataatctgaattgtgaatttctttttttggtgggggggatgggggggtctcactttgtcactaggttgagtgcagtggcgtgactcttggctcactgcaacctctgcctcacaggctcaagtgatcctcccacctcagcctcctgggtgcctgggaccacaagtaggggccatcatgcccagctaattttttgtattttttgatagagacagggtttcaccatgttgcccaggctggtctccaactcctgagctcagtcaatccacctaagccttggcctcccaaagtgttgtgattataggtatgagccaccgcacccggtctgaatttcctatttttcacacttgcttcctgtaacactatggcaccttgccttgagcatataaagtgttatgtaaatatcagaggtctgctatatcagagtgttcaaattcaggaaataatcattagtggctgtagatatagtttaaatgttaattggaaagcacacctatcctttgattaattatgctatggtcctggacatgtggctggtagtgtgagaaaatctgtattaagcctgccttcagagtttctcagtggaggttctctggtgagcctgtttttccagggaagtaggagggtagacatctggaagtttgttctattcagcagagccttgatatttccaatatggcttctccattttactttgcctgttattcaaaatgctgtgctcatgcaaatgtgggcccatactaatttttatagctggttcaatttctcagaatataataaattgctcttcaaacccatgttttaagaatttctgatgaatagcaaacttgcatcctagaaattcttttaatcacaaatgataggcacaaaaagtggcttgccatctgtatactcacatgtttaaaattcttctaatattagcattcttttctgttttggataaacccaattttgcctggctgcataattgagtgttttctgtcccctgttggctgtggtttccaatggaatataaaccgtaaattctgagtggacccagcaaaaaatgtttggttctgactttactggcaacaaattgaatcaatcaataacttgccaggtgataggaaaaaaatttttttaagcaacaggaataaattatcgtgaagtatttgaaaatgttggtaaaagacatactcaaaagcataggtgatttagttgttctaaaatctttagtctttttaaatggaaattatttctatcacttataaaaatatcggggtttcttttaaactatattcataaagtgacatgatttaaagcccctctcataaggaagttcttgcagtggggatcactatgcacagtgggtaagaaccaagtctctggaggtaggctgcctcaagttaaattgtagtgtgcctgtgtcactttaggcaagttatttaacttctctgagtctcatgtttcttcatttgtagaatggggttgataatgataacacctttcccagagaaccacgttcttgcaccattttatctctctgaggatactgaggcttagggaggttaagcatcctgctaaatggcacacgggaaggcggggcagagtagagctgggattcacacccaactccaactgactgcacaccctaaagtcctttgagttaccatgaagactctaagatgagcatgaggagacagggcactggcataggagttatgtagcctgtgatctgttcctaaccagttctgtcaccatgacccaatatgggagacattaatgccaaagaattccacatgttacataacaaatagggaccagctgagactcaggcaaagtgtaggagtaagtcattatttggccccgtgcaatgttgcaacctccgtatcaaaaaaaaaaaaaaaaaaactaccccagggcgtccacaaaacaagaggaaatcagttttacgaagtaataaatcctctatatggtgactcttgataaaagaagtggtgattttcaagaactttattattaaataatgacaactatcgttatcattcacgctatacatcctatatacaatgtgctccaaaaaagagctccaggctgggcatagtgactcacacctataatccccgtactgtgggaggccgaggtgggcagatcaggtcaggagtttgagaccagcctggccaacatggtgaaaccctatctctactaaaaatacaaggcgtgatggtatacacctgtaatcccagcaactcaggaggctgaggcaggagaattgcctgaacccaggaggcagaggttgcagtgagccaacagcctgggtggcagagtgagactccatcttaaaaaaaaaaaaaaactcgaaatacaactttgtatataggttgcatagggtggaataataatgatagttatcatgatctaataacttttagaggcaccttcttcagtgagctccaatagtttcttgcaagcaatgatataagaactaaagtaaaaacaaactgtgtctatatctgtattaatttgttatggctgctataacaaagaaccacagactaggtggcttaaacaacagaaaattatttcctcacaattctggaggctagaagtccaagatcaaggtacttgcagcattggttttctctgaggcttttgtccttggcttatagacagtcgtcttctcctgtgccttcccatcgtcttcacatatctgtgtcctaatctcctccttctatatggacaccagtcacattgggttagggcccacccatatgacctcactttacctcagttacctctttaatgtcctatcttaaaatacaatcacattctgaggtactgggggttagggcttcaacacatgaatttggagggagcacaagccagttgaaaacaatatctatatctatatttacacccacatctatatctatgtttgtgggtcttactgaaacctgaaatgatagcagtgaagactcttcccaatcttatgatgtgacaatgaaaagatacatattccaagtctaattgacatgtggcctcttagcacaaacttattaggaatgagcgttttctcagccaagtgttatctaatttctgggctcctgagaccgactgctccattaacactgggaaggggagcacggctgggggaagccaccaatctgctggctggcagtcagaatgcccatgtggtatcagatctgaaaaggtgcactgtgggcagccagaaagagactagcactgtgagcatcctctggcctcaggtctttgattttctttgaggcatgtcctaaaggctgggacactcatctacacacaagaggtgcagacatgaatgtggggcaattatccactcctttcaagtgagctggctgtgcttaaactagaacgtgcaggattttctttctttctttttttaaggaatcaagtttatccaagaatatggcatcttcccatccacctaccttccttcctttcttcctccctcttcctttctttgttttcttatctccttctctcaattatttatagagtgagggcctgctatgcacaaggcactctgtgtggtcctatgggggataaaaaggtgactaagaggcactctgccttgcatgtttcattctaataacctactccctgttctgctgttggttgtgctttcagaaattgctctgctagttcttggcaaggctgaaagccacttcagctaacagcatccagaccttccctaccttcaagatcttctgtcctccctgtggaactgacagcactccacctcatctctgagccccccacacatctcctcaagctcagccagtgtccaaactgaagttcctggctcctgacccctctagacggatgattatccattcactctgtctcgcctcccagactgctttatttttttccttttctgagctgttccttctgattcctcccacttcttcctcttctcattttgactcctttcccaattcacattgatcatctctgatgagccggctgagtgtgaaaaaataaaggttctaatgatctggcttcctctctgcccactgttgtttatccagggagtaaagacatgcttcaagtactcctccctcagagctgagagtacaagaaggggtcccagacttatttgttcctttccccaaccctcactgattctaaaattacttctcaatcactgaacattagtcaatatgtttattttttaaagtaaagtgtgggaaggttgtggagagtgaatgatgagattctataatctgatttaaatcttatctgcaggttataaaatgttaaaattcatgtttggaatagaatgcaacacaggcacatattctccttgaaaattttattcctgcagtttaatttagttgggaagaaatggtcagaccagctatttttttaatcacgtagatagattgtgtgtcctgtccaaacctggcaacccctgggatcactgccttcttcctctcctgctaatcaaattcaacccatttttcatgtaccaggcaaagtcccactcttctaggagggtcgcctgggcacccatgagcttcttgagggcccagcctctgtttcagccatctttgtggcccagcaacaagcaaagtcagggacttggtagaagtgtggggaatgaatcaaaatgaacaactttctccagtgtactttctctagtgtacttagtgtctgtgccatccattcagatatgtcataatatgccttccaacattgttagtcagaccctttaaggctgaatattttgtccttccctcccagatggcctgctccttgaggagggggacagtgcttccttttttctccatattgatcttcattgactaatacagtgatggtattcagaaatattgttgcgttaaatactggttctttttgcttgacagcagtatctgttgggaactacatttagaaagctgattttgcagaagccataattttattgtaagtaaatctgtgagaggggtttggtttccatacatttcaaatggaaagtaaattaccagccaactgatgcttagtttggttcagtcacatttattgagcaattgctttgcacctgacatcaaaccagaaaatattcctgcctcatgtgggttcagagtccccagggatgtcctactgcccacctgacctggagacaggatatagtgcttgtcctcacaggtggccacagatgatcagtgggcagtgtatgtggtttcagccacatgcctggaccttactgggtggtactatggacctgctgcacacctagtgcatccccctcctgagtggtgctggattgctgcccctcccccatcccagtccctcctctggtagccagaataaattttgcagtaagttagcagagttgattccaaaaagtctgcactgtggcatctcaggaaaccaaacttatctgcttaagaaataacttgcagagagaaaaggaactctgacaaggctaataacagggatttcaagctgtgtttcagcaagccagtcacagagtattcacgtgttaattcactggcgtgttccgcggcataagcaccccctctctgccttcccccagttccaactgttgtgctgcagcagatttggtctgagtctgggcagagcccctttttatggagcaaccctcccgatttgttacagcaagagcctggtgcaagtgatctttgccttcccatcgcacacaaaggcaaagagctccttaaagggacctgcctgctcctccgtgcagctgcaaacccgtgtcggtgcaggctcagcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggtatgcacgtaagattccctctgtgcggggtatccaggttctatacaggtgcagtggagacagtccatcggttttgaaaagtgatttactcatcagtgggttgctcactttagaattctcaggtggttctaaaatagctctttagggggatgaataaacccagggtggttgtgtgtgtaaagatttttaaaaatgtggcccattttgtataattctaaagtcctatgaacattttagaaactatgtacattccagtccccagaaaaaaacacaactgctggaactggtatttagatcaggatagtttttcagtagcaaatgtgtttgttctattttatgataaagacagtagtttctgggattatactatcagaaatagtttctcatctagtactgctctcttatttatcttttgtttgttttgtttgagacagagtctcgctctgttgcccaggctggagtgcagtggtgcgatctgggctctgtcgcctgggaaatagcctcctgggttcaagcgattctcctgccttaacctcctgagtagctggaattacaggcacctgccaccacacccggctcattttttatgtttttaatagaaaagagctttcaccatgttggccaggctggtctcgaactcctgacctcaagtgatccgccggccttggcctcccaaagtgctgggattacaggagtaaaccaccgcgcctggccttatttatcttttgaaagaccaagttaacaaatgctatacaaagctttttaaagaagctttgttgcaggaaaaaccacctatattggtaaattagattgaatagccatatttaagcctaaattactgcttgaaattaaatgtagaccttgtgaaatatggagaaaatgtaaattgttgcaattctactggtttcctcataaattttaaagcttcctcatcccctatgttgttttccatagttggaatcatcctggtaatagtggctgctctaatagggcatgacttacatttgacaagtagaaaatttcattattcaattatgtgactcctgcctcctcattacatttgctttgtaccaagtccctctgactttatttctttaaaactactgtgcttctagtttctaaaagtgtttgtgaatgtagaggagagaagctaccaacacatcttccaaaaaactttggttacttcagtttgcagatatgattttgttaattgtccatatctaactatctcttgtctttgttaggaaccaggttttagtttaggatgaagttaatgaaaataatgcataggcaacatgtgtttctcatgtgaggttgctgaaataagcatttaaacctgtttttataaaagttgcccttgaaaaaatttctttgcagagttacaggaaagtttctcattgcacaaacatcaagcactgttattttgatatatgtttgagccattaagaaaaaaagtccttgggtgggaaaaagcaaaacaaccataactaaagctctttaccccagctgcagtacaaatgtaagcagcctgacttaggtcaactcattgaagcatcagctgtgtgagtgcctttgcttttcctgatatccctgtgatggagagagtggggcaccacaatgacagttctctaaatgagactgtagtcttgagtccactgatgttttctatggctgctgctgtggcacacacgcagcccctgccttgtggacacagtgctgctctgcatgcacttcagctactgagatggagatgagcagctgctttcctgggcaaggtccccaggaacaggaccctccagggttaaggcagatcacagaaggtggtttaaattgtggcctctagtactttcgcagcactatgaactttctttttgtaaatcagaagaaatcaaaagtaagaccactaatttcttgaggcagagtttcatagttgcttgatgattgtgttggaagagtttgctcttatgaaggcctttggaagtcaggagatttccattaaggtttttctggtggcacagctcaactcatgttgagtgataactctgcttcccaaaagctcagagtgtgagcaaggttcgcttgggcacctttcattactgacaactaaagatagttctctaacaaaaagttagccactgggatcttcggtatatgttgtttcttaaggtaactaaacaagatgcctctttttcacttgtgctcatgttccaagccactctatctgtaacagtcaggagatttgcctgtgtgtgtgtgaatgtgacttactcttctgtttcagattctactctgagtgacctttatgaaggagattatgagattatgccaaatgtacaccaagctttcttagggttaaaagggggagggagactaattatatactttataaaaaatgatagaagtaacttttattagctaaattatccttttttacattgttttaactaaagtataatgtgtatatatggactatttgttaatgataacaaatagcagaatatacaaaaataatgccatagaatagggaagataattggcttaggtaagcaatctggagaatgcctgaaataactaaaatcgaaagttagtagtagctaattgtggtcacaatttcatccttgaaaatggttttcataggcagagctttaaaggggatccctaaatccaacagaagattttttaaaaagtctttttgttcatttttctgaggaaagggtttatagctttcaccagaatttgaaaatggtctacaactcaaaaactgtcaaacagcaatgttgcctagtgaagaggtactcatttagtcagcatagtcaataaatatttgctgagcacctattctatatcaggaacctcactcaactggtacacaaaggtgcagaagccaggtgaagtctggggctaaagtacaagttgaagaaacagaccataaataacaaaacaaacaaacaagcaaacaaacaaataacataattgtctaatagaagatattcctatgaagttatttttttttggaggggtgatagtcatgcttgggccaacttagttgatccattttgaagttaccaactctgcttcagttccagaattaatgattgcatcttggggcatgagtaattgtgcgtatgtctgccacccattttgctatccagagacttctttaaggtatatggtgctacctggcagctgaggacctacttgtaaccctgataaataggtataatgccttctacttatataatgccttatgatttttaaagccaactaatataacagcctatgtttaccacccattaatcaataactcacaaaactgagattttagaaagaattaatgtatacttgtgcaaaacctctgaattctgcaaaataaaatgcttaaaggcactattatattcacaccatcattgtataagaatattgcataaaactggttattgtttgaaggcagaagataaaaaaaatctactagaacattctggcattccaaagctactgtcagcccaagagaacaagattccacctaatgtttatactgaggactatcctgtatgtaaataacacaggattattcctttccttagagggcttttttttccaatacagattatttgtatatatttatggggtacatgtgatattatatattacatgcatagaatgtgtaatgatcaagtcagggtatttagggtacacattaccatcagtatttatcatttctatgtattgggaatatttcaagtcctctcttctagctattttgaaatatacaatacgttattgttaattatagtcagtctactctgctatcaaacattagaacttatttcttctatatcactatgtgtttgtacccattaaccaaactcttcatcatttcactctcagagtttcatagttgtgctttgttagtgcatgaaagttcctttgttctatttttatgtctatttttaatctcagatttcattacactgtgttagtttggtgtacactctacaaccatacatgatagatttacacatgatagatgtaggtatatacatgaatctttcatcctaagaagagcaaatcattcaggacagaagttaaggcacattgggttgtttttgtttggttggtttgggttttgtttttttaaataactttttggaatgatccagctaccagtgtttgacatggtctcagagcttctgtcattcagaattgagcacgtttgtactgataaactccctcctcctcattctgaaattgttattttagttttagaacattggcatatgatgggccccatttcattgaaaacaatctttaaattccactaaaaacttcaactccccccccccccacctttttttttttttttgagatggagtctcgctctgtagcgcaggctggagggcagtggcgccgtctcagctcactgcaaggtccgcctcctgggttcatgccattctcctgcctcagcctcccgagtagctgggactacaggtgcccaccaccatgcctggctaatgttttatatttttagtagagatggggtttcaccgtgttagccaggatgatctcaatctcctgacctcgtgatccgcccacctcggcctcccaaagtgctggaattacaggcgtgagccaccgtgcccggccaactttttccccatttttaaagttaactaccattaaaattgtttttgaaataattataaatttacagaagtttgcaaagaaaagaagtacagggaatttccatatgcccttaatttctccagtggttaagcatgcctgcttaactatatagcatgatagcaaaaccaggaaattgatgatccatatggtttggtacaatccataggatttattccgattttaccagttatacatgtattcatttttgtctgcatgttgtatgcctatgtatatttatcacatgtatagatttgtgtaaccaccaccacaatgaagaatcaaaattgttccatcatcacagggctccctcatgttacccatttctgtccacatccactcccccttctccaatttctaatcttgggtaaccattaatcttcaagtcatctctgaaattttattgtttcaagaatataaatggcataacacagtatgtattgaggttggcttttttttttttttttttttttttttactcagagggtttgtacagggaagtggtgagaaagaatcttgtagtggtgaaaagagattggaatatggctccatggagggtaagatatttagacacgagggaacatcagcaatggagggaccagtaaggatttttaagcaagatgtctgcttacaaagttctgttaagaaaggattaatctggcagttgttccagaaaaaaaaaaattaagagttgtagctatggaataagaaaatttatgttaaattccatggcactctctactttcctatagagagtcaggactatatgcaaaagactcagaccagataccagatgcctttcccatgccattcctttcagagcctttttattaaagcacatgtcacagtcaccattctttacctcccacgaatggtgggtagtttttgaattaaaacaattcaactgaaagatcaatcttgtcagccaattatgtaaaaggcacttagcgcgtgtgtgtgtgtgtgcgcgtgtgctcgtgtgcgtgtgtgtgtgcatgcaagtctccgtatggggaaaagtgggaggaaataggtgggctgaagaggaggaaaaggagagctagctctgtggctgtgtttcaaacagaaatatttgattttagtccagaaaaaaagagcagtttggttatttgaaatgccaagtttcttggtttatttttgggttttgttattgttttttggtaaagaataccgttgtcatttccactgacacccatgggtatgggctttcctctctgccttaaagtaaaatggtgagaatggggaggtggaagagccttcctaaaaattaactgctgattcaatctcatagagtttattccacctctgcaaggcagcagtcagaagtctggcatccatgggatggtgagaaaatggtaggaggggagggagcctcctggaagttattacgcaaacattgttccagttctatggttctggaagtgtgtgtgggggctgtggggctgtgtatgtgtgtgtgtgcatgcatgcatgtgcgcacgtggacgtgaaggagtctgaagagtttccggaaacggctagttttctagctgcaatcttcagtttggttgttacacatggagtccttaatcccacatccactcaatgaccctctttagaagtacactcattttaaagaaattcttttttaaaaattctgcaaacatttcaatttatggtaatttgagaaatgttctgaaaggagaaaaaaatcccatcacattcaaaaggaaaatcagattcctaaatttcactttgatttttaaaattcctttcatcaaattcatagtctatctttagtatatcaatttatgaacagtatgagatttggattcagtgaatttgatcaaaatataggactcttaatttatttgagtaccctttaaaaacttttttaggagagaaaagtctcttatgagaagaattcagtagcatcaattcatactttttcttgaagaatttcaaagccattcagataaatagctattaggcatcataagaagattcgatattgcaagttaatcatattgtatgcttaaagacatttttgtaaccagtttttcacttttttaagaattagaaatagagtgattgagtctggaattcaaggcaaaagtcctttaaattttcatttcaatattgagaattattaatactatgtgatcaccagaaataagagagttagcaatggttgttggtgagggaactcaagacgccatctagtacagttactttgttttatatagattggccagttagttccttggtcagagttacccatgaagttgggcagagggccaaggccaaagtgaggtcctgactccaagggcagagttccttatgctcctttcgcttccacattgcagcttcttgggtaggccccatttttcaacacaggaaagaagcacagcacatgcaacacttctagaaaggacaattcccttctctacataggcagaatttgcagcccaagcttttatctctggaagtagcaaagccatgctgtgtgctgagagagccagaccaactttctccatctcctgtagagccatgaggaccccacagtgctgccacagaggctcttcactggtacatgttctgaagttggacataaattaacttccagatgatagcatgcttagcatcacagtgtctaaagcacaggcttctcaggaagagatctacaaaaccataggcatatatgattgaacattgccacatgtaacactggacaggaaatgctcatttgggcattctgtgctgaacatacttaactctcctgtatgcatttagagattactttgaaagcttgctcctgaaagtcgaaatcaaacacatttaaaattccttactgcaggttgattttcatttacccagattggaaaccaaaacagaagcccagcagtgattttttttttcttggaatcgacagctagggaggactctgagagcattcacacaggccatctggtctagccctcatgagaaatctgtcctgtttttccaatttgcactgtgcagcaactacttgtaaaggcctctaaagaaatattgtataatctttcacagcagtcatgaaaaaatttggctcttctttttgagaatcagaatcattcattcagctctaaagtcctcagaggaagtgataaggtgagggttttcagaattgttgtctattgcctggactccaacagtcaagtcagggagaaaaatgaatataaaagattaaaaaacaagaaaccaagggcacagcaacaagacaaaggaggcacgtgtggcatacagaggactcccacttccttctgatacctggggagggagattctctcccattctcatcccagcacctgttcatcagatctggcctgactgttctactacgaaaccatccaaggtaaaaaaaaatacttcccaatcacaaaattcctctttgcaattgactcggcttctttaaagctgcatcggaaacttcttgtcctgtcctctgttgacgtgaaaatgagctaactataattttctgcctcataaggttgctggtacttgaaaaccgttactacaactcagcttcctaatttccagaacgataccagcagttttctcctagatttcattttctgactcccaactgtaactataactctcattcaaaccctctatacaatgtctatctcttctttcagtcactcagtgctggatacaattccaagtcaaagtctagacttttcagtatagaatagcaagattggctaataacagaaacatggtatgtcctttcgtctgcatgccctggtcatgcttcctgttttagaaggaaaaaaaatgtttttcatattttgaattattctatgaaacaatttctgtaaaacattaaaaaaaaatcctaacctatttattagagtaatgggggatgactatgctgacacatagcaattcttatgagatatcaactcgaaaaattataatggtgacagttgaagtttcttgggttaaagaaatatgaaaaggccaaatttgatgtataggtttcaatgatagttgagtatccaggtagaaagctaacaacttgtactgtgattaatttgctttttgatatattcttatagataatttatttttaacataggaggtttaaatataaatgcaactgtatatgactgctatgattaacaagaaaaattttctgtatgggtaattaacatcttataggagaatgcccatggaggggctcaactccagaaattacaagcaccgagctcctcatgattagttcatatctactggaaagcccatctggtttaacagagctcttatgtaagaaatgcaagatttttcctgaggagcacatgctaataagcttcctcttttccattagcttcctctttaaactaggtttttatgttttgttttttttttaaaatgtctttggcctgagaccacaacaacaaccttgttataaaaatcaactgcgtaaataacatggctttaatgaatgctactctctttcaactcaagaatcagcaaagaattcctctgaggcatttgaggaaaataaaccttttgactcactactcaatttcctatctgtatatgcacaagcacgtctgcatgatagtgtccgtgcatttactttaaaaaactgaaaatgttcagaagaaatcttagcagcctgatttcagaaggttttcatcttgatgaagaacatatttgtttcattttaatgaagagaaaataaatgaactgctactctaaagagacccaaatagaaaggagttgggaaatccatggtctaacatacaacgtctcactcaataatggcttatatttcatttccaaggaaggagtttaaggtttcactttcactcaaatacagtttctccagaagtgatcttttggaaatcaagaggcttggatcttagttcataaaagtttgggataattccttaatgagaaaaacaagtggacatttgccagagaactccaaatttcaccagatattttttcctgagggcttcagcaggaccttccgtgggttctgtttcaaaacaagaggtaattttttaaaagggggtacagcaagtatccttaagaagcaaagctgtaaatttcacactgtattggtttcctcttgctgctacaacagatttccacaaaattagtgtcttaaactaacacagatgtattatttcataattctggaggtccaaagtctaaatttaaagtgtcagcaaagctccttttctctggaggcttctggttggaaatccatttccttgcctttttcggcttctagaggttacctgcattccttgactctttcctccatcttcaaagcacatcattctaatctccagttctgtcttcacgtctctttttttctcacttcgattctcctgcctgcctcttaaaggactgctgtgataacatcgagcccacctaggtaatccagcaaatctcctcacctcagaatccttaattaattccacctacactgtcccttttaccatagaaggtaatatgtgcgcagtttccaggaattaggacatagacgtctttcatgggccagtatacagcctgccacccatatcatgcaaaaaatgttatatgggagaggggagagttaaaggaaccctaaagtatcaagcatcatatccccaacactttttctagaatccaagacttgtccaggtgaagcaaggcagcaaaaagaataatgggatcattgaaaatgctgagtgctggggattttctctgagtaaggctacagcttgggttttgaatcagaaataaaactctcatttacattgtgtggctacagtgtggtaaagtttaaagttttatcttggcctttgcaattattattacagcagctactatctgaatctgctctgcttccctcagcccctcactaacacctacgaggagtatctcttttttctttttttgctaccaagacctaagtacaaactaaattaaggggtcaacattaattgaaaatcaatggacagccacaaagaccaagctgtaattaaaatgctcatgacttaaaaatatatctacctccaaatttcatgactgtaatcagtgagatatgggaatagaacttctttctagcacttgggatcatgggagatgaagcagcgcattcccagtgcatctgggaggctctgttcacatcacagaatagaccttaacccttccataaaactcacgctgtccctgctttgttcacattgtcatagcagtgttgtggaggagaaaagaaggagtttattatgacacacattttcaaatgttttaaatctgatgtagtttcccctctgtgaagttctgtctcacatgccaatagaaaagcctgggtgttccccagttctttccaaagacctacagctctcttatcactgcctagaatactgggctttgaaggttatactcttgatttcaaatcatttaagtctatatactctctcttggcatgcaagcaaaagtaccagattgcattatatctggggagaaatattagtggttacaaatcaaagtgagttaggaaaagagttttctggaaattcagaaatcaggagactcaagagttaaaactcaacctttgcctataatttagtctcttgtggccagatattgtttcctggaggctgtaagagacacaatgcttgagtaagatggaaatgaggaaatggctcctgggggaccttgctgattgtgaactctgctaccaccctgacctatagtctgggaagcaaagcatgggttagaatgcaataatggaggaagtcattctaaaatagggataggaggatattgctctagaacccctcacagggctaggtaactccccatgcactttcagctaggtggcatcatctttatatagatagggcagtgtatttagagtcaacagtgcacatcaagcccctctagtactacactgaggatagtaaggggaagagcctgacctactttgctgtcttccaaattactatcaccagggtctgtattctgacttagaaaagacattttgcttgggcctaatgcaaatacaacaatgaaaatgttggttcatgttgacagtagaaaagaaaaataagcaaatcgaagtctgcatatttattctgcagatggattctgcctgattacaagtcattgatgatcattaatgaagcaaatgtgatgaggttagtgtttttcaatttcatttcttagcagcaaggcagtactatcacacgacaatatcactgagaaagtatttggccttactttaataatgattaattttagaaatagaacattcgtaaaatgttagtttatcattttgcttgttagtattcatgttaaggatattagcacagtctctacttattttgagatagaaatactttggggacagggtttgacaaaagacaaatgctaattatcagaatgtctgaataacattctttgccagtaaaatcattctttatgctgattacctcatgtcaacatccaaactaagggaatgaatagtttaactactattattttatccttgagaaaaactctgaagggggaagcaagcgatgttatgcccattttaagttaccgcaactgaggcacaacataaacagaacttaatggtatattatgtagtctaaattattggacttttgatatcaattctaagttcagacagcttctggcctacttcctgttatactgaccagcgtatgtttatactaatagtgactcaggattaaaaggaatgtaatattggcaaatgacatttctgaacaaggttttaatttcccttgttggcatgtggcagtggaatgtcccccataattactctgctgagaaaaccagggcagaggcaggactggagcagtgtggtggtacaaagaacatgcactaaagagttcaggactgatgccagaatccagaggctaacggaaggttcagcagccattgcggttttttgtttttggcagttcaagctattagaaatctgcctcaagggaggaataaaagcatcatcaggtgttaataggtaaattaatatcaagcttaaagaagtaagagatactttgaagatgatttttatggcaagtatttatcctacatgtttagtccataatttatatcgagtatgtgaatgtgtgtgtgatgtgcgctaaggtgcacacacatacatgaggtcataggggtgaatggctcggtggaagcatggcatactagctaaagggactcgagtatcagtttacttcactttgtctttactaccagtatctgtaagatggacttggtaatctttttcaagagtttcaggattgttttcataattgcaagcgaccatatacctgaagtaccaattactatccattaaaattgtcattaatatcagtattagcatagaatgggacaaatagacaagaaaaaaattaagttctgtgaacatatgatatctttgcaataggtcttgttatttagctttgtatgtgcatggcttcaaaatattcctgttttaatcatccccagtcctagcacggtggcttggtatgttgtaggtgatcaataaaggattgcaggatggatgaatggatgcatgagtgatccagttttcataagcttcaaagtcttctgtgggattgcattacaatacaacccttttgctttccagtgcaggcttaattctctatgagacttgtcctcttcacattcacgatgggcttctttcctttggaaataggaatcctatctgttcttgaccttggttactgaatagcctgacctatccttggtgtcccccaaattattctgccataatgactggaaactaatagttgtacacagtttctgttatatctacttacacccagccttgttccagaaaagaatttaaggtggctctcaaatttgcataggttacaaaagaaaagaaacctaaaaacaacagagacaggagtcaaggatgcttgtgacaattcatcctactatttagacactaaagagcacacatgtcctcaagaaacatttcctggtcattgtctgggtagttgcaaaagagaaagtggagctgtgtgtggggtccttgggagacaattgtgcagggactgcttgagtctttgtttttgttggtctgctaagaatgtgggtcagcataaggtagcgattcctgaacttatcacttgatcctttacaaagagggggcaatggaagcaacatggcttgtgaaactgtattccttaaagtagtgaacagatcaagtaacaaaaagagaatatctgcgtggaagctatacagtgggggcaagttattgatattgatacttacaggttagtattgatcaattaaaaaaagtgatgtaactattccaaaactcttagaaaaacatggattttgagtgttgatctgatgtggtgcacagaaggagctgagttttccctgtgtggcatgttcagtgactctggccttttctcaaggggtgcagtagccaggagactgaatagtccaggactaggcagcagggccacttgaaatcccaactccaagtccattcaccaggacctgcaaagagctacaaccttttcttcgaggttgcatgaagaaagatgggatcctccagtttggttgtactggggtaagtttggtgagaccatttgaagatattaacatgtggtgttcctccctgcatctcttcactttactacattcaagcaagtagcttatgtagtattctgcaaatacgtccttatttgcagaaagtgtgttttcggtgtccagatgtctaagtccattacagagagtcaggtttgaaagaaaaggcatttcccagattaagctgagattctgctggtttggtgggaagtctgtgggtcccatgagccttgctccctgcagcgtccaaggcacgtgatggccctgtggacatggccctgtgacagtggagagactggatccccagctaggggtttccaacctctcccaagttctgcgaagcccctggtgtggcttgaaagcagcagaactgaggaccatgtggtctgggacagccatagacagatgaccaatgatgggcagaatcatctgtaatcacgtggtaaacatggacagaattccctgacgctgaagagtctaagaccctgggaccttgacccaatctcagcagcatcagcatggagggaggcggtgagggagttaatattgtgtaaaaattaaatttccttttggctcggtaggagggagttcctgggttgaaattaagttaattcatagaaaaatattaacatgtcatatgtcttgctacctaagtttgtgacctaagattctaacttgcttcgtgtacattttggaagatggaagaggagagcaggaaggacaattcaggcatcatttcaagatagaaaccagccagccaaagcatggagacaaagatgaggacatatgcttcatactgcaaagagacatgagtctccagacttagccattcagagactatactgatttgattttagaacagaagagattatttttatgaaaaccaggaacttcttaagtttggattcttttcatctttttttttttttattgttggtctacctccacaagaaaagaaattatttattatgttaaaaagttcctcttgccagtacacttatgtctcaaaagaatggttaaattgcttttccacttagagttggaacatgaacaaattttattaaaattgaagttgagtttggtagtgcagggccaactgtaaaaagaaaatcaagggctgtgaaatcattctggtgctgtcatttcccctctgagagaggagaacccaaggtggctccattcatctctgggccaaggaaggggcagatgtgtaaatgggaggctgtcaactgagcacattattactgaaatgtcattactccaaccacgatggagcaggagttacagggcaggtctgtctaattactaaactattgttattaaaacttttctcatattaattttgatttttcagaatacagtaaggctgtacagaatatagtctctgagcatgatgctcagagatatgaattcttaaccgtatgatttggagtcagttgattcattcaataaacattccctaagcaggcactgtgccaggcactgttccgggtgttgaggataagggagtgaacgaaatagccttggcctttgaaaagcttatattgtagaagaggagaaaaagaaacaagtaaatgtttagcatgtcaggaggtgatacctgctatgaagataagctgagcaaaaggtggaaagttgtggagggtgctattgaaataggttgggcaggggacattatttgataactttcagtaatagattggaagaaagtgagcaagtgagcctttgagtatctgcgagaagatcaatccaggcagagaaaaaagcaagtgcaaaggcctgagtgcacatctgaggaacaatcaggagaacattaaggttagaatgggccagatattgagggccctgtgggccatggtgaggacttttcattttattctgggtgagtgagatggagcaggattttgagctgaggagtgatattatccgacttgggcttcctaaggattgctcgggtttcttggtgaggaatagactgtaggggcataagtgtaagctgagaagtcaataaaaaacagtgtgtagtcagttcatgaggacgatggtggcttgaattgtggaggcagggatggaaacagtgagaagctgtagataagcccatgatgataatgatgcagttctctcacatatggagcttctcttctggggctgcccactgtagtgtttagccttgagtttgaatccagcactgccacttatacgttcttgatgctggccaagcttttcatcagtgaaatgaagatcatgacagtgtctgtcttacaagttgttaagaggattgaatggaaggctttgcacagcactgactttagcattctggcactttagttttatcatgttaatgttagaaagcatcaggagttttgtcatcatgtttctttgttctgaacagctatttttaaatggatggtgcatttttcaactgatggaacattagaatttaggaaatatataatataaaactaaaaaaattggcacacacacttgtactgataatttattagcattagctttcagattttcaataaaagttattttttcccttttaattgggggtccattacttatttttctgctttttcttcttctaaaaagaaaaaataatcttccctccagtttcaaaactggaaatcaaacatttcatctggaaatgtattagaaatttatttttttcttgtcttacctacttctctctggctccatactgagttgtaaataatatatcagttttttaaaaataaaaagcaaatacctaatcatatgggtgttttgtgtctctgacactggaaatataaattttaaatctgacttgtctgagtttttgatgaacaaaactaatattgtgtatcatgtagatacagctttattagcctgaatgaagctgcagttgtctttaccacagaggcctcagccctctctagcttttatgtggcagtgggaagccaacacagatgccagcactggctctcagggtctataagcccatgctgttcatgttccattcaagtcaacaaatctagtttttatctgttgtgtgcatagcaccatgatagggtttctgcataaagcaaaagaaatattgaatgctactcctttcagcttttacctttactggggagacaaaatttacctgcttaatgagtcgagaacaatgttagataatgtaaagtagattgcccattaaaattaaaataatatatcaaacggaatgttacaaaccatggataccagctcacacaatctttgtgatcagcatcaaagaaagagctggcctatgcttacgaaaggagtggtgtaaaggctggcagtccttggtcctgctgccctgtttgtgatcaaccacattatcaagtgtcacaagccagagattgcaggggcagaagaattctaggaactaaagagaattagttctagaattctagaattgtaggccttcacaattctaggaactaaagagaaagccaagtgcctagtgcaatgttttctattgttcagggagtgagattagtcctgtgcgttctgttcacacagctgccaagtacctccaacagggcttgttgagtgatgagatttcagcagaatcaatcttggcaccatctccatcttctactctgccctcaatttaatataaagaagcaaactggagaaagagtgaacgagaggactctttgtgcagtagtgcagtggtctttctcccctcactaatcctcctcaaaaaaatggggtatttctctccctgcccccaagccaagagggagactccaagagaatcacttataaaacttgccatgactgtacaacatctttaaaatccaagatggtgatggaatgccatcttgatagttttcaagccactggctgctgtagggtgtggaggaagggtcaggagagagatgggtggtatgacatggggcaaaggcataagtatgaagagttgtgaaaacaggatcccaattggtcctgcaggccctgaacactgagcccaaagagatgagtttgcaagctacagacttctgggtgggacagggtaggtatgcaccagaggagttgataagaagctatcagcttacctgctgggcatggtggcttacgcctgtaatcccagcactttgggaggccaaggggggcagatcacgaggtcaggagttcgagaccatcctggctaacacagtgaaaccccgtctctactaaaaagtacaaaaaattagccgggcggggtggcgggtgcctgtattcccagctactcgggaggctgaggcaggagaatggcgtgaactcaggaggcggagcttgcagtgagctgagattgcgccactgcactccagcctgggtgacagagcgggactcctctgactcaaaaacaacaacaacaaaaaagaagctatcagcttatctcataaagggtcccacctcctaagaattgtccaccagcatccactgttgggcttcaagaaaatgagctagggcagcaattagggcccagatgtggggaggactggaactctccatgggcagagcagaaaggagactcctccattttcttcattttcttggatcaacactataagcaggtgcaagtgaaagaggagatggtgttcgaggagcagaagaccccccacccttcttctcctgctcttaatgtgccagtagcactggattagggtaggatcagggatggaaagagatggaaatatgaattaaatatgaggtcaacatgttaaaagcagcagggctgaatcttagaacgtggtttaagaaaagtgatttaaacgtcatggaattgagccaacagaggctcagtggaagctatcaccctgtggaaaagagagagagggttccaagaagttgagttgaaagttgtgagcaggaaaataaaaccaattgatgtttataccctaacaagttaaggcaagagtatgtgttgtgagaaaataggaaaggcaaagatgaattttgaccagagagttatcaagaaggcttcagggagaaggtaggggttgggtcctaccactgaaggataggtcgtgggtgaatgaagtggggagaacaggtgagctgtgtgaggtggagggaggactagtctgcctggagcagaggcatggggagtgtgacaagttgcacccatgcgcagacctgggccagcggtggccaagcttccacaggaggaatttggcctccatcagaaagacaatgggagtcattgcatattctttagcactgagtgagtggtccaataggaagggtgccttaggaagatggctggtgtgtgagagagagaagaagcaaaggtgctccttaggaagttattccaaacctctggtgtggggctaagggacacatcaatacgagtgtgacttgttactcctgaatctttcctcagccccatttattgactgcaaatagtgcagtgtgcacttaaggcccttcgttttaagtatttaaagggttcactgggtaggcaggctctgcagcctgttgacggctatccattcataagctgcatgtccctacctgggcagcaatcagctttggagcaccccactcatcacacattttgtttatgttacttttcgttctcctgttatctataattttaaactgccgtgtgctcccccaaccttgccttgaaatgcattagtaactatgggaacatgatgctattagaacgagcagagcttagtgacatgcacaattgcagtgttaaattggttttgagatgactggcagtgtggatgctattgctgagtaaaataggcgacaggtattgtgactatattaacatagaccatcacctctggtggaagacatggatattaaacttaagacagaaatcagggctacatccttatcttgaagaagacatgttcccagaggttttaaatagcgtgaaaagtgaactattgagagttccagtaagaaggagacttttcatgtgctaaaaccaacaaaatttccccaaaatatgtaagtatgaatgcccattgtggctatgtcaaatatttcataataccagcacttcgggaggccgaggcgggtggatcacttgagaccaggagtttgagaccagcctggctaatatggtgaaaccctgtctctactgaaaatacaaaaattagctgggtgtggtggtgcttgcctgtaatcccagctacttgggaggctgaggcaggagaatcgcttgaacctgggaggtggaggttgccaagatagcattactgcactccagcctaggtgacagagtgagactgtctccaaaaaaaaaaaaaaaaaaaaaaaaaaaactcataataatgaaattagttctatgtgcattcgagtggtcaaattctgctataaagaaaaagattactgcagactcaaaagatgcaggttgactgctcatttggccctctccccaaggtttgtggaaatttctctcaaggcagggaaggtgttaacaactgcctcttctgacagaaatggccactagcctggctccagctggatcaactagccctgaggaatttgtccactttgtgagcacttctctccctgtcttgtgtctcctcaaccctgcacctcacccagtattgcagactggatctttttgcttcacatttctgtttcttaggaggtatcgatggtcttatacttccacagcattagtagcaaacagcaatagctcaaatttatacatttaaatgaaatccaatgaaagaatttaagcaaattctgattaacagtagacagtgtaaaaaatagtatattattatcaattcactgacatatttgctggattcaatattaaaatggactagaaaaaaaatccaagtgttctgaaaacatttcctcccacccctattttttggctactgtggtaggttgaataatgatctcccaaaatccctggactctgtgcatgttcatggcaaaaaggactttgcagatgggattaaatttaggatcttgagacgggagattatcctggattatctgagtggttcttaagtgtaatcacaggtatctttacaagagtgaagcagagggatatttgactaccaaagagccagacagaaggcgatgtgatgatggagcagtgagagattgaggatgtcatgctgctagctttgagatggaagaaggggctgagagccaaggagtgcaactatggaagctggagaaggcaagggaaatggattctttcctaaaacctccgggaggaatcaaccccgtctgcatcttgactttagcaagtcaagacttgactgagttagggattctgctctccacaactggaagaaagtaagttggtgttgttttaagccactgtttttgtgataatttgtgatagcagcaataggaaattaatagaggtacccgtcatcatgttaaagcatcaagttaaagcacagaaaatggagggaaaaatattgtcagtgtttgagtgaccagagtgtggcgtgaaattccttttttgagcactagctcattttcacagtattgatttaagctcaaagccccccttttccatgtagccttctttccccatctggttagaagtattctctgtctctcacctctgtgtgtaacactcccattccacctattttctgctaggcataattactaggtatctggcatataaacctcttatctgccaattcattagtaaactcctgcagggcagggatcccaactatactttcctttgattcattcaaccagtatttattgagcatatgctatatactgggcacagttcagagcacttgaggggcagagttggaggtgagagtaaaaaggcaaaaatgtagtacatgtatttggtatgttaggtgcggtgtcaaaaatgtacaggggttggggtccagtgttaacatgcattgggttgttactatgtgtcatgcatgttaccaagtgctgatgtttattctaatataacgctcccaacttccctataaggttagtgctattatctccattttatagataagtaaacagaggctcagaaaggaattctatcaaaggccacccaacctgcctgactccaggggccagcctccccaccattctgcattactgcctccataagcctacccagctaggaagcagtatgggcaggattgccgaggatgaggaagccccatggccctgagccaagatcttttacgtcagaaacactaaatgccaaatgcctattttctgattaaaagctggtcataagttaaagacatatgacaagtgcataggtgactttagctcaagatgcaaataattaattgcccttcaatttctattacaggctgagtgcagtggctcatgcctgtaatcccagcactttgggaggccaaggtgggtggatcacttgaggccaggagttcaaaaccagcctggccaacatggtgatatccccatctctactgaaaatacaaaaattagccagacatggtggcacatgcctgtagtcccagctacttgggaggctgaggcagaagaattgcttgaaccgaggagatggaggttgcagtgagccgagattgcgcaactgcactccaacctgggtgacagaaggagactccatctaaaaaaaaaattatattgcaacattttctcgggtctccaaaaaatctggcatcacgtaagcaagaggcaggaaactggtacatactttgtcaataggacaattgcattaccaaataattacatgatatttccaacatcagagaatgagtcagaactatggccaaaggaaggtgaggcttgtctcaatggtgctatgcgagtgcctgcttttttctcttatggtggccagcctgccttgccaatggaaaaggaggccatcatcatctatctgtaagcaggggttgggagtactggggtataggctatagtacactcaggcactcaggggctctggatttgcctctgctagatgatgtggcattagccaaaccgctgaggttctttgggagcccatctgtccaccacttccacaaccaggagcaccttgctcactgaggtccctggaattcctcatgacctgaggctttacagatacaagcactggttctcattccaaggacctgtgtcctggaatattatcaaatatctacttacctccaagctgatgtaaaggagtggaatccatgtttttactatcccttacaaaagcttttttttttaatttcaatcatgactactatgtatttgtatctcaactatagcataaatgaacccatttaagaaaaacgtttctcattatctattcatgtgggataaaaccactttataaaagtatatcttcatatctatattatcatattctctaaagttatagatatgtcttgttacacagagaactgataatggtgaatacaattttcttactttctagaatggttgaatgtgaatgtggggtcctaatgtttagaacatataaaatttgaactgtacattgaaatatgggaaaataatagtagataacctgacaacatgtttgtatcatagaagaataatggtattctaatctacagaataaataaaagagaaattccgtgtgttcacatgcacacacatatacataaatatatacagagagatctatatcttaatacagttacaaatggtacaactcaaaaaaactagtttacatttatgtagcagtcacatccttttaaggttgtttcacatctcttttctcatttttattcttacaagaatcctgaggagttaagtggaacaagtcttatttcccgcattttatagatgatgaagccaaggcacagagaagccaggtggcttagaaaaccaacacccacccccagccaagcagtggtaaagtcaagtcagctctttactgggctggaagcctagactcttttcttgacacctctgcagaaaatcaacatagtagtgactctgttctagaaagtataccatattggttaagagcctgggctgagggaagatctaagatcaaatcttgactctagcatttaccagctgtgcaatcttggatgtgtcccataacaggtcagtctcagtagttttcaatctataaaatgggaactgattgtactgtacttttcagggttcataaaatagatgacacattcaaagtaattgagaaaatttaataagggataaaagtgtaggcagagttaagggcagtcaacaaaggacagtaaagcatcctgtggatagcaaagcagctcccaaccctgaagaggggagcagctgccagcagctgaagagagggtggtgcctgtggaagagggcccctgccaggaggcaggtgacaaagagaggtgccagtcctcagcccaaaagagctcaagttgggagaagaaataccagactttactctcatcttactctgggaacctgacagaagccagaagacatgggaactccaaagatgaaatccatgaaggtcagagcccaggccacaaagcagggtaaagagagatggagagtggatctgcagaagcaaatggagaataacctgcacacaaaccccgtctcagggtggaggctgggacgattatatgagataagatgagagaaatgactagcacagggcccagagcataagttctcaataaatgttagttgttagaatgattcttcttattattattcccattaatatttggtggtgtttttcagtttcagggagatatttttagaatcttggctgaaaagaaccgactttgatctgcaacctagaataattattctactcagaggtgggataggtttgtcagcagttagaaatacgattctagacatatccacaggactaattcataggcttataaaggaacttttgcatgtacattttcacattgcgtctggtgacagtgtaattaagattatgtcagggtttccattgtgtcttgctattttcaagcttttataacttggttataaatttttgccctggcaaaaacttggcttactatatctcagcctttagatgaaattttttacagagaaaaacaatctgttaattgtctttcacttgagtaatggaatatatgtgtgttcattgtgggtgtagatgtgtgtgtatatccatccattaatacgtgtggtaatagctttgatgttttgtcttccttcttccctatctcgatgccattaaccctgccacttaataaaggaaatgactcaaaaagatgactcatccacaattccacctagcggaagagaagaaacaaagagcaaaagagcaggaaaaggcagaagggaaaagaatggctatatgacagatgatttacaatagccttgcaaataattttttaatgtatcccagccctcacacttttcacaaagtcagttcccattggagctgaaacacgtaaccattactctgcacccacatgtcttcttggatttactgggaaggaaaacaatgactgagttagcaaataacattgtagagcaaacaggaccttccagcaatattagcatattgcttccattaaagcaatatgctaattcccattcaactgctcaactgaaattttaggcaggtagttagatatctaagatacctaaggtagaggtactcctggttatttacaaagctaatctgcatctccagaataaaaagccaagcctgctttaaaagcagtgacagagaggtaaaaggaacaggaagaaagccaaggagacctcaagtgtgctgggtgtctttctttctttctttctggaagagttcagtcaagtgagagacaataggactaagcaggatagggggcaaaagcctttgctttttaatatacatccatagctcatgattttctataacatacttgaaaatactcagttttcattttgggttggatataaatttagaatcgtggttgttagaaataaaggtctctgaggggtcatcacaaactcacaggcccacagggtccaggcaggcagagtgagtgcccccgtaggcctctatgaacctaaaggagcagaccacatgccctatccacagggagtggacccccagcttcccagcaactgttgctttgttggaatatggaccctatgctgccagatcttccaaatattcaagagaagctggaaatcttctcaaatgtcaactccatgagggcatggagtgttttgtctgtttgtttgtaagtgtgaccctggtgcctataagagcgtatggcacacagtaagctctcaaaaaggttttgctgaataaatacatgtagaaaagaaagtagacaagcaagcaagctggatttttatgtgaatgctcttaaattttaatgttgacaaatagatttttgttttgcatggcttaattaaaagtaggagcccacttctgggaggaccaaacaaaactaatctcagggctagttgcgatttgtcacgaaatgctacttggccatctcatgtctaattcaagttctctgtgctgcagacaagaaaaccaaggccccaagacattaaggacttgtttaagggtcacacagatgattagtggcagagccagtaaaccagttaactaaccttcatctttaaattttccatttatagctttttcttccttcataccttgctgttatttcaaaaataaatacaaaaacaaaagcaaaagattaataaataaagttatattcctttataagatttcaaagtatagcccaaagctttacaattaaaagataagttgcaagggaacatggaacaacttagaaagatacaggaggaaccatccctcctgtgatttttcatacagtcagcctggcagtgaaataagctctcctttccaatattttgtcagttagagtagtccaggttatgctgcaggtgcaaatagccccaagatctcagcagctttaagcacaaggtttagtttttgctcacactacatttccttcatgggtccactggaagttcactctgcattgtccttaccctgggacccaaggtggcattgtccattgctgtggcagtctaattaagtgagcatggcaaatggtacactggctgttcaagcttctcccagaagtgatgttatcacttctattcatttatttttgggccttgtaagtcacatggccatgccaaacttaagaagggcagggaagtacaatcctaccatttgctgggaatgcagggggccagaaacactggtgaacagtgctgttgattaccacacacaacttcacctgcagagctcaagagccctgtgaaaagacactattttccctcaatgcattcttagttttagatgatgtcatgaaatgcactgactatatctacattttttccctaagactagtgaaaggaaaaccaaatgttctgcttatccacatctcctattggatattctccgttttgccctctctcctttaaaattgttccaaataacctggtaatcaagtgcttaaccagatggaaggaaacaaaaacttagaaatatagcttaattgtaagtaccatgttactattctgggtttccaagtaagtataccatctgctttgatgaagtccagttttaatgtagatcatacaggccctctccaacttcgtgagcatcctatccacataatcagcctgcacactgtgggcaggagcagggctacatccatcctggaaaatgaagtgttttcaggtacattatatttcctttctacattctctgaggactccccaggccatcagacagtgctgtgcacagggtgtcagggagccatgcttagctactgtgtcctagctgcactgataagaaaaattttgatttgtcaataattgagttaccctcagttatgctgccctgaatcaaagctattttctctccttaatctaaactgcgagctcctcaagggaagtacattttccttaaacaaaataaacaaaggcttacttgtttctgtactcttagaatctacataatcctacacaaaagatttattaaatgaatgaatgaatggtgcaagcaattgatatgagcttaaatgcactgaaagaagttcttcgcccaaatatgttttatttgaggacagcttccttggaattgagaaagtggtgagagcccatacagaattcttggtattctcactgtgtacaattcattttcttttgccattttcccacagagaacatttgggagatctcagagaaaatctagaaagtgggaggctaccgcagcaggactgtgtccagtgaaagactggcatggtgggaggcagaggggagagtaccaggaatgttgctgaaatagctcttgctcgtccctctgtccttattgctctgggctggcctacaaagacacctccacaaggcctgtccagtgggctttgggaagcatggggaagttctcctctcctcaccatcacgtgtccacatctgcctcctgctgcaggcatccccagattagaggagggcatgctatttgctaataataatggcagaataagtcagcacaagtgcctggcccagcacaagtgcttgcttgtctactttttttttttttctacatgtatttattcaaccaatagtctttgagagcttactgtgtgtcatacactcttataggcaccagggtcacacttacaaacaaacagacaaaactccaatattatttgctaatattaatagcagaataggtcggcacaagtgcttggcccaggaaagagtggatgctggagcccagtaagagaaacttttcccagacccctgtctgtagtgcacacttttcctttcttttcttttcattcacatttagataaaatgttctttagagcaaatgtttctgtgctgggcatggttttttggttaagattcctgaattccctgtctcaagaatggctgctgtttggagaagtatagggagtgaaaatgtggcatgcaagccaatcacacccagaggaaccagtgcaaaagcaaacacagagccctttttatgtgcaagatgggtaatattggcccattatatcctcaagcacatctctgaggcaaatactctattatctcattctaaagatgcacgaactcagagttcaacttgtcaggaccaaaagctactgagcgatggtatttgaacacaaacagcactgctctagcattctcagctgcgatactaggcttcctgctttatatcctttttcccttatgcttccagtttttctttacaagaatatacatttcagaacaaagatttatgtgggtattttgggaatgcatataccttttatacaatttataacattgttttaatatcaaaatgcattctgagttctaaactctcagcttgcaaataaacttttgggtctcactctatttgtaagctggattttgtttttggtttttaatttcattttaaattttaggtagttaaaactgtgttttaaagaaaccaggcagtctggttccagaaagtcaagatcctttaacataccttagaatttaaaagatagatcttaagagatgcatcttacttgtttgttacgttccaaaatcattgcatacagagaaaaccatgtgtcaaaactacccttgaaaataggaaggctccacactagaagccaacttaaccacctccaatgtgggaacaaactatggttacttctgctgaacactaggtgaagtagccagcatttagggacacaaacaagtgcataacttcaggatcccttcagcctagtgagatgctcactcgcacagcgacagtcacaaaggactgggtccagctgagcaaacacaaagggcagattctcccagctcatactcgtcccagaacagttcttagatgaaggaaaccaccaacagaatggttttgattattctcctgtcacttttctgcccccagtgtgttttatcaaatttgaatatgttaaatgaacgtttgatgtgactgaactcaaaatatgtacagtcagccctttgtagttatgggttctgcatccagggattcaacaaactgcagtttgaaaatatctgggaaaaataaaagaacagttggatctgtaccaaacaagtacagacatttttcttgtcattattccctaaacaatacagtgtaacaactatttacatagcatttacactgtattaggtattataagtaatcagagactatttaaagtatacaggaggttgtatgcaaatactacaccatcttaacttgagcttcttatatccattgtaggtcctggaaccagccttgcacagagaccgagagatgactatatatagtgatgcaggtcaataggaaacttagggtctgagaatgattttaagataatcacaaaagcattctaattcttattcctttacctgcttctgtagaacattttaatatttaacagaaccactggtttccaagggattccctttagaaatgcagtattaagagacggaggcattactgactgctccaagtacttctggggttccgatacctcttgcctaatgagcctcttagcccatgtcagtttttaagtccacatatctgaggagactacactataggagaagctgcttggattttgagtgatcagctcttcttttattagaagatgatgctaccgatgtgccaagaagaagctcatattttaaattatttttccaagagtgtgaatctgcaccaatcagcaacacctttctactagcatccgcttggtgcactgatcagcaggccctttgccttagttgtggatttaccttctattatttgactcctaaattcttcttaatttttttaagattgggggctcacctatgtaagaaattaattcttttgttactcatattggtgtataaatataagtggttttcaggaagattctttaggtaaagtggtagatatgaaggaccaatgactggagtgggttttcaaagtgtcctttgaaaaagcataaaactgaaatacttgtactgtttcattggtgttcggggagaaatgacacttgcatttattagacttctcctttatccagtgtatacagatttgtgtttatttacatcatcccagtagaactctatgtcataaaactgtaaaaatgcttaactcaatcattcatgtacttggttttatcttcattctgtctgtacattgacccccatgtcctaagtctttcaaccattaaaaatagtattagagaagtattttttaaacaaatcccttgatcctatgtgagatctgtgtcattctgaagagaggatgtgaggtgtttcttttatgttggtaaaggttgagttgccatggtaatgacttattgtgcaatattgggagacgtgctttaggaacatggcatgtggcaaccccatattgggttcctgttattatagtcgtgtcataccttgacttttcttggtcccaaacaatctttccatcttttatactatccggaatttgcatttctagtgtaaagcttcctttttactgcttcctgttgcttttagaacaaccaaaaagagaattattatggaaatggcttttattaagtatgatagagaaacaaagttcccatgatttttacagcattttcaaacatgtagagtgctttgcttttaatttcttcagttatgcattgttactactttttaaaaccaaggaacatcacatagaacaattatcaaaaaccagaataatttattttgcttttttttttctctcacttcctcaggactgcacatatgtttcatgaaaatacatgaagaattaggtgtgcttttagggtatgatcagaaatgtgagtctgaattaatagaaaaattgaaaccataatctaagccctgctatatcagcatcttttttagctgaatggatagacatgtattttcacttaaataattcaagttcatcctgtccttggcaacagtttggttctcacaagcctttagagtccaagctatattttctatattagtctatattacaatgcgctttaattaggaggcataataggtaagtagaaagtggtttcattaagaccttgctctataattttcactcatctccagggaaatgttgcccatgtatgtttcccatgaatcggtgccattttagtgattatgttgaacaggtttttcagaggacacctcatttattcatgcatttactcattcaatagatactattgagcacctactttgtgccaaggatgctaatttgatgccacacgctcacttgactgatggagttctcaagttcggaactgataccaagtgggagccagcagtcacaggcctctcatgtttcccaggctttgctagtttggggacttttcctcagaccctcacagtcatattcatttttcaatggctctttatcacaatatcactcattcactcaactggcattagttaggccaggctttctaccatgctcaggtaataaaaagaccagggtagtccctgccctaagaggcttagtccagaccctttggaatccagttcttgagagtgtgagtacaggggagctccttttcttattaaccccactagaatcataggttttcttcaaactctttcatctcttcaattctcccctccctttgctcctccaagcaaggccttatgagggtacaattcctgaaaatcatggcactgaacttcatttgcccaagggcacccaatatagtatatgggataacaactttcatttatggagggtttgttatatgccagatttagtgtgaaataccttacacctactggctcatttaatcctcacaaaaccatgtgaggtggatactactatcattcctgtcttacatatgagaaaatcaaggttcagagtaactgttctgagatctcttaggtagataagtggaaaagctgagatctaaacgcaattttgtctgactctggggctcaagctcttaaactttgcagtacagtcataattactccatggcaagttatgggtcccactgtagtgttcattctcttttataaactgatatccatgacactatttttgttacactttattgagaagcacgtctcttacttttaaatctcttccaaagtaaatgtgattcgtagacctaggaagaggaagtggatactattatttgatggatttcagaaagatttaaaaattaagtaaacaaaataacttatctttcctttggatacttgttccatgtttttaaaaaatattttatatattaataaatgtatattaaatataacatttctatattaaagaatgtaagcgttcagcataacatgaaagtctgagatatgtattgccaaattaaaattatcatactggccaggtgtggtggctcacacctgtaatcccatctcttagggaggcagagatgagaggatagcttgagcccaggagttcgagacctgcctgggcaatatagcaagaccttgttctccacaaaatggaaaaaaataaaataaaataaaattgtcataccaactcaggaatgcacatatattttatttatttaacctaattaggttttataattgcacaaaacaaacttctcctcatatttcctcaagtaagttggggtttacaaaaaggatacccataagataatgaaccatggatgacaggaatcttacaggactccaaagaaaataatcatagaatagccagttctcccctagagtggatactaggcagctctagaaacttcagaagcaggggttagttcatcatgccttgggtgcttctccaccagtcatgcccagctactctgggggtctgctcccctctcctgcatctctgacttgcttattcatttcttctttcccgtatttttgccttgttgcattggatgtgcttatttataacccctaactgtctttgacatggcatctctatacatctcttaaactgctgccctacctcctaacaacttcattttctcaggatattctagctaaaatttctatgagagaggatcagatatgcccagcttataaccattatctctgtctaggcagagttctgaccatatgtcatagaatattggcaaatatatagatgtctcaggcctgtagggaggtgcccactctgatcccagatgctttcagtgcacaagagtagtaatggcaaggaatgggattctcatgatgaaaaacattacattctcagtaatccttcagcaatgtggtctactctgactctatgagatctggcatctagcaacttctccaacctcaattcttatcactactctccctattcagcatactacaactatgatacagtctcaccattcctcactgcagcatgctcctgcctgaggacctttgcacttgctgttctctctacctggaaagctcttctcacagcatttggcatggctcccttctgtacttcattcagttctctgctcagatatttcctcctccttgagatcttgtctggaaccactgtttaaagtggtaatcactgtcattgtctatctcctcaccccatttattcttctttatagcgttgaccactacttggtataactttaattatttggggtcttttttgtcttctcccattagaacatataattaagagtagaaacaacatttatcatgttgtagctcagactccatgccctgaaaagcagataagaaacaattgacaggaatactggctcgcaaacctctctgtgtctaagtaggattctctttgcaaagtttactacaccaaattaaacatattttaaaaaatctggttaaggcaaacgtaagagcaataataaaatagcatgtctctatggttgtgattcagcccactgacatattcaatatttgaaagacagcagaagaattttgtgttaatatcagtcactttatttccttcttgatctgagacttagaattcaccttaatctgcccgaaatagacagaagtgcatgtgttgaggccatacaatccaaatgccttgtctttgagtagatatgactaccttggaacatggcttgaaaggcattttctcaataatgtatttttttaaggatgatccataatgagatagatcaggatatattaatttctatatgctaatattagcatcatactttgagaaatatgatttcaagccatatttagcaagttagatataccattaatttattaacccatatataatgtgtactgtgtgtcacgtattgtgttactgatgcagatatagtactatgggctagatccggggcttacataagtaagtaactcatggccctatcatcaagcaagcattcattgtagcatgggaattggaaatatgaacaaataactgaatatctaggcttatgggatctattagagaaatatcccaggcacagagttggcacagagtagaaagtggtcagctgtatcttggagtcaggggaaatggagaagacaaagattaaaaacatttcaggagatgattaagacaacaggaggcaagcattccagataggtggctttcttcattcctgcttatctcccttgtttcaagttcttgactctctaccatagctttcgtgtctccctctggtgctcacccagcatttgtttccccagttctgcatagctcttaactttgcctgtgacttccatctgggatctcatgttgtctaactcctgactccatggaattatgctccctacacctgcccaccaccccaaaattctagcccaacagccaacattccttcccatccacacttctccatacctcataacatgaaaatttaggcaagaacaacatggacaaagaaacaaagacacaaaaatgcttggcctatcagggagctgcatgtcgtttgcagtgggatagcagataggaaacaaggacgatggtaaatgaggctggatagtggaagtagatcatgaagggcttggtataccacttaaaaagagtttgggctctattctacaggccgtgatgagctgtgaaatgtttttgaggaggagctatagcagaagcttggaggttggattgaaagaacgtgtcgtttctgggaaaactacaatgagataaacacctcttacggacactgatcttatattaacacctccaaatccactagatttcccaaagtgttgtctcatcttttgcacgtgttgctattgtggttaagtcatctggatatgaatttggtgctcctttattatttagctgggtcaccctatcctgtagttatgtcgttattgtattaaatactactaattataagacataactgttgttgagttgagtttcatcaagttagtttcagctcattgttgcagcttgtctgtcctttctacttgtaggccgggtacaaattccatagttgcatcttctgatctctgtagaattgttaatagagttgttgaacagagtgcagtatagcgtagaaaagcattgcacagaagcattaaggatttccttccagggagaaattgatctataattcaataggctttgagtaagttcttaagtcagctacaaagccacttggctccacagtctacctggtgagtctttgccttgttgaaatggagttgtttgatatttgtattatttctatagtctatcaacttattatagtatatctagacatttggtatccaaatgggaaaagattctaccttttgatattatcaaaattttctatagtgagttcttttctaagtgggaagttacagtgcggtttaaaaaaaacttccttttgctgcacttatctttttgctggtgacaaccttgtattcagccagtcaacttgagatctctaatatcttcagggtgagtggaattgaagaccaaaaacatgagatgcttgactttaaaggtcaaaatatcaagaggcagggcgaaaatttgaaatgccttgagatcagacagaatttgtccccatcttccccttccttcccccaccacctaatgtggacataagataaaggcactctgagctggaaatgggatggagaagtaggaaacaagagattgagatgctggggcaggggtgggggagcaggggatgattgcctgcctacaattcttcaagtccaagaaaaggatggaaatctactgaactcttctacatttagagatccaagagtagagggatccccgggagagaaccccccaacagctgggccttatgcaccagtggcatgagatgggaataggttggatagtagattaggaatgactacaaggggtctcttggacagagcatcctaagggggacacatggagccatctgtggcctgagaggagtgagggaggacagctaaactctctcagtgtcccaagtaatgtgagaatttggctaaggaagagaaagaagctgaaaaaggaagccatttcactcttgccaagagaaaacatcagagaagagagccacagggaccatccaatagaagatggtagaaagaccagactagagactcttagcaaatgtgggtgtagacacaactctcctttgaatatcttccattaattccacatttcaagggagtccagaccaggctgggttaagatttagaagtaaatgctttcctttttcaacacttgcatttacataagctcagagtttataatcaaccccacggaaaatggggtaaatagagaaaggaattctgaatgaaacagagttttaattccaaaataactttgaaatcatgaaatttcattaatttcccgaaatagaattaaattttctgaaaatgaggccttcagaaaaaaatttaaaacttgttttttcacaaacttaagtgtgtaaaatatatcccatccccccttttataataaagtggggagaaacaatgaaaagtgaggaaattggactttctatggcttatgatcaaatccatgttggtggctaattataaattataaccttttcctcagctaaatgcatatccttagcctaggaatcagcattcgccttatcagtgttgtttccagggcccatttcttcccattaaaaaagaaaaatcagagcagcatcggcctgtttcctccctttaggcacttctctttaccatgattgctctcagagccctgacagtttccacaatccaggtatctacactgttggaagatgaccaggaaggcttccaaaaaaaattcttttacagccacaagggtattttactctgttgcccccagtgctaggtcttagttccactttgaatcatttcttctgacgttttcaccttgagactattttcacttaatggagcaagatgagctcaaaaggacagctcagcaattctgttctggttgtcactaatcccattacatcacctatcccaagcagtgaccattctttcatcatttccctaaggcaatgcctgacccaggtagatgcaaagaaaatctctgttgagtgaacggagctccaagcatgttttctgtggtccctgagcctttttcttttgtcttttagtgcttttggtaagcctcagctcacttctgtcctcccagggcacgctgcatggcttctcaaagcttccaggcctttcaagctttatagcaaagcccttggcattccttttctaggttactattttggtgttcctcttatggaatgttccccttatatctattaaaactactttctaaaaacaaaaaacagttgtgtgcagggtagggagactgaacctccttctcatcctgagcgtagccatcaccttagcccaggaagaggttcttgtgggcaggggatgtggctctgccctcaggctggagaggggctccttgtccatcactgataatcagtcactggaaacctgctcctaggacccttgaagtgactgactggcttgcaaacaatattttctaaccagttatttaaaactatactaagatccttttctgaacacttaacagcaccagcgatcatgtagatgttctaacagtaggaaacacattcccgtttgggttggtattcagacacaactaatgaagagtggagctgaagaatggaaaaaatcaggggtggtgggggtggttattgtgcagatcagtggtaccgaattgctggacagaggtccaagctagttcagacagaagattctaacagtgcatggcaaaatgagtaaaataaaaacaaaggagtcgttttttaaagctaacgttcaatgtaaaagaataccctttcatttcttcttaagagaatttaaaaaatattttgacatatagacacatacataattttacataaatgagggcatataaatgatttttaaagtaaaatttagagtattttctttcacttttttatggtattacaatggctttttttttaaattatgaaaccctgataatagcagatagtggtgggcattttgctgcatgttagctatgtccatgtttggcagaataaaagttagcagtcttatgtctatttcccaaattcttttagattgcctacttgtccttgaaatccagacacctggaagcccctggtgttgatgaattccccatgaaccaagtttagcggcagggggtcaaattttccaaacagtcttgtgttctgaaacctaccaggatgagccagacaaacattaagaaaggggttgtatacctacacacaagtcagcagtggcctggaaattctccctgctcttgtcagaagtacctgaactcaggatatctaaggctgggatgcacaggacttccctgcagccttccttcagttcatcacatgtgaatatctgctataacttgatgcaatactcttgattggaatgacttgacacattttatacaaaaataaactatgaatagtatgtggggtttttaattaaaatgagtttggttaccaaaaaaattattcatttctgggctttatgtgtttgaattcttatttgaatggtatgttttataatataaaacattaatgaaagtttacacatgaattaaaaggggtcaggcataaatagtttgatgcccagattttcttgctttcatacaaggatcccaccccttcaccaaattgtttttatcaagtttagtcatccaatttcttttcatgaagtgaaatcctttatactctagtcctttaaccctctcaattgtaccgtatttacccataaacttgtgcattacatttacttggaactggtctgttgtagaatagtgctccctgcctagtgtagtgggttagtttcaaccagtatttgccaatgttcactgtggtacaagcacagtttttcagagtgtcgtgacatctgctataaggaatgtctccaactgccaaacgggaccaaggcttccatgctcaataaacttccacctgccctagagatgcagtaatttccctccagcaatcagagcacagtcagacccagatgtctgagttttcttttcgaaaatatgaccattgtgatacaaacccattgggtaaaattttaaaataataataaaattgtggttgattgttgtgaaaacttccttacccttaagtacttagtgctatgtatgatctgagatttcctctggggagatcaacttttttcccctggattttatgattgtttatttcctggtttccacaaccaagtttattcagaagcttaaatgtgaaactgttctcaaaattatgtatcttttccttgatttctctattaacactttgtggagttggccttgccaggtaaagcctcaaggagctttgaagctggcctgagataaaatgggaatggagtgaaaatgtgtctgggtagtactcctgcaatccaaccccacttaggcatcatttctcactccttcgtcctgtcttaccctactctttttactttggaagatggagtaaatgcacacacagtgggacaaaacttcaaacagtaaaaaagaatacatagtcacaagtaagtttcccccttttggctgtcctgagttcctctacgctggactgtaaccagttttctatgcattctaacagtccacgcacataccagtatacaaacgcacatagaaacacacacacacacacacacacatacacacacacacacacacgtgtatagctttttcttataaaatggtgacatactatacacattgaccttcgtcttgcttttttatttaataatatatcttaaaatctagtcatatcagtatgtattgcttcatttgttttagaagactattctttgtgtagctatattataattgacgtagagacttcatatcaatgaatatttaaatagttcctagttcttttctgcacacacacacaatagttgtactgaatagcacaacacatgcatttttgtatacagctatgagtatatttataagagatgtaaaattgcagggtcaaaatgaatgtccattttaaattttcatgcacattgacaaattattctttaataagatagcttccaaatacactcctagtgataatgtttgagaatgcctatttgccacactttagtaactttttgatatttgctaacatgacaggtaaaatgtgatatgtcaatgaagttttaatttgcatcttttcacatatttaaaattcactttttttctctctttctgtgaatgtgttcatttttcaattagttgttggtcttttcatgttgatgtgtttgcgctctttataaaaaaattatctttttagatatcaggcagaaaacaaatgatattttcccagaaaaatttaatttgtatgtattcaaatgtattcggtttttgggttcgtgtcatgctttaaaaaccctaaaagcccttctagattaatttttaaataccaaattttcttctaaaacttttatggttttattttttgcatttaaattcctgatccgttttggaatttattttggcataatgagtgtctttctccctttattttaaaggaaaaagaacattccccattgtggcagcacagggtcagggaaatagaaatacagagttaagtggacagttacaccatcagtaggtaaccttccctgaccagtggatttatctccctggctctaagctttttgacaaatgaatgtgttgatagaatgatgctccccaacatcaaggagttggatgaaggaaccaccttggaagggccttctctttcctatcggatcttacttgcagaatgctcttgagtcatatggacctggggcaaaacctggctttactcttgtcagatgtgatgagttgttttatctcagcctcagtttctgtatctgtgaaagttaaggacaacagttccaacacatcgtgattgttatgagttaaatgagaaaaagtgtatgatatttcctggcacagtgcccagcatctaaaagctgcccaataaatgtgcatttaatccttaattttccttttatttttttccacttaagtttttctcataccaatagaaatcaacaccggttggaaatcacagccccagcttcctgttttggccttcttctcacaacttagtcctttcacccactcttctggtatctgggaccctggcctctatacccgtcagaactcactgtggaatcatgtggactttaatgtgaaccactaagcttgaacctgaaattacacctgaatttccccaacctcaggctttcttgtatcaatactgccatcattgcactggttccctgatcatttccttgactccagccttgcccttctttcccaaatgcatgctagagcctgctgctaaattggtcttccagaaacaaatcggatcacaatgctttcctgcttaaaggctaaaaccccagtggctttgcatgacagacagtgccctccatgatctccctcctgctggcatctggagcctttgatttcttgtggatttcctgaacacactattaattttcctgtctcagtgactttatccttggcattccttcaatccaggatgcattttgccttattttttagtctagaaaatgcttattcctcaagagcctactccagcttcctcctcctgtgtgtttacacaccctcccctttgccctctgtcattaccttgctttttcttctgcctctaaccaaggaaagtggctactccctctttgagtcaccactttatacatacaccaatcacgacaccagctgacacctccattactcctcacatactatgaaattatttacacacgtgtctggtcttcccttgactgtgagttccttgccattgaggactatagctctatttactcctattgcatgtcctagcacatattaaacactaaaattatttgttaaacatattaatccatcaatatccagacattatctagatttccaggtaaggaagtaattgtgttaggatttccagactctggaacatatcattttcaactaacactgagatacctcaagaaaaaatctttcatttttcttttccttgtcaacatttcacctgtcgtttggtatttgatgacatgagcttataataaaacaataaatcaatattgtgcttagatagaaagaacacaatgccttcaaaaaaacagtgctaactgtcaaagtgtgattctataaaattgtttgggttttttttttttttttgcattacacagatatgaaaataatagcttgaggtccttttggctaacattgtgcattttatattttactgtgagatgtcatttttgtgaagttgatttgtggttatctacttgggagtaaaaagtcagaaacattggttacaattctaggaactataattattggtttaacttaatttttggaatctagaacatatttaaaagtaacaggccaggcgtgatggctcacacctgtaatcctagctctttggagggctgaggtgggcggatcacttgaggtcagaagttcgaaaccagcctggccaacatggcgaaaccccgactctactaaaaatacaacaaatttagccagatgtggtggcaggtggctgtaatcccagctacttgggaggctgaggcaggaaaattgcttgaacctgggaggcggaggttgcagtgagctgagatcgtaccactgcactccagcctggacaacagagtgagactctgtaaaacaaacaaacaaacaaacaaaaaaagagtaacaatacttttaaccatatggctgttactgaattagtttcataatgtatggagaataacaacaaatactctttcaagctaatctacggccataactctaaacagcaccctgaagagaatctggagtttaattttgaccgtccttgaattgtacatgttcagaatggcatggattaaggacatttgggtgctgatttttatattgatgaaaaattagactgatgtatttgtacatatgtgttcatggtaaatttccagtgacaaacctggagatgccttttgcagattctaagggagtgttctttcttttgaacaagtgctttatcttgagaaaaaaatacaaggagcaggaaggaagaatggacacccacttgggcagcccagttagctgaaccagttgtggagtttggtgagttgatacatcacagttcaatcatgcccagattcataagcaactttcacacgagaaatccaaagactacaatcccaaaactagatttttgtgataaatgcagattagattagcattatatgttcatagctacttgaagtgcaaggactagacataagacctactgaaaatgctattgtagtgtgaagaattggtcggcaagtaaaaatcagagttttataagtgactgcgattattgttaccttattatcccaactttttgcctttgctaccaattgtactaagtttacataattcacatggcgtttagatgtacagacattcaaatcatctatttctacctgaaagaccaataactcctcctctagaaataaaattgcattatatgcaagtgagataagttggaaataaatcatcacctgagaacactgaagttggggcgggttggagtgaggaagttgctattttgaggagtacagggctgatagctttagcactatttgccaagagagactggagcatttctcataggaatcagagagctaaataataatggtttgacttgtttcatgttcttttttccccccactgtcttcttttttcctttctgtatcttcctcctcattccttattctctcatccttcccttttcattttccttcttcttcttcctcctcctcctggagccagagttcactttgcctagaggcaccaagtgggcactgccttctccaccgatgagtcccctttgtagagccagagtacatccattcagagtgtgaaagtacattcactgtgtgtggttgatagtacatttcactctattctggaaccttaaaggaaatcacagtgaatgtaaagatcacagtctcagagttagacaaatctgggttcacacctctctctccacttagtatttgccactagtaaccttaggtaagttgtgactcagcctcgtgtgaaagagaacagtgatccatccctacctgaaaaaatgattgtgacaattaaatacaatgataaatttcagtatgtaacatagcaataaagcatgtttgattaatactgttttctttctttatgccgtgtcacattcaagtattatctatttctctgttccaaacactgcagtatgaactaatagcagatcctattgttaaagagtttatagtctggtggggatggcgatgtatatacaagtaacaattttgctgatgtatacacaagtaacaatgttgcaagccactgggtgatatatgctgctggcctccagagatgaggggatggtccaactctctgtgcctctccaggtactgcctgcttcaaggaaggattcacaaatctggttgatcaagttccaaggtcacatcagtcagtttgctgtgtgttcaaaggttttgcatatggagacagaactctcttttcttccttttaggttgaaaacagtggcccactttcccttggggagtcactcatcttatactttctttggcatttgcactttttttttttttttttttttttttttacagagtttaactcttgttgcccaggctggagtgcaatggcacaatctcagctcaccgcaacctccgcctcccgggttcaagcgattctcctgcctcagcctccctagtagctgggattataggcatgtgccagcacacccagcaaatttttgtattgtttagtagagatggggtttctccatgttggtgaggctggtcttgaactcccgacctcaggtgatccacccaccttggcctcccaaagtgctaggattacaggcgtgagccactgcacctggcctagcatttgcactttctttcatttcactaagcatcccagagtgtggtaaatttcaagtgtaagtttaagggagagaaaacagacccattgggtctctatccctgaccatgtcccaggttccagttcccatgattctgctttcgggagtgccagcaaactctggctagcagaggagagagcattctcctccttgctcatctcagtgagtcattgtcctgtgcctttatctcccttggcacctcatggggctgtggccaggtgggcagtgtcacaggcaggattggggtgctcccagtcacctgaccacaatacggcctcaacaccaccaaaattccaacaacactgctaacacatatctttagaaacatacagtcaaagtacagagatattcccaggaaaggcaaattatatccagcaaggggcatggcaagggttgagtaggcagctcagattgacaggggaaggcaggaacttggcctgcgctcaggggtcggggtatgaatgatccagtgactctggtccacactaaatgattgtgaagtttccccctagaggaggaatgcatgtgtagtccaggtgtaggcatggtatctacattttagcaatagttactaatgttttgttccatagctactcttttttgacatcctggaacataaggactattttatttacctctcagaataaagtttgcagcagtaaggtctattcttagtgcacctagttgggacccaagataataacaccccccgccacacacacacacccaaatttaagtgcctactctgtgtttatttctgatctttacaacagccctggatggtgactattacctcattttacagaggaggagttgaggttcagagaagtgaagtggtctgtccaaaggtgacaagttgcagaaccatggttcaaacttcagatctgtggctccagtgcctttattattatggcctctgctcacaactttgcctacttcaatccatgcaaaaggccagcctgttttgtgataataatacctgtgtccattgtctgtcaattgtttactcaggcaggcagcagggcacgtgccattgagtttccctgtaatagtcatggctgggctgaatgggtacatcctctggccattgcacatctgtgacctgcatgacccattggagggggagggggctcccacgtcttccagggataatgaccccactcctggcttcatgcgtgttttgtcctccctctgtatgaagtcccagaaagaggtggtactggaagacaggatgatccagttcattccttgtcttttctgtcacatttccgtgtctgtcctcttgcccatgatggtagatcataatatttgttcaacttctctctcaagatgatcataaagatcaaatatgattatggatataaaaacaacttctgaagttcaaatgctagtattatggtttgtgtcaaagagaaactggaggaggcattgtgtctcaatattagtagcagaagcatttctgagggatccacagagaatcatacatagctttttgcctggatatcagccctacccctcagtatcctttcctagagtgcagtggaaaagcccatcttgactagaattcagctcaagtcaaaggaaaaacccaatggaaaatgacttctagataagctgaaaaaataaaataaaacccccaaagtccttagcagtgattcagttttccttctgaaagagagaaaaattattctactaaatgccaaattcccactacacctctcttcgagtgggaggggcattgagaccatcacagtgcaccatcctcagccagaagcacctttcttgagcatgccaggtgcaaggtcctggcagatgtagctgaggggcaccatggcagatggacccctggttccatctcaccctacacttccctttggactacgtgaccaagtttggggaccatcacccatccttcctaacccatcttggttagtgctgctgctgccttctgctgaccatgtccttccctttccagatggtctgtctttcctgctgccttggacaagctgatctgaaataaacagccaatgtagggactttgcaggcagaatcaccacctccatcttcagtgggcctgtgatcatctcaacagattggtcaagtcagtgtgaggagaggaaatgggctttataatttgggtgcctgcgcagacttttattgctatgtctttattggctatctttgttgccaaggtagagttatatcctcccaaaatataatggcaggctattccactttgttgttgtttcttcctcaaagtattagactccctcaagacctcccacctctatcacttccaaaattaaggtgagtaattagagaaatattggttttatcgaatgactatcaaagaaaagagacactcctcctgttatgcaatacgttggtctagaaaatggagcatatttttacatttaagtatttttatggcaaatttaattatttgaaatacactttgaaatctcaatgacagcaaaaaatacagaacttcttttatgatgtaaagtcacatttattgatatagatgtatagatatagatattagattctcttagagtaccatacctacattcatggataattcgtagcatcaaatgctggtagtaagtcattgaccctcaaatgagagcaacatacaaaataaaacccaaatctagacgacgagttaagttcttctgaggcacataagcccatcagattaccttctaagttttccaagaaaaagcgataccagtaaactcagttcttaccaccttaaccacactatcaatgccctaaattccccttaatttgcactgccattgaggcctgacacatgtcattcaacacttgctcacatgctgtcattcccccctcttgctactgttgttctcagagcccaattggcctccgagctgtgttaggatgagatcatgccttattgtccctgtggtctgtgtcatggtgctacagagtgctgcatccaggcatctgggctgtgtccattaacatcaaatttttattctgctacatagaaatataatccagtggttctcaaatactttgcccacaatcatagaaaaaaaatatagaaagaaatatattttgtatggtgacctagtgcatacatacatatacatattataccataaactagtttcacaaaataataattatctttatatatgagatggaccttgagctctgatattttctattctattccatttcaccctgtgaccttttattctattttaatatactggatgtgacatttaaaatagatttcatgacaaactaatgggttacaactatcaatttaaaaaacagtaccaggatatgtctggaaaggtttatcccctgcccacaccagagccactccctggcagcttctcctacctcctacaccacctctatgttcccaggtgagcttgtgctaccttcggcttcattgtggatgccacttggaatgcctgatgccttcaataatattctgtccccagcaaacagatgaatggcaaagaaagcgtgagtgtggggaagccacacttcctttcacttctgcatttcttttttcctctacgccacctcaaccacaggtggtgctagaggtagactacacttcagggttggggagacctgaaaggaatttagacgttcagttagaaaagtttatcaatgcaagcttcactgactatcatcttaatccgagggagtgcaccaaagaaagtgaatttcttcacgtggggtctccttatggacaaatctcaatgcctagccatggcctccatgacacaccatatagttcccaatacaaagttagtcagcctggccagcagatgctgagagcttttaaaaatacccatgcacagagctgcacacccagagattcacattgaactggctggaaatggggcttggacattggaatttttgaaagctccctatgtgtttcttttttttttttttttttttttaattttttttttttttattatactctaagttttagggtacatgtgcacattgtgcaggttagttacatatgtatacatgtgccatgctggtgcgctgcgcccactaacgtgtcatctagcattaggtatatctcccaatgaaagctccctatgtgtttctaatgaattaccagggctgaggaacattgggattgattgacctgactggggatcttcaagagggaagtccaatggggggcttttcaagatgttctcaccccgctgaggtgcacaagaattcttcctgagcacatagatgtgagctatggaattagacacacagatagttctccccaaaacaaataatcattagagtcaatgaagtttacatacatgttaaggaagaaaactgtcataggtaacataatatgaacagccccttttgttattataaaaaattgtattagcctccctaccctcacctccttattcaatctctacttcccaggctggaaatttagaccttcctgcataaaatggattttaatcgtacagctacagctctctagttgcttcagctttggagtattttcttctctgtatcttaggttagtgtttctctaattttattatgcacaggaatctcctcagttcttgctgaaatacagtttctgattcagtaggtctgagaaggggctctggattctgtattcctaatcagctcccaggtgatgctgttgctgctggtctactctttgagtttaggccttaaaacagattggcttctggccacagatcccctacctgactgctataagcaggtaaaaagctatgtgggagtttgtgatggttccatgaagtatactcagagacctgaggtcgagggagagggagggattgctcctctggctatagagaagcttctttcagcaaattggccttccgagtcagggccttttcagcctccgcagcttgtgggagggtatggggcttattggaaaggccccagttctcactgtagctgagaccttccctctttgtctccccttggctggttgactttgatcttggatctgataacatcaaaagcatcatggtttaggcaccagcatctttaggattggagagtttaataaacccagggaacaatcaccagtgactacataaagagcctacttctttatagtagcaacctaatggctaatttacataaatatataaatgaagaaataccaagaagttaaagaaagcaaagaacttctaagcagaaaaatgtgtattgctgttccttactagaatgtgaagatccaatttgacacatttggctccctctggatttcctttagcagttaagatcctggctaatttattatgttgttactttcctattcagtaatttgctaaaaccacgtcttgattacatgtcttcttttctgatacccagtcagcctcctatctgatgaggctctcttagcaaacccctccactcctttcagctcttcaatggagcctgccttggccacagataccccacccccacaatgtctttttatcagggagctcaatatcctatcatttgagctcagctctttctggctaacttcctaaaggatctattaggattataaaggacaggatcatctccctcaacaaaatcaaacatggtcctctaaggtcctctctaaggaaaaggggagaaatttgccttgcgacaaagaactgctcaacttctcagcgctgatttttttatgctctcttctctcctcgcctgccgagagccattttcctgttctgaaagctgctgctgctgactgcctacccctcaccacaggtcttagatgctgcgtacctccctcttaacattcttgccatgtgtgcaaccacaggtgaatctacaatctgctcagcgcacagctgagagagggtgggaatatttaaacaagcctttactaaaagccagagcagtgaatctcaaactcatatgtctaagaatccatggaaggatattaaccgctttaatatcagataataagttcctaaacccaaagattccgtttcagtgggcctgggatggttttgagtgattctgagcaacatggtccgagaattacattttgagaaacactagcgaagagatttttttaaatgaggaaaaaaataaaaagaaataaactgagagaatagcatacaactaaatgggatcagtttgtaagtttgtgttctgaagctctaagatcccattacgtcctatctccaggaaaatggaacatcaacctcttgggcatccgtgacatatgcatcgtaccccagaaggtatcgcctcttcctcccagagttcacattctaaataggcaaaataaaatcaaatgaccctaagcattctcctcccaaataacaatgagctgcttaaaatcttttctggaatgagaactactcatataaacagataagtagcataatttgttttatttacttgtaccttaattgcatgctgtgttcagcaggcagtggatcagattcaagaggcttcgtaatttcccttttcctagtgacaaaggtgaaaaactgatctctacacttaataatgtttgttttggggtgaaggaaatggattgacatttcagaaataaatgtattacttggaagttgcattttaatttagttacttttttaaattatggtcttagattctgtaagtttagtatataattgaaaataaggaaatattctatttttgttcaagtataatcttaatacaaggaaaaactcaaatagcctggaattttagataatgaaacttgaatttaaagcagattgatggatttatggctggtatctatctccgaggttaacattgtattatggcctacaaagctaaagtgttttagtttgagggtgttccatttgagaaccttggattcaaggcaatgagaatgagaaaagtgtttgtatgactacatttggctgggacaaattctgttggatgcagggctgataagttagcccatgtgctatagcagagcattagccattcagttgttgaatagtgaggacagatagagggacaggatagtagctgggactttggtggctggggacagcttgaggcagaaactctttcagaagcaattcagaactgattcagaagtacagtgtttgaatattttccatcaactccaatttgcactagaaatggaggagaagaatgatcaattccagcctctatatgaaagaagagaaggaaaagataagaaaaagagaaagcaaagtaaataaatgaggatgtcttacgctgtgctactgagcaacacctcactatagaatactgaattgaaataaatacaattttgctcagcttaatttttggagccatctcattgttctaaagaaacaaatgggaggagtacaagcttaaattagatgaatatttagcatttacctgaaatcacagcaatatgtattcatggctatcatggtctgatgtgtaagttttccgtgttcatacagttaattatattttttggaactactccaaaaaatgtaattaactatatgaacacggaaaactcttccatcagacacctatagggaaatgaagaagagcaaaaaatctcttcttgcagacacctaaagggaaataaagcaaattaactacagcttaagccctattacttttgaactggtaggagaaaaactcagaggaaataatgtaatttgtatgtatgaagtactgatgtatatgtggtaggagaaaaactcagaggaaagaacataatttgtatgtgtgaagtattgatgaatatgtggtctatgacaagtatggtaaaatgaaagtccacaaagaaataaattagcagaagcatcatgtctcccaacaaatatggaaccactacacttcactaaagagagtggcacctggtgggaaggggcatagaatttgtaactggccaagattaaagtgcaaatcatgacattgtctcttaaatgctttataatcaggagaaaacttattatgtaccagtttttctttcctaaaaaacaagtatcataagcttcaggttgctgtgaggattaaattaaataatatgcataaattgtcttattcgtaataagtaatcagtgaaagctagctacaataatcataaaaaattaagtagtcaaatatggaagcatctaggaaaaatccagaagttgattaattttatggaaattttttttccattatagcctttgtatttatttatcagatgagttttcagcagatgtttgtcacacatcttgctcactcagttctgttcttgtcagcatgccattgtcaaaaaacttatgagtagagtgatattagagcaatagaatgaatccacctctcttactgagatagtcaaagagataaagaacctaaatgatattattttcttttcagagtgtatttgcttataagtcatttctggtctgtggcataaatatgtgaagaaaaaaaccctgaaatataaaacatgtatttattaatttattacgcttaaggttaaaaaaggtaacacaaattttaattagtttaaaagacaaaaaggaaaaggaaaaaatgtttagcctcaagtaccagataaagactctgatccagtatttgtgttgagacaaaggaaactgtagagaaaagaaaaatagagcagcaaacactgaaataatcccagaagaaatgagatcactggtcacatccaactcagctgcaaatgcagcttccaaccccaataatcagccctaacaggtgagttgagggctttattgcttgctgtgtgaggaaaaagttacctttctgagcttgagtcctctgaagactctaagaagacacctctgtctttctctcatggttttgccatcagtgagaacctaaatcattggaaggagctagagaatcaataagtttggacttcttcagttccatattataaaaaactcatccaccagttagcacattttattcagaaatgtgcccattatagtatgttattgcccctgagaaaatacatccaaacagtacttaaagaatctggggaagcccagtcatcaggttgtttgatagactcacatttcaactaattgggagagcttgttcatcatttctgagcggtatttttcttccaaacatcattttcaagctcttcaaagttgtacccttcaaattttcttaaaatccactcatctttgtgtacttcaaactaatttggtacttctgtgagtttcctatggaaaattctctaaattcacacagtatggatctggcagggcaaaatcaatgaaaccagaaacggggattagttacaaggattcttgtccattctccattcatttttaactaggaaatacatatgaatcatctaacaagggtcaggcattgttatacacactagggagatagggagaacaggacacacagggcccctttctgctatatgcaagcaaacaaaaacagacataataaaataatgtaggctaggataggagatatgaagggaaaaaaacaccaaacaaaccaaggggtttagagggaaagtcacaagagagtggcttttagatagggtgattagtgtggtcttttggaggctatgacatttaagctgaggcctaaaaaggaggggatagtaaagagtgagtggaagaacatccagacaatgagaacagaacatgcaaaggccatgagttgggaaagaacttcgcttggatgcagaagaagcagaccagcaagggtctattgcagcattaaggcagtagacactagtgatcagatcagggtggtggcaggaaaggttcagggcagtgggtggagttgagatatattaggggtgggactgacatttcttgtccgtggattgggcatgagagattgagaaccaggactcctcccaggttgctagcctgagatgcggggatggtggtgccatttactgagtaaaggaacaggttttggaggaaaaaacttgtgttccattttagacatgtaaggtttgagataactgcatgacatccaagtggagttataagacagacagttctgtacctgtgtctgaagctcagagaggggagtgctctgatctgaagaaataactgggaattgtcagcctaaattcaatattgttattgaatccatgggaatggatgtgatttcccaggaagcatgtatctaggactgaggcctggtttgagtgaatgtaaagaagcctctatatatggtactcatctttgatggttctctccattcccaaaagctcagctgaataattagtatttagggagaatcctctggaccctctaaaatttttctctggactaagccaggccactgactgtattttgatgctgtacctgaacacagaatggcttttattagatcatgctatcagcctatactgaagaacgttataagaaatcacgcaagaaacatcctggtgtttcgcagcaggagctactgtttcccctactttacagaggaaactgagacacagggaagttaaggaacacacgcttagttatgcagcttctgaattttcaaccactttattatatcacatcaactaacagaaatgataatcagtctagaggaaccacttaatttgtccttctgaggttatttaggggcaagtggaagaaaaaaagtagagaaatctggagacagtgcattcacatcatgttcccaccactgatggactgaaacagaaactgcccttcctgtctctggcccagccctatgttggaaagccaacccataaacagttcagtacaactcccagaggaggtattagcaaagtttcctgtgtaaatacctgtctgcttcacaagtactttctaatgagaggaagataatcaatagcaatgaggcaatagttggtcaccttctatcttaccacttctacttttctatttttcttttcttccaccttaccatttctaccaattctccagcttcttgtcttcttgcctttctccttcttgttctttgagacagggtctcactctgtcacccaggctggagtgcagtggcaccatcacgcctcactacaccttggcctcctgggctcaggtaatcctcccacctcagcctcctgagtagctgcgaccacaggcaagtgccagtaaacccagcaaagtttttttgtatttttttgtaaagatgggatttcactatgttgcccaggctggttgtaaactcctgggctccagcaatccacctgcgtcagcctcccgaagtgttaggattacaggcataagccactgtgctcagctgtttttcttatttaattttcattttctactgagttcttttctcccctctttaattcctttttcttatttcctatgaatgtttagcctattggtgttctctaatctggattttcttcttaacctaggacagatcttttcaaattttgttcatcttttttccaactagtttcaaaatgcagagctgagtgttctattttacatataccaacatttgtatgcatgacttgttatttttatgctgttgttacctgtgtcctttatcattgtattctgaaaatccataatgacaagtgatcatgtcaggataactttggttcagttctgagcacatgagtacagatgtttaaaacatgtcagataaatgagataaaaagctgagttgatcagattagttaagagaaaaggccaggcacagtggtttatgcctgtaatcccagcactttgggagacagggataggagggtcattgagcccaggagttcaagatcagcctggacaatatagtgagaccccatctctacaaaaaataaaaaattagctgggcatggcagaacgtgcctatagttccattacttgagaggctaatgtgggaagtttgcaccactgcactgtagccccagcaacagagtgagaccctgtctcaaaaaaaaaaaaaaaaagagtgattattttcctcacagggaaaaattcttctccaaaaaagaagtgctctgaatatatgtagatttttgtttctagagtgttttacttgacaagagaggtcaagagaggaaaaatggaattctaaattgcttcataacctttgcctcctgaagatgagcaagaaataaaaataaagcatttcagaagttaagacatgactccatgaaaatgtgttttgattcaccaaaattttcaggaaagcattgcttgtgtaatgccagagatcctatatcacaaaattctggttaatcattaaataatatctttttaaattaaatgattcctagtacttgctgtgtccctggcactgggctaggtgcaggggcagcctctgccctcacccagctgtgcagggagtgtgagagcagggctcagcagctgagacaccgtgtgtgaaaagtttcctgtgagatttgcacagttgtcatgggagggacgtagtgaacggaaggaatcagacagattaaaagatagtgcggtgggagaacaacctaatttgggcatcatccagtatggaaaggaaatgaaaacttgaatgcaactagaaagatatcataagaaagactgctgactttttcaagtaatctcagagcaaacacaatgcttttgttattctcttggttggccacactgagtgtgtctcacgctgaatccatcagggcaggtaagcaaagaaatcaaacacggaatctagtgaacaaaagagttggggctaaacagacagctctgtgataacaaagggaagctccacgtcaggggttcatgtgagcttcttgggaagaggcaatagagacctaaagacaggcgtgcatggatgtaggctctctcttcccactgcctggcacgctgggctccacccagtctttcagcatccacttgatgttaattaaggctccagttcctctaatttagtgcttactatccagttgttcattgccccccaatttctttttactttttaatcttcatttggcatctaactggcagtgcaaacttctggactcacacagagatttcttccagcctgtttggaggtggagaggcctgggatagtgggttctggcagaagctccactcagtcgctaagtctcctcactggtcctcctgacaaatgaaaggccttgagatgggtaagagtcttgcctcaccagctgagctgtgcattctttacttctggatttacttttatttattctagtagatgtgtgaaacagcctcaggcaattcagggtctctctccctgccttcctctggtctctctccctgcctcccctcttttggggagagtcacacagagccaaggtgagtttagggtgggccacccttgctcccgcttggctttgagtcttcatccatgcaggtccatgccgccctatcccaccagtggggcctcctcaggctgtctctcagggcatgttctgaagccccctgcactgtcctgggacactgctgagctctgtgaggctggctcaggggctgctacccaggcttcctgcagccatttcagctcaagcccgctgtgaggcttggggcagggtctggagtcggaggtgtcagggagcacactgcgactgtcctgggccacacttccgcccctagctcaccctagagtacctgccaacaacccgtctcctgtgggctcctcccggggacccgcatcaatgtctagttctcttccttcctctggctgcctccctttcccattgtaaagactgctgttatctacaggcagggaggatcctgctatgcctgatcagattcctccaaagctatcaggtatgcccagagctctttcccatcaactctgaaggtgaacttctgcattctgtggtgtcacagccgctctaagcaatgacaactgcaggaattataagggacagagcctcagtgaatatgccatactatattgtcctcacagagctcacacagttgaaaaggactttggagctcatccactcccaatcctcagctatgtttgggtctttctagagtatcccatactttaatggcaggaaccttactcggccctggacagccccttcagttgctgaacagtgccatctttaccaaagtctccctgtgacatctggacctcagtcaggtctgtccttggcgtcacactcgatgggtcttctccatgttcctttgatgctcctggatgctcaggccccagctgagcagcctggaaaggaaaggacccccaaccacaggaaaaaggctttgggcagagggtgtcagcctgggcccagctgagccattcctgctgcctgccctgtttcctggcagacctctgcctcagggattctgcacagtgggaagttcgctacctgtcatcgagcccatctgtaggcttcccttgtgctgacagtgcagcctctggcttctcagccaggagcagcacagatgcctgggctcaccccacacatctaacatgccagtggatctggcattctgtactcacacatttgacaaaagttccttagattattgtagcacataccaaaggagagaactctgctataagtgattgggaagcaatttgccaattgtaaaattaaattagtagtagaggtaaaatctgtgcattcagtgacagttcttcattagcagccgactgttaatccacagctttctatcaaatgaactggagcttgagtcttcaggctttcactgatacctaccttttccttttctctctccttctctccatccttttctcctcctcgtccttccttcctttcttaaatgtttaccgagttcctatgtgtacaggcagtgggctaggtaccagatagaaaatgatgaatcagaccaagaccctggcctcaaagagctcacattcagaccagtgaacatattaagttttggaggttgtatcagttgtctattgctgtgtaacaaatcacttcaaaatttagcagtttcaagccacatttaatgtctcacagtttctgggcaccaggaatccaggtggcttagctgggtcctctggctcagggaccctcacaaggccatacttaaggtgttggcctgagctgaagtcatctcagggctcagaggtaggaagagccacttccaagctcatgtgactgttgccaggctcctcgctggctattggccagaggcctccctcagttccctgccacatgggcctctctagggagcagttcacaacagggaggctggcttcccgcagggtgagcaagccagagagggcgagcctgaaagcagccagcacttttttgtgtgacctaatctcagaagtgacatctattattcttgcgacattctatttgctaggagttattgggtccagcccatgctcaaagggaaggggttacaaaaatatcttaaacaaattgcactgcagaagctatttgtgtgacacgtgattaatgaatatcaggacatgggggatttgggggcatgttaaaggccccccacagtagaggtattgtcataatgtgtgtgtgtatatatatgtgtgtgtgtgtgtgtgtgtgtgtgtatatatgtgtgtatatatataatatatgtatatatatgtgtgtgtgtatatatatatatatatatatatgtgtatatatatatatgtatatatttttttttggacggagatttctcttagtacccaggctggagtgtaatggcgttggtgtgatctcggctcaccgcaaactctgcctcctgggttcaagcgattctcctacctctgcctcccgagcagctgggattacaggcatgcaccaccatgcccagctaattttgtatttttagtaggatggggtttctccacgttggtcaggctggtctcgaactcccgatctcaagtgatctgcctgcctcggcctcccaaagtgctgggattacaggcatgagccaccgtgcccagcccataatatccttaaagacatttaagcctcaaatcaccgggcccgaacacagcaaattaaaaacatcaattaccctttctttaagatgccataaggaaggtatgtgaggaaacttccataggattagactaaagccccaaataataaagatggttccttattcctgttttcctactttgctaaaaggtacactcagatgctgtctctaatggagaattgggataaacttcaccagtcctgcttaatcaagtgtatctcccctccaaaaaaaaaaaaaaaaaaggaaagaaagaaagagaccagtgccagtgagacaggtaggggatattcaactgtccctatttcgttccagaaaaactaaggcgttacaacttgcaatgtatctggtttgactcaatatgttttgtattcaagtttccaaccagcaaaatttgtgaccttattaagaatactagttcatactcagtacccaagagaaagatttccattccagaatctagtctactagcttggttattattcatttatagtgtcagatcagagaaagattgaaggcattcctaattagttgccttgggatataacacatttgaaataatatcaattgatatttcagtgtctgttaagcctgatttatagggacttgtgtttcagtctaaaagattaatcatgtgtcacacaaatggatcctgcagtgtaatttgtttaagattttttaaagtatattcacatgtaccatcatttttacagaaacaaatacagattggaaatatctaagtattttataaaggacatatgatacttcaccaaagaatcccattattttaattaacataattttctgacgttgacgtgagacccacatgtgtagattctaactcagtctaacaagcataagtgcttgcaagtcctctgagagaaaagtcacaggcctgagtctgagttaagggagatgtcctcattgcctggccagtttcctcattgacattcaacactccatttgcctgcttgcaaaacaaaaaagttagccctgcatgttgacctacctgaaaggtctttgttaattgaaatactgctgcaaattcatagtgggtttttttttaagtacaaagacaaaataaagccaaatcatacttataactcaaaagttagaattgttttgctaattttgtaaatgagcaaatttatcttcttaatcaaaattcagtttggaaatattccatatcatgtacaggtttctaatactcaactgcagccacttttgagggactcgattttgaatcttcagagtatcagatattgtttttcctcccatcccattattttattattctaaagtgcttgtaatttcatactaaagaaaatgtgacccgagggctggccatggtggctaagccctgtaatcctagcactttgggaggccaaggcaggtggatcgcttgaacccaggagttcaagaccagcctggagaacatagggagctcctgtttctacaaaaactaaaacacaaaaattagccaggcatggtggtgtgcacctgtagtcccagctacttgggaggctgaggtgggaggatttctatagcctgggaggtcgaggctacagtgagccatgatcatgccactgcactcatgcctgagtgacagagtgggaccctgtaaaaaaaaaaaaaaaaagaaagaaaagaaaagaaagagagagaaagcaagcaagaaaaaaagaaaaagaaagaaagaaagaaagaagagaaatgtgaccccaaatgagagattactgggaagaaatgcttggaaacctgtcataatgcataacttatggaggaatgaatgtgaacataaaaactttcattctgcaaggctagtttccaaaagaaacacatcaagtaagaccaaggtgagaccacagaaaataacttaaattctgttttcattttttttttcaagaacttatttaaggtttaaagttttctttgacctctacgggggcagggatcatccacccaagttgttgatgggacaatagaaccccaaagaggggcggtgacatcagcagtcaggtaccaattaaacccacgtgctctgattttttcctcactacgttttgtaaacccaagagcctcctatttttcaaatttagaaattaagcaacttttgaagctccctttctctgggctttctgtacaaataatatactaaaatgcagcacaagttaaatctacagttatcttggggatttgtcatcactggctccacaacgtacactgtgggtttctaaataaacttcccttactggctgcacaagtttctgcagaagtgtcttttagtagcctaaaaaagaaaggctggaagagcaatgtttcttttgaattctctagcaattatgaaatcctaaagaaacaggtccaggttacaagagagggactgtggtgtcagaagtaagtcctaagaataattactctagttggctctgtctttccagagttacagcaatagggagttccttgaacttcccactcaactggcagatgcctctggcatgttgtgatgtggtgggtgttttatttgaaatggtgaagtgaaagaaacaaacaaactctctatggccaaagtcacaatgaaatacagatttatgcatgagcatgtactcataccacacattctctctctctctctcacacatacacaaacacacatgtgcgcgcacacacacacacacacacacacacacccctgttctgaaactcgattatcttatcaagactggatagatgtctggtgcttcttaataaaagtgttgaaagtttccacagtgaatttgtttgctggtcaaaaaataggctcatactgcaatgggtggaaactttcaagtggggacagttagaaaaggaagtcataatttttgagctgtaagagaaaattttttacgagaccctcaagaactcaatttcttgctttttgtatgacaatgtaatgtttcacatacttaatgactgcatgacatgtactacaagattctgttttttctttatgtgattccacctattaaaaaagccaccagagcctatctaatgcttggaatactgtttcaaacttttaaatgatagagagtgctacagcaactttctccgatagaagtataatgaagctacatgtgtaaatttaagttttctagtagctgtatttaaaaagtcaaaagaaacaggtgaaattaattttaataatacattttatttacccactgtatccatagtattatcacttcaatatgtaatcatatatcatgattcagataccttatcaatatatcataatgtaaaaggtattattttatatttttatactaaatattatatatttaattatatatttaataaatactatagtttttatactaaatcttcaaaatctggtattttgtacctaaggaaaactcaatttagatgctaaagttttatgagaaatccttaatctgtacttagatttcataaaatttactgttgaaaaagttgattcatgtttccaagttgttccagacacagttaaaataatttttgtgtgtaagttaattaaaattaaataatattaaaaattcagtttcttaattatgctaacgaattattgttgttttgagtaaacaacagccacctgtggctagtagctacctcattagaagcacaggtttacatcaatgaatccttttcatctttgagccaccatagatctcactggagatggatttattttaaaagattaaaacttttggcagaatgaggcttgagaatttttttgattacttcgtatcatccctccacttgaaacaaaccaccatcaccaacaacaaagctaaggtcatgacataatttggggtggtcatttctgtccttccatcagctaacagcaagaagggaaggagaaggggaagggaggaattgtgctctgagccatgctgagaggacagcagggaagccagagcaggagcccagaggaaacctgctcgctcaccaggtctcctctctggccatggtcttctagtctcctccctcatcttgcctcccaatcactgcaaacagccttgcagcaacttacatctctgcaatttccttgagagtcttttgggaaagggtagaggttttcaagaaaattagaaaacattgcatatgcctgtggaaattattatattagttatccctggtagggtttttctctttccatttttttttttaattgaagggagagcctgaactggctctgggctggagttccagctccctttcttcccacctgcattgccccatgccagaaaacacagctcactttccctatcagtgaaacatggttttgatgaaggttaagtaagttggtatttaaaacatctagaagcatgtctgatgaatggaaagctctcaagaaacagtagagtttattattattgttttacactatggattcctataaagtttttcagcagagaactgtataactactatatataaaatatgaatattttaagcacagcacatcccacagtgcacaagggactgaatgtcttttataatttggcaaaaagcatttatttttaaataaaccaatattgggctttttaaaatatgaatgtgcctcacagcaccattctagttttatcctgaagaggtgtatatattacttgcagaacttctttcaaaatcatactgtttgagtcattctgttggtacttattaaaaattaatgtggccccctgcattgcaaaagaaaaaacatgattttttccagtggtcactcatctgcttttctctattagcttatgcttttttccttattttttagcccatttctcctctcctcagctcaccagcaccttatgatatgatagtcctcagtctgtggctcagaggggacatcagaggccaaacgtccatgagtttaagaaaatgtgcaacaatctacaccttgtccatcctcccccataacccattgccactggttttgaaaggaatttcaaaaggtgaaggcctatgactaagcaatcatttcctcccagtttatcatctcagatcggttgactgttgctgctttgggactaataagatcagtgaccttaaaaaccagcatccaggagatcaaaactgagccaggacaccaagagaacaatgaatgatttgcttatgtaatgctgatgaaatcatcactgtggtgggtatgcaccattatgtgaatttatgtcatctgtaagtgatcaggttagctagaaggtgggcatcaccatgttatgtgatatgtacggcatgccattatagattatactttggggcaagatcctgagatacttaatggatatttagttgcaatgagctttctatagatttgtcagagttccagaaaagtggaaccggaaatgctatattaaaggcaatggtggtatggtagaaaaagaatcttagaaaatccaagtttgtgtcctatcctcccacatactagtggaccattttactccattggagcctctatttcttcacatgtgaatgagcatcaaaatagctataccatggtgtttgtgtgaggattaaacaagataataaatgtggttttctaggactgttcttaagcttcagtgttcggttactattcatttcaaatttatgtaattttatttaaccagatgagaaaatgttcataatttattgttaaataaaaacagtatattaccatattcaaaaattatgtaaattttgtaatcaactagtcacatcattgcatcgagcctgagtttctcccagctctggggctctagatacgtacatccagctgcccatttatcatctctacgtggatctcagacttcacatatccaaaaccaaactcctaactcctgactcaccatcccaacctagcctgcctttctgtagccttcctcacctcagttaatgacagataatttttcctcatgcttccagtcaggaaagtctaaacttagctgggcacactggctcatgcctataatcccagtgcttcggaaggctgaggtgggaggatcgcttgaggccaggagtttgaggccaccctgggcaacatggcaagacccccttctctacaaaataaaaataaaaaattagctaggcatggtaacatttgcctgtagtcctggcagctcatgaggcttgaggagggagcattgcttgagcccaagaggtcaaggctgtagtaagctacagttgttccattgcactcagcctgggtgacagagcaagactctgtttctctccctctatttaaaaaaaaaaaaaagaaaaaccaaaatgttggaatcattcctaattctttattttatcttctgcctaacatctaatctgtcagcaaatcctgttgactctcccttcaaaatgtatccgaattccagctgctcctcacctcctcctctactaccatccagcccaaactgccatctctcgcctgggttactgccacagcctcctaaccgatcctgctgctgtctcccttgtccccttggcccacttgcaacacagcagccagtgatacttttttaaacctgaagtcatttcacatcactgctctgtgtaaaaccctccaatgtcttcccagtacactcagaatcaaagctaaagccttcacaatggcctaacatagccctacatgctctgacacttcaattccccagagctttaccgccctcatcattcttctcatctcagcttactctgctcctgccacaccatcccccgggatgttcctctaacagaccaagcccctcctactccagcgcctttgcacttgctactcccttccttctcttccctagccatccacgtggctgtctgttccccagtttcaggtctcatctcatagggcaggttttcagtgaagccatcagcaccggctccctattccacatggccaccccattcctactccacataccccttccctgcttcattttttctcatgaagctcatcaccacctgactttatcaccccttgatatgtgtgtgtatatatgtgtatgtgtgtgaataatatatacacacacataaaggtatttattgtcagccactccccactatcatgtatgctccatgagggcagggatcactttttcattgcgatagccctactgcccagagcagtgcctggcacagaaaaggctctcaataaatatttttagaattttttattttattttatttgagatagggtctctcttggttgcctaggctggagtgcagcctaagcaacagagacagtgcacacgattatagctcattggagccttgacctcctgggctcaagggatcctcccacttcagcctcccaagtagctgggagtacaggctcatgccaccacacccagccaatttttaaaattttttgtaaagacagggtctcactatgttgcccaggctggtctctaactcctgggctccagtgatcctctcacctcagcctcccaaagtgttgggattacaggcgtgagccactgcaatgaatgaattatttgtctatatttattcaacaaatattattaacccctcaccctgtgccaaacgttgttctaggaacttaaaatacaattgtaaaaaaactagacaagaatactgttctcatagagcttatatctgtatctatagctctatatccatctatatctatatatcaacatctatatgcacatctacatatatctatctaagactgaaaagtgtacagtgaaaggattatggctgatttttcattattgatgctcttctatacattctaaattttctaaaagcgtaatttttaaaatttctagaatgacgtgattattattgtaatgagaaacaattgtgtaaataggaatgaggagtgaagcaacagttaaatgcaagagaaaactttgacatctatactgtgctcatgtgaacttgatcaacatctgattaagtatcacaactgtatatcactgctgttgttgaggcagtgtggcattgaattgaagagcaggattgctgcagacaaattgcctgggttttaattgtttacagttacatgaccttacttaggctatctagctcagtttcctcatctgaaaattggaaataataatagtattgttattactaatactagttcattggttgatgtgaggatgaattgagtaaatacatgtaagatgcttagaacagtgtgggacacagaactgataatcaatgataagtactattattgtttttattgctattatagttatctttattattattgagtgaaaagaagggaaagttgtattctctagaccattacacttaattatgaatctactggctcctggaaaaaaatactgtttataattttattctcatatacaaatttgaataagttatctaaagtatggtcttctattggtaaattcattaggaattaaacaacaattctgagaacagaagcagtcaaccctgatgagcccagctcagttctcggaactttctgaggcattgtctgtggcagcaggttttctggccatgtggagaagggagtcaggatgctgcctccagagctgccacagaaagagcagcggaaatggcttagtgtgattggcactccagtgtgaatgcctgggtgcccaatgggaagttaattatattaaagctaaagaaaccattacattgcctcagaaaaataattagtttcaccccagatcacatttgaaattaatgacattattgtgtattaggtaaatacatataattctttgcaaagcatattcaaatgccatagtttgacaagtggttatgccttattacatctaaccttgaaggttttagtattttggttagtcatttatttattcatttgtttttgctactctgactgtatgtccagccaaaatggattatgttattaattgaaaatattttaattgagcatttatcgtactcattcacaaataatccaattaaatctgatcaagcatattgcttaatgcaggaataagtgtaagacatctgcaaattctgcactttggcaatcttttttttttttttgagacagcgtcttgctctgttgcccaggctggggtgcaatggtgcaatctcagctcactgcaacctctgcctcctgggttcaagagattctgttgcctcagcctcctgagtagctgggattacaggcgcacaccaccacacccggctaatttttgtatttttcagtggagatggggtttcaccatgttggtccatggtggtcttaaactcctgacctcgtaatctgcctgccttggcatcccaaagtgccgggattacaggcatgaaccaccgcacctggcctcagcaatcttatttattatagttagggatgtttacaaggcgactacataaaatggtgcagaatctcagattaacccaacccattttctcccaaactgatgactagaaagctctaagacaaactccatgatgctggatcataccatttccactgtagccactaaacgttagtgacaaataagttcagtgctatgatttaggtgtgttgtgcttatgtacttgataattgaacaacctttatttcctctattccacacaatacttggcactttctcaaaaatctttcagtcactactactcaattcttgtcatatcaagagagactgccagggtagggtggcatgccaaggagggcatgggattatcaacctgaaggaagttccagaggtaatctgtcccattcctctggattcagactgaattgtagaattaagagtacagatttgcatagacctttactctctcagagcaattgagatatatctatgataaatgaggtttatttgaacactagggtaaagtgattagttctagttaagatcagtccatttttcatgtcagaaattctctcttcagacctcagctaagcatgaaaccaagtcctttgatgaatatcaaatgatgatcagctcataacaacatatattagcaattactctgaaggaggtgtccctcacacagcaatggagatgcctctgtgtggtttaaaactgcaacacaaggccaggcacggtggctcacacctgtaatcccagcactttgagaggccgaggcgggcggatcacctaaggtcgggagttcgagaccaccctaaccaacatggagaaaccctgtctctactaaaaatacaaaattagccaggtgtggtggtgcatgcctgtaatccaagctactcgggaggctgaggcaggagaattgcttgaacctgggaggtggaggttccggtgagccaagatggcaccgttgcactccagcctgggcaacaagagtgaaactccatctccaaaaacaacaaaaaaacaaacaaacaaaaaaaacacctgcaacacaaataagcacagacacttgaatgggaaaagagacaatattcaaaaatcaatctcattaaaagtacttgtacacttattttcagggaaaaagtggcagagggaggtcctaggagagatgacatccaggaaaaaggtaatagcaaagctaaatatcaaacacaacccgttactagtgaagatgtggattgtcatctccagaaacgaagtctagcataggtatttgagggacttagatccaagctggggaaaggaaagaggaaatttagtttttctaggtgttttttgtgccagagacagaacagggcttaagagttggtctttggactaacttggcatggtttaaaaccttgttctaactcttactcactgtgtaaccccagtcaatttgcttgacctcttggtttctcattttaaaaatgggaaaaatggagatgctggtagtaatagtacctacctcataaggtggttgagatatttaatgacggaacatgtgtaagttgcctggtaaatagataactgtcaatagtgttaatttctattttctgtatggcgtagacgtgcaagaggctcatcttcctcttgactaaggagaatgctaattgccactgaacttctctttagcctcatagaatgttaacattaataaggcattatagtgcctccaaattctcctagcttgttgcaccccctttccagtgtttgctcttatacaccagtatttttcacagttgtaatcatggtgattgcacgctttcatattcatatactttcttatcatttacctttgcgtctaggctcctgctgggctgtgtgttgtgctcttttgtctgtagtgatttggggacaaatcaaacccttttgtctggaagtcctgagcctcttcatcttgaatttttgcttgctattgctcattatcttgcaaagcatttggtcctggcttcagcctttccaaaatgaattcaaataaacaagattctaaactccaggagtttacagcctcatacaatccaaatggatgcagatcagacataatcaaggcaaacaggtttttaaaaattgcagaaatgaaattgtcagactgcagaagtctaagaggtaaagactgtggcttgcaggggtgggctcactgtttagaaagaatgggacctgaaggaaaatgttcttctcctcagcctttatcttttctcctacacttggcccttacacataaaaattaatgaaagaaagtagaagttttggccctcaaaaagttgataaaaattattataactaatgcacaaatatcacaatatgtgcaatatgaatgcaatctggcattttcatgactactgaagatgggaaatggcaaactgatggtttgcagtttcttttttgaaactgtatgttcactccttctctccggtagagtttaaaacaaatgatgggatgaaaaaagagtgaactttgaataactgaacatatggaaggctggtgctagaaaatagtgaagcaagaaaatctggaatcatgcattatatggccatttgtcatctgtctcctccactggaactgttaaggacattgtttgctttgtttatcactgtgcccctggctcctagaagaggactgggccatactaagtgctcaataatcatttgttaaggaatgagaaaatagaggacagaattttgacccctaagcttgtggggcttgataaagtcaggcgtgatggcccccactgaaaaggtagccatagcgtggagctcccagctcccagccaccatgataccctttaaggtcatttgagggataaccaaatcaggaattgagaatttcctgcatcccatccctttaagacaaggataattctccagcctgcagcaaagactgctgcatcaccacctaagccatgtttagagcaataatttgtaatcattatccagttcataggggaatccagtatctctgcatcttaattttgtcttaataacattcaaacagggaaaccactttgctcaacagtgacctgtcacgcagttataggttacatatgtcttattttaaaggactgctgcatttaaatttaaaccacgtagctcccaagaataatattagctgctgagaataggcataaagttaacagaaggaaaagacctggtcccgggactattgcaaaaaacctgcactaaaagcagaaagtcataatattgtcaaaatggctaatctagtacctgggcaggttgattagatccttgaatttgaatagaaaatttcagagagttttgtagttcataaaagtcctttgcatgaataattagtgccgctaacaattcacctccctgcaagtggcatctcagagtaatctaccttttttttttttttttttttctgaggcggagtctcgctctgtcacccaggctagagtgcagtgttgcaatcttggctcactgcaggctccacctcctgggttcacgccattctcctgcctcagcttcccaagtagctgagactacaggcgctggccactacgcccagctaattttttttttttgtatttttagtagagacggggtttcactgtgttagccaggatggtctcgatctcctgacttcatgatctacccgcctcggcctcccaaagtgctgggattacaggcttgagccactgttcccggccgagtaatctattttaacacacatcctttattcacagaaaaacctgtttggagaatatgaaaaagcaatctccctctatccttccaaccaaaaattgataattcaaaaattgcagctggtactgttttagtagctggcaattttgaggagacttttcatttttcttaacaaattgccaaatggaaatggctatagcagcaacattgtgcaggactgagaggggcccagtgtttaaccccttttctttccccttctccctgccttgcatgctgcaggcaaataagccagaaatgcaaaggaactctgtcacaaattcatttacaaagcaaagagatcttttctttttttctatttctgaaatcggaagatattttaaaaaatacacaagacaaaaatttgaggttgcagaatttccctacaggatctccttccctatcccaaactccaaacaaacaatgtcccctttcctcctcaaagctgctttcagggttttgtttgtatatatgtttgattttatgcaattaaacctaaatcctgtttgtgaaatgaaaggctctaggatgtgcagttatcacagaaaagatggaatggataaggttgccaaatttagcaaataaaaatacagaatgcccagttaaatttggatttcagataaaccgtgaataattttccagtgtgtcttccatgcaatacattgggcatacttatattaaaaaatgtatccgtgattgatctgaaattcaaatttaactgggcattctgtattttatctggcaaacctgggagggctgggaggtggcattctgagtagggagcagttctctgtgcccccaaaatctcaacgaatgcatctgtgcataaagctcacctggtgatccgttcaaaggggatgatgagcaacagtttcactctttgtcactgttgtttagaggaagtttcactctttgttttcttaatgttttttagagacagggtctctctctgttgcccaggctgtagtgtaggtgcaatcatagctcactgcagcctcaaactcctgggcttaagcaattccctcaccttggcctctcaaaacatcaccctttgttgttattttcaactgttatttgcaaataaagcttgccttggaatagcagcatggtagaatggcatcaatgtgcctgggatataactccaactctgacatttattaataagtgtgacctcagactcattcatatttagtaccagagatgatatatacctgttctgaatacttcccaagttgaagtaagtattaaaaggtaaaataaagttactaacacagtgccccgtgtacaagatgaccactcaatgttattccatctcctgcaacgctttgtcccttagtaaaggaaatgctgaaataattatagccccaagctccttggtaaagcatggatgcataggttttggctattgctctttctttgcttgtttctttaatacgttcattgatatataatttgtatgtggtaaaaggcacaaatcttcaatgtacaacttgttagtttttcatatgctcatgtaaccacaggcaggtcaagatctagaacatttccacccccacccactgcctccctagaagattttctcatatctgttcccagtcaatatcacctctccataggtaaccactattctgatttcttttaccataaattcattttccctgtgcttaaaattcacagaagtggaatttttcagaatgtatcattttaagtctggcttctatcatatatttgaaattcatccatgttttcatgtatactagtagtttgatctttttcattccggtatgatattccattgtacgaatataccacagtttatccattttattgttgatgaacattagtgatgtttccagtttggggttattataaataaagccatcatgaacattcttgtatgtatctttctgtaagcatatgtattcgtttctcttagatatatagaaatagcttgactgggtcatagagttctcactctctccaaccccaggtggatcaaaagcacacagtttgcgtagcaaagttgcaaatatgttttttaaaggggagagaagcagcaaaataagaaaggaaaaaaggaaggaactgctagcctatctccctcaccaaacctcacataccactgtaggaaagtctcctgaatttaggggaagagattctttgacacagttcagaaaacagaatccaagagaatcttgggccttatatacttagccacatataaatgatgtacttaagcttaaacaaatgtcacttaagaaaactgtagtttcttctaacataaaatgcatgttccaatcttgtcatttgtttatcttacaccaatcttaatgatacttttgtgaattcttaatttgctccaactgtcacatcatggagattagttctgagacataaaaaatacttcccaaacaagtcagtttttaaaagccaaagatacactaaatgtcattaacgttgcttccattttagaaagaaatagaagactaaatttcatgcacaataaaatgttcataaaaagggacaatataatgctttcactttccaccctctggacagtttgtgccttctgctgcaatttcccagtataggtctaaaattctccctcttgtgttatgacagtgaatacagctacattttgacactaggataagagaggagttgagcttcaactggatcactgcatgcaaacatgctcctctgatgtcagcactaaaacatacaggtctgggcattctattgttgaagctactcagggaaggaggtttatgggacaaagtaagggagaagcagcagagccaaccaaagcaagagctctttcagataaagtgccaaaaagttaaaaatgtggttgtaaagtacaatcacttataaaataatgtgaaatgtattatcctgcctgaaatttttttagcactaagtgaaataatccataataccaaaagtccagtgccaggattataaaattaagccttcagagaacatgtttataatgccccaggacactaagagggatgagggttctgatgtggcatttgttcattcaaaaacacatcttaatgcaaactgatgtatgagactgaatcaggtcactggaaagggaaggggatatgatacaaaagaagtcaaagggttggctcctgagctccacaatggaggaattaaagccctccctggattgtatctctcccactgttgtgccgaacttctgttaaactcaatagggaaggcacaggttaaagaggccaaagagacccagaaccagcaaaggagacgtggggttttattaagggctcacatacaggggagagattccgtggtggcaggctgggtaggagaaccgccttacacatggaaacgatccagtggcggcaggcggcacaggaaaactgcaatggcttgtgaacatcatgcagttcatatagccttctcactcaacaacctccacctggcatccttcatttaacccaaactcaaggcctcaattccttggatggtcctgtgttccatggtacaaaccaggggctcagatgtttatcatagataaggaatgaatctcagcattggccacttccagattttccagcatggaacacacattgagaagtatctgccatacagagtcattctaaggatatgcttagattattgtttttaggtgtctttcccctacacccaccatctgccctcaaggggtcaaggaaattgcttagagaacagtgtgggcttgggaggcagtgggcctaggttcaaatcttaaacttgtcaccagctctgtgaccttgtgaatattaacctcttgagcttcagttttcttatgtgaaaaagaagctaccacagggttattgggagggtaaagtcaaacagcaaaaagttcaacaaatgtttgcttctaacatccccagccttcccctgttctattttttctgctgaaataccctgagcaggccagtgcatcatttcttcctcttgaaattgtcttgactgctgatatcgttttttcacttcctgagacatgattctatttagagaaaaataggatactgcagactagggtctaaaacaggttttgaaaaattacagaaatgcaatcttaaaggagggggctcagggtacatttttttcatgtgaaaaagaaaccagaggaattggggcttgaatgtactgcagtgatcatcaattttagtaaaaaccaattaaatctccccctcagtttttcagtattttgcatataaaaatactcggtatagccaatagatgttgaaatgaattacaatggtcagtctaactctgcatgtaatataagcagagcccaagctaattttcctcacaaaaactactttaacaaccagaaggcaataaaatgaggattatgaatccataaatctttgctcgttacagaatactgaaaatggttccaaactaattttattgtagcaaactgttgataaaaccttgtgactggtttatttttttgttcattataagcaaatagtcatcagccgtcgcccgagaccacatgtgcagttacagattaattacttgcagcgtctctggtttagaggaccttactggtctcaggcaaaccagagacttaaaattatttattaaataatacaatgtgaaaagggagattggatacaacatactgtgcaacacagaagcaaattaggcagagaggaatttcctcacggagaaaataaaattctgagagtaatacattgaatagtaggatatggtgtggttaagggcgtggctttggccttagcactgtggccttgggtaagttacttaatatctctatccctcagtgaactcagttgtaaaatgaggatgataatattattcacctcatagggttgttttcaggattaagtttaaaacagtggttctcaaatttaagcctgcatcagaatcacctggaagccttgttaagacagattgctgggccccaccctggagattctgattcaataggtctagtgtggactgtagaatttgcttttctagcaagctcccaggtaatactgatgatgctggtggacagggtgctacactttgagaaccactgaattgtacaagtgtggagtctgaacaactctggcacatggcaaacactcagtaggtgtgagctatcatttataagcttttgccaggagctgggtttgccaggtagaggaagatgcttcaacaagaggacactgtagacaaagaaacagcgtgatgtttcagagataaattggaaatttggtatagccagaatatacaatgccttggggttagggaatgccaaggtgaggctgtgaaagaatattacaggatagtttgtgaatgcttgggaatgccaccgaaactttaaatgatgacttgatgaacacttagggctacagcctctctcaggtcctctctgttttgagactttggctattggaggactggcagaggcattggcacatgccagacatacagtgaacatttactaaatgcttctgggctaaatgcatgtaagcagaaaaggtaaaattatgtgtaaattataaacggcattataaaattatgtgtgtaaattataaagggcagcagatgaccagttagcaacttcctaaattggaaaacacaggcagctctgagcttcttaggtcaaacacaagatttcaaggcagctgagcagctgaaactgtcttcttttgttatttcatcccaacacaacagggcaaatccacaaagcaatctcatctactgaaaaacaattacagccgggccagggaaaaacaccacaaaaggcttggaaatttcctgagaccagggtatatgaaatctagacagatttaatcactcttattgcagccagtccttaaatggggagcttaatctcattttcattttccataaaggataatttggagagacttcacagaagtgaagagtcaaggcctctcaggtttcaagagagacctcactgtttttaaaaaaggaagaaatgcgaaatgaagttacagaagctgaagtgcattttaaatgtttattatcctgtaaatacccttttaacaggaaatgtaaaatgtaaaatagttgttaatcacaggataacaaaatacttttttttaagaaaaaacaacccacagtttgtaagataagctatgttttcagtctatatggcaaaatttatttccactttttctatgtctctctgagactctgcatggcctgggtaagaagaataccaaaaggctaaatgtaaggccctccacggccatcagccttgtaccaaaggccctttctgacctgcactgtggtaggccctagcaagcaaaacaaaacaattgatcctacctcaggtattggtcagaacaggggatcataatggtctgatccattcaggccaggcaaggggctggctccccaactgtgtctgtcctgtgtgaaatggggtagctcatgaaagatctggagggaagcaggttaagaggagccaaatggccagggttagattcttagctctgtcttcactggacaagtcgttcaatctctctatacctcagtttcttcatctgtaagatgagggtgataatagcacctaccttctagagttattgtgaatattaaatgggttagatcttacatgtcctctactccatagggagtgaccaggcgccagctgcctgccaactgggtggcctcaggaaactcacttaacctctctaggtctcagttttctcagaaaatgaaagaataggatgaatttacctcagagaactttcctgttcttagactctttgatcctgtgactctgtcctgagtgtctattgtgagaaataaaggaatggagaggagcgaaaaactaactttggtctcctcactaattttggccatgaattcctgagctatttcagtgttgagccataccctagagcactttatttgcttgggaagcttgatttgttcatgggagtttgcacatacaaagtgtttatttgtcaaacattattttttagaaggtacaccaatattgaggcttaattcctagcaataggtagttccagtccaaagccttatagaaattggcttatggaaattgcagcggaaatagcagccttggtggttgcatgggtagaagcttcacctttgcccttcccactagcgagaggtggtagaatgcagaggtgaatggcacaaacttcagtttcattgaggcagatgtggtcccatgcccagctctgccacttatggctgttcggccttagttaaacctcgctttccttatgtatgaagtggggcttaggaaagtaggtattaacaatacctactgtaataagttgttgtaaaggttagattttaaaaaaatacagattaagtgcctagcacgatgttctgaatataaatgattaatagacgtgagttctcattatagaaaacacaaagaaatttaaaatgttaagccaacatcattctttgatataaatatacaaggactatattcactatgtaagtctccctcacttcttcctttattgaccactgcactgacattgtttggtttggttttatgttcagagtaggtcagttaaggtaaacgatgataaaataacaatgccttgcattagactgtcgtgatttataaaacaatttcacatgcattatctcctatattcatagtccaactttcttcaaacaagaaaattgaccctagttaatagagctggtgagtgacagagcagaacgtagaatgcagttttcttcatcctctcttccttgcaaaaggccacagtccttctttgtagagtttatgaagctcatccctatgcagcccctcactcccagccacttttgtggtggaagctgggctggtgttattatctccatttgttaggtaaggaaattgatgctccgagaagtttaacgacattcctgatgttgcaaagctgggaaggggcagagaatagaccagaacctgctcattttctagtgacacagacagaaacataggtaagcaaatcaaaacaacgttaatacatgttataattctttaaaaatgaattataaaatggtgtttggtctcagaggcaaaagaaaataattgtgtctgtgtggaggcacatgtgcatgtgtgtgttgtccagggaaagtctctcaaaggaaggaatacttgaattgatattaggaagaaaagtaggcagcaaagtggcacctaaagaaaattaggcagtggaaaaaccatatgcaaaagaacagaggcacaacataactttgccagtatgggaggaaagtctgtatgcctggagttaagtgtcctacatattgaagatttcttcttttttttgtgtgtgtgttggagtgccactctgtcacccaggctggagtgcaatggcacaatctcggctcattgcaaccatcccctcctgggtttaagcaattctcctgcctcagcctcccaagtagctgggattaaaggcgcatgccaacatgcccgcctaatttttgtatttttagtagagatggggtttcaccatgttggccaggctggtcttgaactcctgacctcaagcgatccacccgccttggcatcccaaagtgctgggattacaggcgtgaaccacctcacccagcctttcatttattcttttaacagttattaactgaacatctactatgtatggggctttatgccagctcgatgtccccataacctggtccatagggtactcagaggaagttggaaattcccagatggaattcagaagcaagagagaggcagtgtgagagcaacagtggaaggcactggagtagatgaagaagtcatgcccaagaggaaagaatggtgagaggagggagaggagcagaggatgagccatggagtccagcatttaagagacagacagaagatgcaaggtcagcaaagactacaaagcaaagttcaaagactgaagaggacaatttggaaagagaatgaaaaatgagggcaaggccaacactataacacatagtggagtgaaaaaaagcaaggaccaaaagtcaaccacagggaaaaactattgggaggttgctgtggttttaataagcacagttctaatgaagtgcagggaaaagaagctagatagttgttgtttgaggaataatacagggaaagaagggtaaaaaagaggtaagcccctgagatcggatgactttcaatgagcttggctggaaagaaaagggagaatctgcgggtagtcaagagcttatggaaaggctgaagctgctaccaagggagggttgtttagttgtgttttaagaatgcaagagacttgggcttatttttaatctagaggaaggagtcaatgaaaaggaagacccaaggcactaaagttgagagagaaagtaacaatggaacaaggacttgaggagatgagatcgaggacacaggtagatagaaggagggatatgcttttcccatttaggagtgggactcttattttgtgtcaaacagcaaaaaaaaagtaaaataaaataattaaccattggttttcagaatgaagcaattcacttaaaataaggcaagttaactgagtcattaatggaaaattctaaggatgtatctggttttaagggcagctggatcatggacattagggtttgatattactccatttctcagctcttcatttctacttggcttcaaagacatggagatgctcaggaggcattctcttcgcatctgaaaaaaaattctcaaaactaactcttattggctacattggatcatgtaccccttcctgaccaatgattccagctggagggaaagaagagcaggttggcttgagcaggtcacaagcctacctgtgagttagaggagggatgagcccctcccgagccatgcgaaccaagagccagggagctctcagggaagaccagggtgctgctcgtggaaaactggggaagaatgccaggccagggagaaaacagaccaatggttgtatactgccacttgtgacaaggagataaggatacttcagaggagagggcactgaggaaatccaggctggtggactgtattgtgtgtgaggtgaaggcctgacttgtcaatgcttaacgagctctgcagtcacttcacggatcccagcactttctcccccaacctcttttcctcatcgccaccgaagaaaggaaatgcctattgtgagttggaaagaggtcccatgcaggaggtaaatacctgcaggtgtgatatgagagcgattgctaagaaaactttatccaagcccatctgggaaaatagcttttcaagttcattacgaaaagaaaggcccagtaaagcttccataagaacaagcttagcttgtggaaagtgctgagaaaagctgatttattctcggtgtgcttccctatttttatgggttgcctcaacttttcttcagacaggaacgattggttccaatagtgtcacatgcagagagacactgtcagtgtaagtctccggggaggtgctatggaaggtgtggtatgcatggggaggagcccgcctgactttctgaagaaggataattaatgtgtatatggacatgcagggagcctttatcttcagaacacatttcagaaatgaaaaagcaaacaaagcgggtgatgaggaaaatggatttgctgtaactaaggaacagacctgggtagagaagtaaagacgagaaactcagctcttcatcattagaatgctccagagtccagagcttaggagcggagatcactcctaagtgtttgggtctgcaaactaggacacctagtttatacctagtcccagaacaaagggtggaggaggtaggattgaaagccactatttggtggagcttctctgacccttacagtccacccagaaaaaaaggcagacacctccagcctgaaatttggaggaaaccttagaattttgccccttaaacttgggcactgaactatgcatgcatggtttgttttcagaaagcctgtttcttaagttggcctatctatctccccttagccctttttggccagttcacacccttccttcttcctcaacctttctctgagcatctatgttcaagaaatccctcatcccctcctctgaactccagtggtgtgtcatttattcaacgttaaatcaggtcctgcttccctgttttcctttctatgtgcactcacttcatctccccagtgtggccatagagttctggatggcgggcttcatgactggttcatcttgcggtctctagaacccaacatagtgcctgggttgatactccaaacatgtttattggttgggttctctcttaccttaaggtggctccaagcccaggaacgaggagggtcaagagccaagctggactcaacagaagccaggagcagggacccaaaaacagagggaggagggtctacaaaagagaaaatggaatgtcccccagtgcctcaagctggcatgggaaccattccaggagtcaaaggctgtctctgacagtttctgctgaaaaatccccagagctgtgggggctcttgcctgcaaggatcatgctttctgtgggacttacagccaaccagttccctaggaacagtttgagggggatttgctgattcatctgttttaatccctctgggaagaactctgtgagcattgcatggcagcagcactctgaaggcaggtgacgatcccgctgagaagagtcgggatcctgtctgtttctgagcttggttgatttaacaaatatatactggggccctattatgtctgcaagctctgttccaggtgctggggacatagcaataaacaaatccaacaaacatctctgcccttgtggagcttacattttaactggggaagaacagataaataagatgaggaaatcatgtactatgttaggtggtgttaagtgctatacataaagatagaaaaggaaggtggatgagggtgttggtgtgggaattgtattttttaaagggtactcagggaaggctttcttgggaaggtgacacatgagctggaggaggtgagggagtgagccatgtgataatctggggaagatttccaggtacagggaacagcctgtgcaaatgtctgcagcaggagtgtgcccagcatgttaagaaaaagcaagggggcccctgtggaaccacagagtgaacaaggggagaagagtagagcaggtcagggagatagcaggagccagaccttgtaggcctttgcatggagggaaatgggacttcaccagcgggttttgagcaaagcagtgatgggatctgatttgtgttttaataagatcactctggccactgcataggggcttaggttagaggcacagagactcttgggaggtggtttcaatgatctaggaagaggtggtggcagtagaagtggtaagcaacaatttttttccagacatactctaaaggtagagtagacgagatttacttcaccatgcggtggatgtagtgtgtgaaatggaagagtcaggactagtgctaaggtttcagcctgaataactagaaggatgtggctgctctaagtcctctttctgcaagttccctttcctacacctcataattctagatatggggcttctcaccacaagcacatggaggctactgaacagtcacattgcagcaagttggctttctgctctctgacccctccccatccatcagctgaggtctctaaacaaacctgatccttctccagcgccttcccctctatcttccattgccaggaagagagcagaaaaccagggtgacaacatgtggcagctttgtcttcttagttggtttgtattatagaaaaatattcaccatgttctcctccagtgtaccttgattttgtgcatgttttgttctatacaatgactgatatttacttttgatagctatatgcattccttggtgtactgagcatttatttcggaagtcctgaatgatattttgaagcctttcaatttagatttaagaatacttaaaacctaagctctccaaaataacacaactatttcacaaaaaactagcattagatttcagtctccagattgaacacatttctagagcacttatcaggtagatttccaggtagagggatcagcctgtgcaaatatttgcagcaggagtgtgcccagcatgtttagtgaagccattactaaatttggtgaggttgggaatgaggtataatttcaaagatgaataaaatatagccttagggaaattagaaactagggagaaaggtaaaataacctactttttcttccttcctccctgaaacgtattaaacatcaaataggttcaagaattacataagatgctaaaggcacaaatacacaaaatagatctggtccctgattttgaggggtatagtctgctgagggagacatcagcctccaactaaactcactataacaggagatggaaaatctttcagaagagagccataaacaaagagccactataatagtgcattaaatatttcaaatttactaaaagagtagattttaaatgttttcaccacaaaaaaataaggatgtgaggcgatgcatttgttaattcgcctgatttaatcattccacactgtaagcgtatatcaaagcatcatattgggtcccaaaaacatatagaattggcatttctcaattgaaaataacactaaaaaacaaaccaaaaaagcgcccaaagagccattagaccacagatgaaggagtatggagtatttaaagctgagtcttgggattagggaattttgcagataggtggtgatatctgaactggccggttaaaggatggacatttctgcaaaaggagaaagaacatttttggctgagggaacagcatgagatcctccaaagtgtgtagcagttttagagaagagtcccagtagaggatactgaggggattctggtgataatgaggagattaggaagtgagccagggccatgtggtaaaggaagtgaagcctccagtgtagagagaatagagcattcactccttcaccaaggctggggtctccttgcccacaagcagatgttctaacatgggtgtcttccaagtgaacacagtcagcaagagccttatcacaagtttctttaataggctcttcagggaaatttacagaacttctcactgaactaaatcagtggacattttgaaagctggaaggcaattataagctgggccagaaacacaaaatgaggaaaggatcttgtggaaaatggagctgtttcagcaggcaggaaacacagggaagtggttctaacacactactactacctagttccttctctgctcacctccatatcctgtggcccctggaaaagatgagacctgggtaaaactggtaatacctatccagtcatttgacacgtgaaaggttcccaagactcaactgccacattagccttgcacagatgcttaacatttcattatatttactcttttagctgcaaagaaaaagatgaaatgcaaactcttttgaaggaacagtgcagctaagttgaaagaacactggatcaagaatcaagaaacctaacctcatttttacttcacctgaagagctgtgtggccctaggtacaatagggccacacaattcatctgtaaagttccccaacacactgcccattccaaaatcttggggaaatttaaaagctatattcatttccaggtcccatccagatctactgaatcataatctccagaagtgagatccagaacctgcattttcaggctgggtgagtggctcacacctgtaatcccagcgctttgggaggctgaggcgggtgtatcacctgaggtcgggagtttgggaccagcctgaccaacatggagaaacgcatctctactaaaaatacaaaattagctgggcatggtggtgcatgcctgtaatcccagctactcaggaggctgaggtaggagaatctcttgaacccaggaggtggaggttgcagtgagccaagatcacaccattgcactccagcctgggcaacaagagagaaactccgtctcaaaacaaacaaacgaaaacaaaaaacaaacaaaaaaaccaaccaaccaaccaaacagaacctgcattttctagtctttttgtgatactggttggtgccatttaccgactattttttgtcccactagcttctgggaaccaagtagagttgcattttgtggcccccttgtggtgaggtggggccatgggaacagttctggccactgagtgggaagtagaaggggcaagtgtctcttcctgactggagcatggaattgccagactgagactgtcccaggttgtttttccctctggctttgcaagcaaccactttgggatctccaagtgaccaccataagcagagcaccctgcctacctgcaatgaaaaagaagcctgagggcttgttacatgtcgctgaggtgtggagcttgttagcgcagcctaacctagcttagactgactgataaccatcctctggtgatttgtacacagtcagcctgatgccaggctttgacaaactcgggctagatgatctttcgggtgctttctacgtctgaactttgttggttctgtaaacaggttattagctattaacttctggtaagatgcttactggccatccgatgggaaaagcccttgtcaggtctttctgagagctgctcttgcaaaataggcagtgtgaagagattagattggggatgggggcagggcagagctctcagagagagcagctatatagttgggagcaaggagtaggtacattcccaagggtcaattcaagttggcctgaaagccaacttggcagctggaatttctatttctacttttaacaattcaacatttcctgccactagaatttgtatataaatgaatgggtaatctgcttcaggggttttcatcctgggtgaagatggtcccttaaaattttgcttgcctggaaacccttttgtatgaggcctaaactccttagcactgtaatttaggccacttcaatccactcttaggataaatacccatcctgatttgcccagaattatcccagttttgcactgaaagtctggcatcctaggaattcctcagttctgggcaaactgggacagttggtcaccctacaggccattttgtttctttctaataacatcactgtgaagataaattctcctcaccccaccctgatacttggcaaagttaggtttcaagctcttcccatgtgctctggctcaagtcagaaaaaaataaaacctcaacagcttctgttctgcagaaagaggtttacagatttcaatatgctagccaaaaagaaaaaaattattctcagcttgattcttttgccagcttgataggcatcggcagagatgggtggtttccaacagcgtttttcgcccctgagctggttttgagcctcgcagctctgccacttgacggcatccaggtttccagacgctggcagggatgctacagtctgtcaccatcaggcctgctttgagtttttctgttctgacagctagacaagatgtcatttgaagggtgtttagtacttgggtggttgttttcagggtgggtgagccccagagtagatttgattcaggaaacattaaatgttggaggctggtctgtatcctacttgaagagtcagattaaagggttgtataaaattaggcactttttattctgcaattaaataagttcactgcccttttgctaaaaatggataatggacaactgaatggcagcttgttggaaaatggtgaaacccagagtggctaaagctgatacagcatttgcttcaccaccgtctttttacaagatattatgaagtgactaaggagagtatattcaactttcagaaaatacttctgagtgaactctttgcctgaatgtccttctactctgcagcctagtagcccgatagtaaagaatgatttgctgaaaagcccgattttccctttcttcatcactctcttccctcctttagctctcaaaaagtcctgggtctcagaccaaaggttgttctagaaacaacttgctcttggagaaatgtaccaaaggaaaatggagtgcaaaagcaaaaaaagtctatttctagggagaccaaattaggaagaaatgagaacatgagatatgagtagaaagaaaggaagggaaataaggacctttctagaggcagggatggttcatgtggtaggcagtcattaggtgccagggaatatagttgaagatgtgctgggataggcttcttgtttcatatattcacactggcacaggaaccgcatcagaacttgtactatttcttcttttagatgaagttgggtcctcctcagaaaacttccattctgtgaaaactcccttggaatggattcctcagagaggttttgttcttctggcaggagaaggagggcacctgaaggggtaggggcacctggaaggtgaaaaagcatgggaaggagggtaaaggcaatgaatatcattttttctacttcagtacctttccaacagctggccccatgggaaggaaaagaaaacaagaaagagtaagaataaaattgtttggattggacttttctcctaaccaacctcctcatgaatttaatctcagtaagatttgtgcaagtagagtttgccttaatgtcatttatttctttaagactttggcttttcctgccaatgccaaagtgccagtcagagtacctttagggctttctaaatctggggctttgagggagacatccgtgtttgagaaacatgtgccctaaggaagctcagagatgaggatgatgataaaagtgctactttgggaatcttgtctgctccaataagccacatcactcacagtctccatggcccccactccttgtttctaaaatgcctggttgtttagtgccttctagatctttaagtctattagcttagaaagaagcttatcagagaagaaaccagtctgtgttctgctttagacaaaaggaggatcttgttggatggaagaaaaaaaaaaaagcatccaagttaaagatatacatattgcctacaataaaaataattattttaatatgcttttcaaaaaagcatatttaaaacattatttcaaaattaaataaaatgtcagatatggcacagttacctaatttagaagaaacaaaagcaaaataaattatactaagagaaacttttgtagaataatattttaagtaaaaccagaaaaggaagtttaatttaggtaataactttataaatgaacacagcaaaatacattcttgacatttttctgaatgttagactctttcagaagtttattcattctcataagcagtgatttccctgtgattagctcattaagtatatctataaattaaagtgagcactttctattttgtgtatttgttgtattctgcagattggatttcaatttttttaatgtagtttttctgattataaatcatgaaagatttaatcacctctttaggtcaaagaaattgtatggctcttcttatcgccctcaagcttctaagcaatgggtatttcaaataattcaatcatgattgttactggtggaaggtatccaagttaccagcagtgaatccatacaggtctctagcagtctcaattcttgcctcctcagaagaaataatttgacaaaggggcataaggcagaaaaagagaccgaggcaaactttagagtaggagtggagttttattttaaaaggctttagaacagaaaagaaaagatactcttggaagagacccaagtgagtaacttgaagaacaagtgtggtgtttaaccgtgatcctaggactttatacgctggccccttttccatgattcttcctttagggtgggatgccttcatgcgcagtgccctccttgccattgacaggtgagcacacacagtgtgtttaggaagttgcacaaatgcccatctgaggctttcttcccttttccagtggtgtgcccttggaaggtcgttctctgccattatgtctcttaatgcacatgacagggaagttgcatctctctggcatctgcattcaattgacacttcagtgcaacaggtgtggaccatcaggaaatgacctctccctggtactggctgccaatttatcacttttagagaggcaatgtgataattgccaaaccatcacccgacattcctactgggtggggaaagagccctttcctgccctgctcatgcctgtctaactacctgtaacatgattatcaatataagtgtaaaattaggtcaaatttacttattagacacagggcattgtttaaagtcacctcacctcatctctgaggaaatctaccaatttctttaccaaactggggccagatgctcaaaggttcccttacctgataatggtgaccaccaacagtcttggagcaaatgggagaggtcccaaaggaaagatgaatctttgagaaccaaagccagggctgcaaggcccagcttccctttcatgtcagctccttatcctttgctgatcctggaggatctgaacctgattcattcattcttgcttgcttgctttctcttgcttgcttgctttctctctctcttttttttttttttttttttgcctgtatgctactctacaatctctgtagacttacaaaattttcctcttcaaattgaaaagtactatgcattctagaaggttggctgggtcagggcagatgtggccagggtgattgacacagggatgaagtcccaggattcaaaagggtgtggagcggggtgactgctgaagcagccccgggccagaaaaaacaaagaatgaccacctttgtgctgtagggattgcccgaggccaagccagggagctgaatgttgtgatctaaccttagggaatgagtacagagctggacagagagacaagcccaaaggttagaattggcctagggatagaatagagatcaagagcaaacagaaagtgatgcaggggatttaatggggtttcatgttctcagataaaaatgcacagtcctatcttttaatccagtggcatttcccattatttagtataattttaaaacatttttgttggctgcatatattccattatagctgtagtgtaatgtctttagccatttccttattgttcagttacagtgattgattttcaagattgattctcatttttaatacattcaaaaattaaaatggaaaggacaattactagacagatctgtattcaccagtgtaagtagaaaaatatagatttttcattgttaacaatataaacatacttaacaagcaggggcaatcttgcagccattagggtgaatcagtgttttagaccaagcaactctgaatgctgaaaatggtgtgaatgagcgggcactcttggagatgtgtgcaggatatggacttatttttttaaaatccaaaccattatagaagaaaagagtcagagatttttcttagaagaataaagttaagactaaattaaatggtaaagaaaattcaccgcgtatttgttattgtacttttaaaaattcttctctaagttcaggttccatttgttaatttaaaaaacatatcgctgctatttatactgggtttcatttctgtagaaaagacataaatgtcttatggtcaaggtgtcactctgttatctatgcttggaaaaagtctggtcaatttgttcatgaagaccaagggaggcatcacggatcacctggcaactgttaattgaaatatgtatgatatggtaaccagtgccagaaccctgcagacccagcaaaaatcaaaggaagtagaaccttgtatctggagctaatcctataaaaaatttgcttctgaaataggattggagtgaggtctttaaacaggaaccaggattgaaattaggttcagagttcctggaaggttgatgaaggctctgagctgggactgtgagagccccttcaaggagcaaagagcctcacagagcaaagagtctcgcagagcaaaaagcagtatagcaaggacagtgtttcttctcccagtctggtccttagacatcctaataatattctaacaccacgtttcccaacactctgtgaccttgagctgattctcttcagtctgtcttcttgggaagttctggtgtgagcccaaccaagactgcatccctgtgatacaagtgtgagttacatcatagtctatttcttgctaaggccaaagtagaggaagtcgaggtaaatttgcaaatgctatttgagccagtggccatggaaataattatgctcacattcttcacaacagaaaacgcaagagcatgcctcacatgcctcacatcctgtgggcagctccactcacagttcaaactctctgcagcatctgttcaccagctgcacagcaaatctcttgagaagcccacaacagttgagggcttagtatccaagctctttgcacaccaacctccagctttgacaagtctgtcctttcacgtcaggggcatttaatgattaaagaatctcagctctcctagtcttagggagttggaagtattggcagataagagagactgggctgtgatggtgcaggtgttttggtaagttccctcccaccagatgtttcactgaagcctccagttccacagccacatgtctagtaagtcaattctgaaggtatatgatctgacatcacagcaaagtagtggggtccggtggcactgcagcctctcatgacaagcgaggtctttgtaaattttccctgtgtcctcctcacttggctcagagaattcccctgtcctctcccttgcctggtcagaaacaaatgcagccagcccaggccagttgcagctgcagtgaaaggcacagtccaattctctttaagtttttctctctgaagagcttcctggtgacaacagcaccagaagctcctcgccttgccatgaccttggctccttttgcctccttggctgtcctactctcaccccagcaagaagtcaattagaggaacaagcaagtctgaatctcccaactgctcttcctaaactagctcctgccactactgcattcttatgaccatatgcctgccaccccagatcccatgtacaggaagagatctgtttatggcagtgattctccaagtgtgtcctggctgcagcatccatatcatctgggaacctgtgagaaaggcaaattgtcagacctccgcccggatctactgaatcagaaatactgggattgatgcccagcattctgtgtttaacaggcctgccaggtgatttagatacatgccaaggtttgataatttgcatttcgaacagttttctcagataatgctggtgctgttgatctgagtaccatgtagtgagaaccacttatgcacttggggaaatggttattctatactagtggttggcaaactatagccacttgtccaaatacagtctaccacttgtttttgtaaataaagctttattggaatatagccacacccattaatttacatattgtctatggctttcttgctataatggcaaagttaaatagttgtgacagagaccatatgtcttgcaaagctgaaaatatttatgaaaaaggggtgtcgatctctgcttacacagacatatcatttttggacaaactacataccatcttgccaaatggagtttaggcaaagacaacaataataacacaagggggaactgggcacttgcatattttttatgtctggaaatgaaagggctttcttcaaacctatgaaagcagctctagctgagatcagaaggctctggtagagactgttactagcagtgtgcctcccacccaccccaggtctgagggatagaccagaggaagaatttgcaggttcacaggaatggagaggcaggaatgcctgggtgtcggttgtgtagagaagaggctaatttttggtagtctaagcattccttgacttagaaaaaaaaaccctacttttttttatggcaacatactcatgactttttcagatcaacatgtctgtaaaatgaaaggttgtatatcaaaggcatatttgattagtttagagtcttaaaaaaaggagggaaagtgtttgaactcttttccttggcagctaagaaactccacttttctttgtggttggtttccttccttccttccttccctccctccctctctccttccttccttcctctctctttctttcttcttgagacggagtctcgctctgttgcccaggctggagtgcagtggcatgatctcggctcacttcaagctctgcctcctgggttcacgccattctcctgcctcagcctcccgagtagctgggactacaggcgcctgctaccatgcccggctaatttttttttgtatttttagtagagatggagtttcaccgtgttagccaggatggtctcgatctcctgacctcatgatccacctgcctcggcctcccaaagtgctgggattacaagtgtgagccacagcgcccggcctttgtggattctttttacagtgattgaatacactttccccactcttcccagttgcgagtgttcccagaacaagagcagtctgtaaatgtctaaagctggggagtgtcattaagtcagaactccagtttagacgtatggttcagtttctgatacttatctggcagggagcaggacagggatatgctccaggggaggggtatttaagatatacagataatgggaatagccattctgggatagcagtccctgaaggtcaacaatgtaatgtggcagagtggcaagaaagtttctggaatttgaatacccaggttgaaatttcagccctgtcattttctactggagtggccttgggcaagttacttaactttaaccctctgaacctgtttcctcgtctataaaataaggataattatatctacatccgagattaactaaaacttgataaattcctaacatggtataagggtacttaatcaatattttcatttgccccactggcccattgttaaaaattttccttttgtttatggtcctttcattttgttattttagaaaatttagcagaactcagaaaagagtgactctttggcaacaaattgtgctgctttaagagagctaaaataacttccctaaatttcaggaaagtgcttcatttatttatctccactgaggagctgtctttgaaattgcttcttcctgggtttaatacctctacaaaatgtgggagggagaattgtgggccagaggacaaggattccaagcatagcctattacctatggggaaaataaaacgaagtagaaagatgattctaacagaacggggttccagacctgcttgagacattgaccaggcaaacatttttacttcacatctccctgaaagtagagcaatcccaactgtatttacctgtttcaaaaagtcatgtgacttagatggcacagaggaggggcagagtgatggcacatgggagaaaaagagatcatcattattaactagtatttcagcctctgtagtttgcagatgcccaaaaacttatggatcattaaaagaagaaatgttttgatctccagaaacaaaaataggtaagaaatacatcgattagcttggagaagagaaccgaagtgttcttggtataaagcatgatttctcattcgggccccactcacagacacctcctcagagaggacttccaatccaccatctgaggtctctccttctctccagccattctcctacccctactcctgcccctgccaccaaccactgtaacatcatttgaaattctatggtgtatgtttctgattacttgtttattgtcagtctctctacccagtaggaaaaacacctttcccttattcactgctgtatcctcaggggttacagcagtatctgacaggcactcaacaagtatttgatgaaggaatgaataaattattcctcccaaaatactttttaaaatctggctagaatttgtgtcctattgtaaaaggtagatttcaagccaaactgactcagtagtctctcatttcagaaaaactctctcctatttctgggctcaagtttatcactcacttactaatttctgatgcttatgctttctactcctagccttactgtactggttcagtcaatacaacattgaatataatgataataatagccttctttttcttgttcccaatctcaaagagaaagcttttaacacttcaccatcaagtataatatgtggtgtacaatttttgaaatatccttatcagattagggaaaatcccttctattcttagtttaccaagatgttttttgtgatgtatgaatgttaatataagcaaataattttgtggcaactattggaatgatcaaaggacattttttccccttatattatctaactttaaaccatccttacgttcctgatgtaaatccaactgggttatgaaatatccttttcacattttgctgaacttaatttgctaatattttgctttgaattttggcatctatgctcattagtgagattggtcagtaactttactttctcatagtttctttgtctagtattaatatcaaggttatgttgacctcataagataaagtggaagttttccctgtttttctattttctgggagtttgtgtgggatggctgttatttttctctccagtatttgttagaatttactaccaaagccatttaggcctggaattttcctgtgcttctgtcagaggtttgggaagcagcagatcacattggagttggaggatcaccccctctaagaggggctccagaacagacttgcgccaggcaggatggtgggaacttgtctcccaaggagactgccttaaaggagatggcactcatccagatgaacatggctgaacttatttgtaaggaggcattacttgatgatctccttggagtttttaccccttacgtatgtctattcttcagagcaaacacatcccactcatctcacttctgcaccttctctagccacaccctctcttcaggatgccctccttctcccccagttgctgctgaaatgccacctgactgccaggtctcacttcttctgtatacccttctcttactaatccaacccctagcaatgatatgcacccctcagctttttattcattcctgtgctgcttcttataatgattatatcaagtcaagatttctgtctgacaacctatagggcaggctttttcaacgtgagagtcctgcttcctatgctactattcttgcatggcacatcagtgaacacatactctgtgttaataaatgcttataaattaaataatatcagccagtatatgacagattaagtggcaaggtattacttcttcctccattccctctttctagggagggttgaagacaggatgttcaaaataaaatagctaaatctagttaaggaatatgtgattaatctattcatctgcacaaattggaacctgtcttaaattgccaagctgaaaatggttaccacagcagcaccaggaagaagatgctaaagataaaagcctttttaaaatatctttaataagtttcctttggcagctgagagaaataccatgggttagggagagaccacaaatgcaggaattagatgacctgtgttggggacctgactctgtccttccatttcttctctacaaagtcacttaactattggagtgttaattaaacaccattaaatgagaacaatatgtaccctgcccactttaaatgagaataatgaatataatgggttcaaatgagacagtgctatacaaatgcacagttgtcttacagagacaggatttggcttatgctggagaagagaaacctggaaatacaaactccatttgtattagcttcaccatctcccctagaatatcctagaatggagctcagcagtactgagggaactggcataagtcaagtgttgattctgccatgttctaaaaatgggcccacaagagtgaagtctattttcaaaggtagggaccagaagtggtgggggaagttgggctaagatagaaatgaaaagccttggaggtgtttcagcctgacagctatcacacaatgttgactctgggcagaggagaggtgaacaaggacctcttcctcagctgacttgtgcaagggaggcagctgccaccacaaccatttgtcaactccccatcacaattgaacatagtgaagacaagctctgtggggataaaagaaaaaaaaaagaatgtttgaggccagatcacctacagaagttcaacacgtttgtcccatatagatgacgttaagctgttctgccttcatgttaccctcagcacatgtccccaggcacagttgctgcatttatcctagtaactgccgattaatttccagtctttgcatatttttgtttaccagctttattcttctctcttcaactctgagaaagaatgtaccaggagttcttgctccagtgttcaatgcaaacttggaaatggtccaggatataaatgaatgtaatgattaatgtgtcaatcatctagtgttattgaaagcagctcattgcaaacgtggaaatattcttaaataaccagagatgatgatttgtgaacttctaaaatgcaggctcttcttagtattgtgcattctatttcatataaccttcagacatgaagtagagcttccctaaattaattttcttaagtttctttggtcaaactattgaactaatagacctgtgctctttaatcccaagagtgttgtgatcgtttttccagacaagtgctcaccatacatagtacaattttcattgatcaaaacaaatggcttgttcttcttcttgtgtacttaatcaataaattttcagctgtgttgtaacgtgcagtctcaaaatcagacattgttagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaaccagggaggcggagcttgcagtgagccgagatcccgccactgcactccagcctgggcgacagagcgagactccgtctcaaaaaaaaaaaaaaaaaaaaaaaaaaaaaaaaaaaaaaaaatcagacattgttatttgtgaaggccattggttccaacgtactgttttcaaaaggaagctagtgctgcaaattttattgttttatttatttattttttcctcctaagggaacaatggattctggatttatagtgaacatttccaaagcagaatgcttcattctgggtagctcgctctctttggatttaaatatgtattctgaaaatggtatgtggagaacatctaaagaccagccataaagggacagatttatgactgtgaagagacagattcctccagtgcacgggaaaagcagccaccttccttactatttcatacgttgttaccgtgtgtagaaaatacctactcagtcctgcccaagattggtgcttctaaaagatagtgagaccaaactaaattattacttcaaagaagtgtagaagtcgaaacaatttactggtgactggtaataagaacgttaaacaatacagtgaccccaaaaggttcttgtaaaaccatctggctgtgtaaaccttgttttagctgactctgaaaggcttaagaacactcctgtttggacaggacttatttgtttttcttctctgaggtcacctttgatcatcctaatgggttgactggccccagatgatttttttatgcatagctagcactaaccttgctatttgaaggtaggtagagctagctcagataaatgttttaacatatagactatgcaagttctaaaaagaaaatagaaacaacattttgtttccatttttaatttaaaaactataaagttaaaatgcaaaatattaatatccaacagggcagccactttcatccttctatacttaaaacacatcttttcaatcagtacgagtcatttcttaccaagttctgcttatatgtggcctcacttaccaaagagctcaatcatgacacatcattataagtcaaccagataaatcattcaataattcaacttattcctctctgcctccagtgactccatcctcttccaccaattactggacccaaagaacatcgtagagggcttaaatctttctgacaaatacactgtttaataaagcctgttgctcctactgcctcaaattttctgggttagctttatctgcctgggtatatatttggcagcaatattcatttttcaacatttccaatgacaattaattattctaaaactgggggtggaccacagtcatggaatcactcaagaagttatacaagccatgctggggaaacctgagtttcatgaggattttgttctagtggctctggcattcacataaccagttacttcagttcagatgcgtttcttcttaattaggacaggcgatgtaatgacacaatcaaacacatatggtaagaatcataaaacatttgggcttgctgctggctcctgctctggtatttacgattgatgtgtacatgtaaaaatattggactgaggagtagtaattgccgctgttccttgaagcaagagaacacacttggctaccagaaactgcacagggtaatcagagcaaggcctccttctataaagtatttgagaacttcatgacatcatgagtaaggcagagttatgtaaaatccccacttcaaaactcactagctaagagactttgaatcagccactgaacttctctatgattcagtgttctcctctaaaaaatgggggagacagcaacttacatgtgttgcttattgggagtaaatggggtaatatatgtaaagaaattggcccaagttctctgtagaaagagcattactgtgagtacctggatacctaccatgcagatttgaatctctttattttgcaaatgtctgaaccgtctgcacatttagtatatactaactggaagaaagacctcaggaatggctcatgtgggaaattaagctgtctttctgaagaaatggaattattgaagttttcaatgcctttctcctatgctatgtgacagtgctccctgcctcctgggaaactataacagtttggctcacagtctatgtgaagatgcatatgtttccttccctttttttttcatagagacattaaaaattactttactttggtgtattaagaatcctgcccacacaagaattacaacctcagcccccagggacccatccttttacagggtaaatggagcttctttgttccttatatccattctactcattctttttgccacatctgtcatgatcattgagaaccattaccacactcattgtgtgtgtatatctggggaaaaacaactaataattgattgtttacataaatatatttattcagctccctaattagaatgtaagctctttggaaataagagctttagtgtatggatggtttgtactatagtagatattttccaattgctttcattgtgtgccttaatcaggaaaaccaggcacctccaatgaacaaatatttattttaaaaatatatacatgtaccactatgctcatattacagtaactataaagttcatgtcctttgcagggacatgggtgaggctggaaaccattatcctcagcaaactcacacagaaacagagaaccaaacaccacatgttctcactcataagtgagagttaaacaatgagaacacatggacacaaggaggggaataacacacactggggcctgtcggggtggtgggaaaaggggagggaaagcactaggacaaatacctaatgcatgcagagcttaaaacctagatgatagggggccaggcgcggtggctcacgcctgtaatcccagcactttgggaggccgaggcgggtggatcacgagctcaggagatcgaaaccatcctggctaacatggcgaaacccggtctctactaaaaattcaaaaaattagccgggcgaggtggcgggtgcctgtattcccagctactcgggaggctgaggcaggagaatggcatgaaccccggggggcggagcctgcagtgagccgagatcacgccactgcactccaacctgggcgacagcgagactccgtctcaaaaaaaaaaaaaaaaaacctagatgatagggttgataggtgcagcaaaccaccatcaatgtatacctatgtaacagtgtatacctatgtaacaaacctacatgttcagcacatgtatcccagaacttaaagttatatatatatatatatttactaattaaaaaaataaagtagaaatttttaaaagaagggattagagatgcaaacatgagtgctccaaatattttcttcccacaccatagtgggttgtctcctggagcatatccatcctattttggagatggttgtcccctagcactgaggaacaggccaatctgtttcaggactgagcagccacactaaccacccagttgtgttctgccatgattggccacccagatgtgttctctcattgcttttttttctcccatcaatctcctacccaccaagctctctctctttaatacctccctcttccattcacattgccttagcaggtgtttggggcaacatttgggcattttttacttagcttacactcatgattattttattggatataaaagatacaccagcagccttcattttcccctcatcctaataaatacaagaatctcccaggggttgcttattcccaaggagcctgcaatctgtctggtgtttcagtcgtgttaggtgtgctgtatggaaaggccacccacaaaaattgtggaaaacgttctttctagaaaaaataaaaacagtttgtcattccaggatgcagatggtagtgtcgtaaagaggtgttgggtggggtatgtgtgacatcaagtctgggccatttgtgggtttccagtgagcccatacaatagctttctcaccgaatatgtgctaggaatccctaagacagggtgttctctttagagagtttttagtcttcttaaatatgaactggggaaactaaattacaatgcaagcagctggcattgacaggacatggcaaagttattcagaggaaggtctgtgtgtccagcctgagtcttgacaacacggcctatgagatcagagctgcccggaagagacaaccaaattgcttagagatggaaactcatactgaacagggtactgaacacacccttctaatgctgctggaagccattcttgatgaactgaatctgctttgaaagggtagaccacaaaataaaacttcagaggtgggcaggttttatcactagaatttccatcattaaaagcagaaaaatagaaatcattccattgtaaaatagcttgcaatcatccacttcagaagcagtataaaattaccgcaccaccttctccaccataactcttcctttggacttttgactaccaccatctagttcagttaccagcattcttggttattctgcacaccccactgaggtcataccacaccctcacacgccttccatataagggggtcctctttatggtggccacggttctaaacacctgagagttgagatgaatccacaattagttttccatgtgatttccaaatgtgagcctttcatttgttttcaacacttcctaggggggaaagtaagatatctgtcagtgatatagaaagcagaagaaaagattacaaaagtttgatgttaatgctttaaaatgtctaaattgcctgagggtatttccgggagtggtattccttaatttgctaagtgcacaggcaatgtgtttggagcctgtaaaaccctgcagcctgcaaagataaccaccactgtgcctcaggttccttagagagaaaaagcccttgtcaatcgaaggcagctgctctagtttagactctgatacttttttctttagatgactgaaattgcctcctaattgatctcccttcttccaatcacagcctcctccaatccatcctccacactgctgtcagtatctttctgaaatgcaaatcggatgttactttatccttgcttaaattttctgatagttttccatcacctacagattacatttcaaattaaacaggataattcaagcccttatcactctagttctaatagatttttctagctttgtttcaggatcccaagctctactctgacccactggttcatctgtacaatggtccctgcaatgtatatacaatgcactttcttgtttagatttggctgtctattcaaatttacttctgacgttgtccccactttttcacctagtgaacaccttctctccactcaggtcttagctcaaatcctttcttcctgggaagcctctttcaaataccatcaagcagagtttctcactcacttctctgctcccatcctaccccctacttagctctgttatgtactcaccatgtcatagaatgatgtttatttacttgtcctccctgcctctatacccttagaaccagacacagtgatgcccaaaggctactcaataaatcatccatgactgactgcacagaagagaacttattgaacttttaggtttcctaatgagaaaatctccttcttggggggtttatataattcttgtttgcaggtggcccaatcctcaggaatcttgacatgggggatctcagacctagtcaccacttctttataaacatctttaatcaaattatggatttttggtaaataaacagcctcaaactgaagtagaatgtaaacagaaacaagtgtccttcattgctaactcttcttctctccacatatattgggccctttatacatacgtgtatgtgcaaacttgcaagtcccggatgaaccagctgcaagctgggtttcaccagcaattctgcatctgatcctctatgattgaaccagtccttgacattgaaagtgtacatcatgaatcactgaattgagtcttaattataggattttttcctttctatttttatagagaggcagtgaaattcaagttaagaatgtctcagctaatagatgcttcttggtgttgaaatgtggctgttctggcccctcgatgtccaagttcattcatgtagtccatggaaaagccaaaatgagggtctgagtctagatttccattctctttgtctaacaattagaactcaatttccttccagttaatggttcgctgcaccaacgctacagccacccaatgaaatctgccttttctcttttttcagaacagcaacaaaggcctgcagccaactttccaaagaactttgtccaaaatgagccaaattaaatttaaagatcattctagaatatgttcttctctacatttgtaaaagaatgattgcctggcaaggcagcattaagagaaaaggtcaaattctctccaaagatttccaacttttttttttttttacactagtagtgtttggagaagcaaattgtggtttgacttttttaaaaaaacaagaaagagaaaagaaaagaaaaagtgttacagggcggggaacatttcacactgggtcctgtcggggactggggagctgggggagggatagcattaagagaagtacctaatgtaaatgatgagttggtgggtgcagcaaaccaatatggcacatgtatacctatgtaacaaacctccacattgtgcatatgtaccctagaacttaaagtataatttaaaaaaaaaaagagagaaaagaaaagaaaaagtgttgtgggtgggaacatattaagaaatgcaacaatcttagcgtttcataatccttcgagaccttaaatactatcagaatctagtatctctaaatatagaaacagtatatttacaagttagtctaaagaatgtatttttctgttcacttagagaaagaaatgggtctattcccaaccttcacataagctgtctttgtaaacatatacttttggcctaccagtgttttcatcgaaaatgtcttagggaattttaatgtaattatcatcaaactgcccagagctaaataaataggttctcaataactgaatctacattcctccaacacctgctattttaatgataaatctagaggtttcctttctccctttgcagaacagataagacaatgatatgtgattattcaaaatgtgttttgtttatctgataaagattgggatgctgggatttccttatctgagtaagatcaatagagactacagtccatattagcttacctctggcagtggcctatgtaaaatgccatgaaggaaggctaaatccttataatatatgagaccagcttgtaattataccacaaggaaactaatcactgttgaaggctcagtagtcaacaaagattattctctaaattcctttgttagttttttcctccccctattatggtaactataactatgaatattatttcaggaaatgttttaatattttggtagaattctactaaaatagtctagagttttattgtccattttatgatttgaagcttcattcaacaaacatttgttgaggatttacctgcccctgaccctatgccgagctctgaagatataaatacagatgggataacatttacctctactacttagatatggggaaaaaatctatttcttgctgatggcgggtgagaaaccacttaaaatatttcattcaaagctaattccatctcttctgatttaaaaggtgaaactctctatcaggagcctctcttttctttttcccaaaatggtgtgaggaagtaggagaaagtgtaggaaacttccaggctgccagagtgaagcctggtcaccatgccatgttgcccttctggtcaagccatgctaatggggagcttccatccagggcttggaattattctgggcatccaaggacctgaggaacaagcactaagtctgagattcccacagaattctctggttatttctattctttctttaccctctggagagttttaaccatagtgggcaggtaaggggaaggggtgagcccagacaattacttctgacttatttttatcttctttcctgcagaagagagttctattttccttctgatataaggctcaatgacacatagctattaattagacttgatgagggtgaccatataatttattatccaaaatgggaggctttttaaaacaaaaaggggagctgggcatggtggctcacacctgtaattccagcattttgggaggccgaggtgggcagatcatgaggtcaggagttcaagaccagcctgagcaacatggtgaaacccggtctttactaaaaataaaaaatattagctgggcgtagtggtgcacgtctgtaatcccagctactcaggaggctgaggcaggagaatcgcttgaaccctggagatggaggttgcagtgagctgagatcacgccattgcactccagcctgggtgacagagaaagactctgcctaaaaaaaaaaaaacaaagggaggtggtcccatgcataattgtgtaccaaacaacaggtgtgattagagcctgacctgggttaaccaaggtgcatggcctccagttagatgggaccaaaattcacctaccttacttctagatttaggattctttgctttatattataatggctcttcctaaatacaatgcatagttgatgtagcaagagatttcccctgtaaaaacgtgtatattggagtttaaagacaagtttaaagtgaaattacttcctagtacctttttttggcctgaatttgagtgaaggtctcaaagcacaatgactgcataataattttctttttcacaaaacatttgtctccacttctattaaaaatatttcttagtctgttcttagtctgtttttttttctttactgcataactgagtatgcagttatgcttcaaccgagttcttaacagtgtgaataacttgattttactacaaagtctgtccatcagtccgtggaactgaaggctattgttccccttgacagcatacaaatgatggattgtctgtgcccacttgtttcagcttatgcagcagcttctgaacgattaatcccaatagttattatcatggtagtaactaatgtaggtaaagaatctaaagctctgcaaaccttttcacatgctttatctcacaagtactttttgtcagataaataggttaaggcaagcattaaatgtatgcacattttatacacgaagacaccagggcttggggaagttaagcaactatcccagcatcccagtgcatcctggtacgtcccggtgcaagtgacaggtgaagtccagccctaaagtcagaggtccttgctgctgattccagcctcccactactatacttccctttctccagttttacttaaaatctttttttgggagtaggaaggaaggagcagagggagagtggccagaaattacttcatgcaaaacaatttgatggctttgatgctgcatgtatctgttttgggaaaatgaaaagaaaggaaggtatcagccgtaaaagagatgtacttaagattcaggagcaaagctcaagagagctcagttataaactttagacaagcctagaaggctcagcacctagtaatgaatggcaagttaacattgctagatggtgataaactcctctaactgagacttaacttaaaaatatggcagaagaaatatgaaccctgctgaggttagaagctccctctacctgtaaaaagcaggcccagtgaggggctcctgctgagccatgcaatcagtcttggacaagagccttttatccatttgtccaaaccctgagaagtcacggtcccatcttaggctcagcctaggcaagatgaagccaccccaaaatatgtcttctatgccttcccacctcctgctctccagtcttcctgattgttactgcaggggccagagccctcagactgccagcccagccctctgtgtccatcttcacaagggttcgtcttacccataaagtggtcctgccctgtctcatcccattgcatttgtgtagttgaccttagcaactaagaggaggtggttctattttctcagtacagtaactttctttttctcatcacaaaagcaatatgtgatcagaaaaaaagtttagaaaacataagtatgtaaaaactaaaaatcaaccactattttaccacctagatggacaaccattatttatatttttagtgactatttttaggcttttttatctacgcatttttaaagatcatactaaaaccaaatttttatcttgctttttttcatttaacatggtaatgcaagcattttcttgttttaataaaatactcttttaaacgtaatttcaaatagttacataataacacatcctattgataaaacaatttgagtctcctattactgaagagttttcttccttccaaccttataaataactactatgatccatatttttgtacataaacctaatttcacatttctgaagttttcttttagattgattattaaaagtagaattatcaggtcttgacttggagctcttgattcaatatatggaagaaaagaacagtttttttgtaagcccattagtatcttggtgagagttatgggacagtgtatagcacagagtagatacaccataaatgttgtaaaaatgaataggcttaattctattaggagtatctgcattttaaaagatgaaatttgttagcaaatgcatcttacattggtataaattcagagagcaatatttataaaattgaagaaataaaagttatagtgaatacaagactgtagaggagaatggggcttctaatgagcattacctcaatctgcattgtgaaaaccatagcctatcatggtcaaagtaaatgcagctcttatgacattccccagctccttggtcagtcagtctgcatggcctggcatcacactagggactggaatctatcctcaagaagcacgcaagcttgtgggagagacagatttgcagacaacacacaaagaaccatgagaagggcagaactgagaggtctgagcacagcagtggaagaagtcaccagctcttcctggggaagcccccttggaaagggggattttggagctggatcttgaataagaacatgtgagaaaagcactccaagcagatgcaaatgcaaagacacattcttcctaatccagagaatcctagtgatgggatgctaatctcccctttctttccccaccccagtcagcaccttgtcatgttggtcacttaacattttagtgagaattggttactctgactttcctcagagcagaatttgatgaagagaaaagagatagaacctgagaactggaggtacttgggatcaaaggggcaggagagaataccattaaaaaggaaaggggtacagacgggaagtagagagcctaagacaagaccactgaactattccatagggaaagggagattaggcacatagagctgtacaacaaggtgatgcctaggttccaaataccaaaaccctcaccagtatgggagtgtgacctggccccaagtgaaggttacctaacctaatccacagagtatcagtgttcttctaaaagtcctccagcaaaggttaatccactctctgttatacaattctattttattcactcttcacatagagtctgtagcagcttttggatcttttctgtctactctgtcgtgattgagaggggttaagctggttgctagcaacctggctcctatctctctctctctaatctcatctggtcctgctctctcctcacataccaaactccagcagactcacctgctttctgctcatcaaccttgtccctacctcagggtcatgttatctctgcttgaaattctcttccccaaggtatttccaaggctggttctgtcccttcctccaggtccccgctcaaatgcatctcctctgtgaagctgtttctggccaccttttctttgcctttctcctgcatttaagttttcatagcacctatcattcattgaagttatttctgtgtttacttgtttatcatgggtcttccccactaggatgtaagcctcatgagtcaggaacttggcctgttttgttcactgctataaccctagcacctagaacagtgctcaataaatatgaattgcatgaatgaataatcaacctttgagatatggtcttttaaagtttatgtccttagctccttgctcatagcagctccagtgtgttcattgaattgaattgtgctgaaagtcactattgattcagcctttttaggcaacgttacctcagttcttccaagcgttcctttccattccccttctcaaacacttaaccccacaccccacaagctgtgaacatgatctcttccagccacattgctcttcctatctgcaatcagcagagcacacagagcacacaaataacttcattttctcctcttttcaaaactgcaaaacaggatgaaataagttctgataaattttgaaccaatgtgagttgttaatttccttctgctctattttcttaccccgttgtttctggctgagggctgatggggaaaggactgagatgagtgacagttcaccaactcccactactgccatggcatcaatcacagagagattgtggaaggtgacgggggagggggtgcagtggcgggcggtggtggcgggacacggaagaagcagggaggcgctgggagggggtgtgcatgaactagctcaggcagcagaaacttttatttttctccttctctaggcctccaaaaatggccgaactcagcagggaccctatcccacgtctcagggcccttctaggcctacttgtttctctagggaatagctaagaatcgggtcacttcagatgcacggatcatgtgaaggcagcaaggggcagaggaagaccacacacttcaacatcacaccatactccttgccatctctgcaacctgctggatgtgcgggaccctggcgcattacctaacctctcgcagcctctgtctctcttgtggataaaatgggaacaagagtgcctactcagaatggttgcctgtgcttctgtgtatgaatggtgtataaaagcacctagagggccgggcgcagtggctcatgcctgtaatcccagcactttgggaggccaaggtgggtggatcacttgaggtcaagagttcgagaccagcctggccaacatggcaaaaccccttctcagctaaaaatacaaaaattagccgggtgtggtggggcacacctgtaatcccagctactcaggaggctgaggcaggagaatcacttgaacctgggagacagagattgcagtgagccaagatggtgccactgcactgcagcctgggtgacagagtgagactccatctccataaaaaaaaaaataaaataaaataaataacctgagttcaggtataggcaaaataaagtatgtgtttatgttcacccattaagtgaaaaagaaaaaatatattatgattggttgtacttttccatttcaaaagtcagagacatgcttatagatgctaacattctaattaatggattcaaagtagatacaaagctttactcagttgttcagtttggcattatactgtccaaaaattaggcgtaattggagttgtgactccaattgtcaacataaccagccacagtgtaggaagcacctactttacataatgattttcactctcattatatgttgatactaaagttgaaaattgacttctttagggctgtgccaaagaattctcagagcaccagctactctgccatcaatattgggctctagcctatgaaattctgtcatctaaatcttgcttagaaccagtcaagtcattcaactcgaataaagtatcagtagtgattttaaccaactggaattaattactttaattttctgggatggattaattcacaaatgcataaagtaaggttatttcataggattctatagttgccatgcagtgattaattaaaaatgcctgaagtcaattaaaaaactatttgcagtagtaaaaattcaccctggcccaaggaggggtagctttgatttcattttcaagagaatttcaatcaggttttatcttaaggccctaatgaatatattcatctggtgccttgctgtatcatgagaggacaatcttttcacctttcctccctttcatgtgtttatgggaaggagctttccttttatatcaaataaaatcaggattggcaccaagggacttctgcatttagaagggcaattctcactgctggttgcaggtatttcctagtcactatgagaaggcacaatgcctggcgctctagttagacaccacttcactgctggtcactgcacaatgagatatatacagtaccttcacttctgagacacaacaaactaaaaaatgaagaataataaaaagatcaaagtagaggttcgagaataaagataaactaaaaccagaactctagcctgaccaagcattagtcatttataacagggctcaaagtagtcatgggccaactgtattcaatgttattcttctggagagaaagagcatcattaacttcaaagtcatttactagctcttgatgcatcttagtagctactgagtaagcatgtgctggattagaaaagaaaacaaacaaaaaacagaaacaaaccaaaaccaatgttctggcaatgtgagaacgtttgtagataaaatgaaattaaataataaaaggatgttggcttcaagagatcttcagttttcttctgcttttatttaatttttgggtctactgttcaaggcttccttactgcattttttatttgtcaaccctagtattcaactctagtttcagaattgttaactcataacccggtgaaaaacaaatttgccaggtagagtaccgtgtttgtgtatagttttttgttattgttgttcttagctttacaatatccagtcaaaagactgtttccaaaattatttgtcaggtcctttgcccccatctccttcagtgtggtatgccattaatctgtaatacagttaaattcatttctcatagtctgtatttcatcttgggtccctccaacattctggtagatatttttaaatttgcatagagtgaaattcactttttgtgtttctacagttgtatggagtttaataaatgcacaaagtcatgctattgcccattcagaacagttccatgagccctcaaattccctcatactgccactttgtagtcaagctctccccacctccaaatcctggtaactacacacctgctttctgtccctctagttttgtcttttctagaatgtcatgtaagtggaatcatacaatattgtagccttttgagtttggtgtccttcacttagcaaaatgcctttaattctttttattgccgagtagtattcctttgtatgaatgtacccaaatttgttaatccattcatccgttggcagatatctgggggactttcaacctctggtgtttgtgaataaagctgctatgaatatttatatacacttttttgtgtgtgaatgtaagtttttaattcactttggtaaatacttaggaatgaaatagccgagtcacatggtatagattgttgaactttgtaagaaaccttcaaactgtttttcaaagtgggctgtaccattttgcatatcaactagcaatggaatgagattccatttgctctgtatctttgccagtacttagtatgtttgtttgttatcttacactttctaataagtatatagtggtatctgattatggttttaatttatattttcctaatggtgttgagcattttttttcatatgcttatttgccatcaaatgtcttctttggtgaagtatctgttcagtacttcggctatttttaaatgagtttttgcagatattttctttcagcatgtaacatgtcttttcattctcttaatagtatctttctcagaacaaaagtcttaaatttttctaaagtccaatttttaattttttaatggatcatcttttttatgtcatatctaaaaactttgtcaagcccaaagtcacacatattttctcccattttttctagaagttttatagtgtcatattttacatttagatctatgatccacttttcattaatatttgtataagatgtgaggtttgtgtcaaggttcaatgtttttacaaatgaacaattatttcatttgccccatgaccatttgttgaataaacaatcctttctccatttaattacctttgcacctttgtcaaaaattagttaactgtacttgtgtggggctatttctgacctgtctgttctgttccacttactgtctattctgtttcatttatatgtgcttcactccttttaacatacacaacactgcctttgattactgtagctttatattaaatcttgaaatcagatagtatgagtcctccagctttactctttttcacattgttttgaatatctgagttcttttatcttaccatatacatttttaatcactttgttgctgtctacagagcattttgctaggatataaattgggataatatttagtcctttgatcaaattgaggggaattaacatcttagccatattgagtcatgcagtccatgaaaatgatatgcctctctatttagttaggtcttttttcatttcattcttcagtgttttttagtttttagtatatggagactgctcatattttaataaatttataaacaaatacttcattttgagggtgctattataaatagtattactcttttaaattttgaataccaatcagtagtttattcctaggaatacaattgacttttatatcttgatcttatatctcacaaagttgctaaattcacttattagttctaggagatttttgtagattctttggggtttttttctacatagacaatcatatcttcgatgagagacagttttatttccttttttaaaatatgaatgccttctgtcttgccttattgtactatgacagtgaataagacaactgaattgtaatagtcaatctaaacataaaagaaagaagaataaaataatatctaactgtgggctccacatcagagagttaagaaaggcttctcaaacttttattggattgttcatttagtcactgaagtattgagtcgcacttccatggtgctaagtattacgaggaagacaaatataaatcaggcttggagtctacaatcgagtactttgcaaatgaggaaaggtaacagggcatgaataatagtggctacataaaaagaaagtggtaaggctgatcagagataaacagagagagagaacaagattgaatctagaggcagaagagcaggccaggagctagctatctgtcacaagagtctgacctagtagtggctgtgaagaagtcagggtggtgctgaaggaagctggctcttctggatttgctggctcttcaggatttgctgactggctgtagagaccaagggagaggaagaagacaaaatatccaggtttgagcttcattgttttgatgggggctgacccacagactgacattctgaatttgaaatatgcactgaagattcagatgaggtgaccagcaggtggtctaaagtgctggagttactagaattaaaaagtagagtcaagcctgaacataagagtagaccatggtaggattctccctttcaccctagccccaaactctaaggttgcaaacacttgggacctgggacttggcccttccattggaacagtgactacagttaactggagaggtagagggacaagaagggtctgagtggggatagaaggcatcctgctaagcaggttcacgagctccagcctcttgtaaaattaaaagaagtcctaacacctatgctggttaaaagaaaggccacaatgtttacgatgttcctccactcaaagcagggttagaaactcacttatggaggcaagaatctgtcttctgaaataaggtgaaatgagttgcccctaagtaccaggagcagagcttggagtcaatctgtgtttgtctaataacagcttgcacttacagagcatttaccatgtgccaagccctatcttaaatgctgcaaccctcacattgaatcctcacaacaaccctatgaagtagtttctattattatccccatgtaacagatgggacacagagaggttccatacatttcccaaggctttgctgatagtaagtgatagaggcactgccgcactatgctgcatttcaccactgcactcaactgccccgtgtcttctggcaaaccacagagcctccctggccaagaagaaagtcataagtgagtagcaatactgtctttatccacagcaaagcgatagcattacagcacccactgtgagcatcactgaacagctgttatgcacccagcactgtgctaggtggtgggaatatgcagacaccttagacacaatccctggcctcatggatctcagtctggaaggggaaataatctcgtacacaataaccataagatgcactgtgatatatcgcactctgactgcagatgtaaaagacatggcacatagagaaacaggcattaattttctgttcctctgtcaaggaaaatgaaaggcagactaatgcattatggctgaaagcatttacttttgattaagtgtatgtttaaatatcaccctcctcctcagtcaggctcattcctcagtctctgctacattgctgactttgctttctaaagagaaagtgagatattcacccacagtaaatggaataagaaagatataaggcatagaagtcctacctcagattttttttgtttttgtttttttgcctttgaaaactcatcacagtgaaaactaattacagctctcatcacaaagagaatgccagagaaggctttcccttcattttgtggaaagagctttaaataacattacataaaatacacaggatcccagttaatttgaaatatagttcaaaatatgtaaaaaccaaatctgtgatctagtaatacatacacttctttattaatgtattaacaagttctaggtgtgggtcaattgccacaatttccaagtggtaatgagtgtaaatggtgagcgtaaatgattttttgatgtcttcaactttgaagtgatacaaaaacacctgcagtttttgatggtgtcaaagtcacaaacagtaacatgagtacttatggggtttcttgcctacactgagaatggaaggatatgctaactttcagttaaaaggtggtgaaacataaagatgtatttttcccattcaagtttatgtatccgcagattatatgcccttgagacagaggttccagattcttctgatttaagactttttgagttactgatgtccagcttttctgctgccttagatgcttgagacaggaaaagcaaagagtagctcttatttaagggctaagtagacatgagtgggcacttctcaagccccacctccacagaacactcaagtttgtatggttatatccatacaactttatgtcacagctccattttccctggtctggtgatcatggaaacagttctaaacacctcagatttctatcatttctccaaagtgccaccttcttctttgcctcttttatctgtcttcatcctctgattcccactttttctagtgactctagcaaaataacttacaattcacatataatagattcaggctatctgcaatgtctaagcacaaatttatctaggctggaagatcattagggcaactgagaggatcattaggccagggaagtgggtcttgaaagtcacagaggcagccttctaccagattttgtacccataccagaaccagattcagtgtttaaaatagcgcttttcctaagaaataagaaaggcagaaagcaactaacactaattgaacactgaaatatgctaggactggtactgcatttatattttctcacttaactgtcaacaaaagtagtgtgcgatgattacctccatttatgaatgaggaaagagactttaaaaagccaagcaacctgcccaaggtcacacacatctggtgaacaccatttctacacctttcctctccttggcccactcagcccggcttcccatccgtgacacaactggaatggctgccacagaagtcaacagccatccccacaaagctgaacatgaagggaatttctccaccccactcgctgcgctctatctcatggcagacttcaacactgctgcccactcactacctgctgaaaccatcccctgctttggcttctccacagacactttcctgatctccatgtacacctttgccgccccttctcaattttctttgccgatgcagcttcctctccatcatctgtggtgctggagctcctcaaggccccatcgtgggccctgttcactaacagaatcggttccctcagccgctgacccagcccatggtgcctgttaccctggacactcagaaaatccctctccccactctgagttacaggcaattaaccttggatgtctcatggatattcagtccccacgagattgcccaaagatccaaaaccgttgttcccccaatgtccccaatgaacactctacttcggtgaaaagcacccctcttcacccagctggccaaatcagaaacctgagaatggcctgttattcctcctttttcaccctcatattcaatcaaaataccaagtcctgtagattttacctactggggatatctggaatcttccccatcctctccactccactaaatccgatttcaaggtagcaccatttctcatcaggattaactaagcagccatctagctcctcttcttaccttccttcaacccattttccctgctaacatcttccattactccatattaaggtcaaaatctgcaacataatctttaaggcactgttttatctggctcctgccaccctatcagactcatgtagagccactcaaccctttgttctcccctcctctattgcctagaacgtatttcagttcctcaattacccatgcttcttccagtctctgagcctttgcacatgctgttcactctgtttgaaatgctgatccctgctctctttactaagtttcttcctactcttcctttggatctcagtttaaatattacttccctagagaagcttttcctaaccacgcatattaggtcagctttctgagggtcccaattttgtatttagggcctactatccttttatttaatattataatcaaataattaatctatttaatacctgtctcacctcctatgacataagctgcacgagagcagcaactatctgccactcagcccaggctcacagcctagtctgaggcctggtacataggtgaaatttggtacatcttctttgacctaattaattaattataggaaagtctcttttttccacacttctctagacttttctagaaagatacggatcatcgggtgttttatttgtccaaagaaaatgaataagaacctagtcagaatttgcaattgacaaatgacttaaacttttaaatcaaagaatctggaagaatcctgttctactttgttgctatttttaaaaaggtaagaataaaagttttgttctgccacctgtcaatgtctgtcctcaaaatgcctggctaaatcatttgtgtgcctggtgaatcccaaatgagtcattatttacttaccaacaatgatgaacagtgccctcataagaaaatgttattactatttgtagccaccttcatggctgtcaaaatgtatgttaccttgtaactatcaaaaccagctggctggcaaatgaacatgatttctgctcatgtacattattaaatgtgcatttcttaaaaaaaacaaacaaacccaaatctcatatttgattagtaacttccaggtaaggcagagtataattcagaaggatcagaaagatgttcaaatagagtgagacagcaaatgatgtaattctctgaccacatgaaaaccaggtcaaacccagcttgtttctgccagcctgacacagctgctggagccccttgcatatgctttccagctgtccctgttacgtcaacctttaaatcggggattttgccccatgcatatgcttcttgcttggtcaaatgcaaggcacatatttttgcaagctacttttctcagctgtttaaaattgtgaataaggtctaagatacgtacatcgagaaacaagccatttaaaacaacaaatttgggttacgaattttctgcttttagcctctttgacttgtaaagaaactgtgagcatcagagtggcctgcaaaactgagcctaagagatgcttgatttcagttctcactactccagtattgccttaaaagaaaaaaaaaaaaagcctggtggctgctccataaagtgaggctaggaattacattcagtgcctctgccatggaacaaatcattgtcctgaaataaggtcagccatgtattcaccgagtggagagtctgccttcagaaagaaaggggaatcacaacctttgagctctcaagaagctatatcccttctccacataactctttactgacgctgtaggatttccaaaatttgactgacaaagctaagtgttctgtgcctccacattgatgtcatttgtttctaatattagcagcagagcagttcaggttcacctgagaaagaggagcttttattttgagttgaacaggagcagatactaaaaatgaacatggtgagacttgtttttgatatctctgacatagataaaatagttaaacctgtgcagtgaaacaattttgaatcaaatggaaaaataattcattctaattggcaatttgatgtgcttacagaatttttatgtagcctcacttatgggaacactgaggaattaagaaatagaataatatcatataaagttgtttttctgcacaatgtcacataagattatgaggtatttgtgaaaattctacatgagtgagataaaggttccagggtatgtgttatagcccagcatgattagtaaacttggtcattatttgatattaaagccacacaaacaagctgctgaactcattagatcaaatgtgtcaagtatttgggcttctattacacatcagatcttaagtggcttagagtaactggacaatagctacatcttcacttagtactgcacaaacatggatagagacaggaggatgcagacgtgccatttggaatagcagaaatcatgttgggatttcatgccctgaattggaggtagctagttcctcctaccttctccagctgcaaagtgagtggcaccatcctgtgttgggagtgccttaagtggtacacgtctcacaaagagacttgcatctgagcaaagttagagcaatgcacacagagacccagatatatctcatgcagagaaaatgcctctcactttaaaagtgaccacctgaatttcataactgttctatctagaggatgaaggtatttggaaaaataattaaaagtattagagttaagggaaacaaaaatatcaaggcttaaggtggggacctatcaccactatagcagtattagtctgtaactgaacttttcttacattttaaaatcttgtaaggctttcattccagaaaggccatcttgggcgtttaaacagcagtggcaagaaaatgggccattagtacttgctagtttgcagtttgtttttgctgacagttctcatgtttggtcttcaaaacccataacagagtgatcattatcttcagttgctgccataaggaaaataggactgccatcaggaaaatgggtgctgagatgttgctaagtacccagtgatataactttgccttatttgagtttgttagaacaatctctgaactagcggggcacggtggctcacgcctgtaatcccagcactttgggaggccgaggcaggtggatcacgaggtcaggagatcgagaccaccctggctaacacagtgaaacccatctctactaaaaataaaaaaaattagccaggcgtggtggggggtgcctgtagtcccagctactcgggaggctgaggcaggagagtggcatgaacccgggaggcggagcttgcagtgagccgagattgcaccactgcactccagcctgggcaacagagcgagactccgtctcaaaaaaaaagaaaaaaaaaaaaaaagaaagaaaagaaaaatctctgaactatagagacttagccttagaactgtcttgctctatagagttttctacaagtcacttctccctactgaaagacattaaaaatacatgaaaacccttttctagatccttttctccatgatacctacaaagttatgcaaatataagcctgaggaagccaccacctcatgtgatctccacggtaagatgtatcccatgttactggaattacatgttggtttttctgtgtccctcagtggactctaagctccttgagggtacaggaccatgccttgttcttctctgtatctccatgactttttaaaaaaattctccctacaatatagcatttgctctagattcctaccccttaaaatcagtagacttttggactaccaagaaaagtctttgtacatctattgatttctgaaaaactactaaatgaacaatttcttataaaaattatgttcactggagcaatccaattattttcgtcccatttagtggttcaaaatattttccacatgcatctttatgcaacagttttcttccagttggacatgtccagttcatatgggaaaatttagcaccatgtctggttggagggtaggagtcagaaagcaccagaaatcgctatgccttgcatttgtttacagtataacactttagcacacattctcacgatctggccctacaaacagtgatgctatgcaaatggcatagacatcaacgctacatcttccaaatgaagaaactcaaccccggaaagaaaagggagcaatttctacaaggtcacccaactagttgtgacaacgggtcaaaagcccgggtctttcaactctttgcatttttatgcattttttattatgttgtgcaattgaatgtgttgcttaggtggcattttatagacaacattaataagcagaggaaaaacatgtgatgcaaaaatgggagtactaattgctaagtctaaagaaaccaaaactgatgacaaatcaagggagaacttgggatagttcagctgtgccaccaatttggaagttttatttgtgttgtttcctttggtgtgggagcaagaagggaaactgtatttttatgaaagccttttatcagagaataagggtgcacttttctacaatgttacagttatttcagctttgcctgctcactttggacccttacactaatgctatgaggcaccctgtctctgagaatttgtttttttcctctatgctagtcagaagacaaaaatgggttgagtctggatttccacaaagacttataggcaaatgcatactagagctcctagttctatccttgtttagaaagcaaaaatatatttcttttccttaaacttttgggaataaagaaatatctgatgttcccgtggtaattttatgtaatcttgaattaaatatatatacacacacacacatatatatgtaatatagttaaatatatatctatgtattatattataatatattaaatataggatatagttaaaataacctaaaagatagttttatatttgttattttaataattcacatccattagaattaatattctgttttagaagtcagtttgttagtcagtaagtcaaaaatatttattaaggctctacttaccgtgtgtcaggccattcaacacaaatcagaactgttctgtgacctaagtctagaccaggatggtaactgaggaagtagtgagaagtggtcagttgacaaataatgaatgaatggttggtgaataagttaaagaagtttaccctcaagaaactcagattctagaaggagagagaaagccagtaaatgggtaaacaagttaataaagaagacaatatgagactgagaagctgtgttctgtgagggacattttctgtgctgcgcctgaacagattttgagcttcctgatgcctgagtggccatgcaagggagacctgtctcaagacaatatgccggcatctgtggttctgcctctatcaggactcatcaagaatctgccaaaatggagatacaatatccacttatgcatgtacagttccacctgaggaaatgatgaccaagtgttgctttgtttttattataggaatcttggaaaatcaggactcagagtttcttgcttgggtcttggtaagtactgagggtgtgacctgggggtgggctggaaggtgggagactggggagggcaccagggagtgactgtggtctaggccaggacctggtctcagatgaggaggaggcttcctggccagtattgccccacttctcctttgagcctttctcttcccatcatgaccctctcccagggagccaccgtgttcatgattccttataggggcccgtcgagcataaggcaacctgatgctaaagcacacctcagagaaagggactcatgcgtcactcccatttagcaagcatgaaggactgcatggcatgcattttataggttcagttcaccactccctcaattcacctgaattttttctatctatccttgttttccctttgcctaatttcctcacttttctatattattattatgcattttatatacttttataatctgccttaaatatttgggggggcaaggtgagatacacataaacacatgtacattaatatgcattaataaataaaaagtattattcctcccagtcaatatttgaagaggattaaatagagatggcaattctaacagcataaagatgaatctgaagtcgtggaatctgactgtgagacttggggaggcttgaggcctccagacatcccttaggcccaggaaaaggcagccttggcattcctgccattcaacaccaatcagagctgttctgtgacctaagtctagaccaggatggtaactgaggaagtagtgaggagtggtcagattgtggctatgttttcaaggtaaaacctgaaagattttctgttgggttctatgtggaagatgacagaaaaaagtcaaggatgactctaaggattttttgcctgagcaacagacaggatgaagtatgagtaaatgaggtagaaaaatgagagagaaatttagggagattaggagattgatttgggacatactaagtttgagatatcgattaggcctgcaataaaaattgtcaagtatgcaaatagacttatgactccaatttagaaaggagagctagatatattaacttgagagtcatcagcaagtagatgctgtttaagcccggatcctggatgagagcactaagggtgtgcttatagacagaatagaaaacagaggcacatggtctaagacctaggaaatccaacattaagaaatcgagaaagtgaggaggagccaaagaaagctgaaaataaagcaaccagcgcagcaggagaaaaatcagaaaaaaaaatggagtcctggaatccaggtgagcatttcgaggaggatggagtgaccaatcccgtcaagtggtgctcatgcatcaagcaagatggggaccaagaattgaccatcgggttcagcaacatggaggtcatcagtgacttttacaaggtctgtttgggtggaatggtagagtttaaagcataattggaatggtcccctgggagaatggaaagagacaagctgaaggctactcttttggatgatgattgctataaagaaaagcagagaaatggagtggcactgagcagacaagtgggatcagagaggttgcttttgcacgtggaagaaatgaccacatatttatacacttatggggaaatccttttgagaggaaaaaatgatgcggaaaaaggagagagaagaatatctggaatgatttcttgaggacgtgagaagcacacaaggagacagtacatgaaagaagcagagtacatgggctttgaggctagtagggcgattgatggggtggtggagggggaggtattttgtcaaagttctcttctattgcttttatattctcagtgggaatcagaagcaaaatcatcagctgttagtgaggatgagaaggaagtgttagaagtttggagagaagacatgcgggacagaagagtgaattgaccagggctaggccacacagtgacaagatagcattaaggatcagcttaagatcagtatgattaaatttgaagtgagaccatgtccatagttatgtgtttttcttctagacatgttcagctttgcaagttcaggtgggtttttgtttttttacataagatgataaaaagagggcaaagatgctgagggcttgtgttgggcagttattttaatggtggagttggcatttaaactgagtagaaaggaaaatgaggacagagtcaggaaaatgagccaggagctaaaatgagggagctgagggactgtgaaaactggataggatcaataaagtatatatcccagagggactaaagaattgttgaagcaaaaacattagagacagtggttggaaggatagaaagtggttgaaaagggaaacatttgaaattggggttacagaggggttcagttattgttagtgacatagtctatggtgtgtccattgggagagaatggtggagattgtatcgaagacaagatcagtgaaggagagaaggttaagaaacttggaggtgaaggtgcagggaagatcatctttggggtcactgaactcactaaaaagtacagcaaaactaacattggagagtggcagtgagaagtgagctaaaattttcaaagaatgagagggagtgaccagggtgggtcagcaactacaacatgagggtcctgatgatgtgtgagactcagagctggcatgtgtgaaggggtatttcaaagatactgaaagccatcaatgtctgagtttttctgattcttcctaataatctgacttgggaggtgaaggcagtattgttcaccataagtctaaggtaatttgacatttgcttaatttatggctctgatattgttactatttactcatatttgaaagaccctggagattcattaccagggacactctgaccttagtttttttttaagtatatctttacagtaaataactattcggtattcattattgaaaggaactacctattaatgtaaagtaagaaatatatgtagtgaaaaagcattgcccaactatttacaagcttgtgtctacggtggaaaatagtttagtcaataagtacacagaaaactcagctgaaagcccttaagacaataacaaattcaggtgcccatgcaatcccagtctccagaggccagtctccagtttttgttgatttttgttttctttaaaactgcagactgtgtatgaggtgcaggcattttagtgaactttgaaacaggcttgattcaggagcagcaagttctatttgagcttcaagttttttcaagagcctgaacacttgtaataagacactgcatgaaaaataagaggaaacaaggaagttcatagggctgacttgcttcattcaaaacagttaactaagcttgacaacttgaataagcactctttcagaacttttttgaactgcctctataagccagaggagacaagaaattcatagaaagaaataatgcaccagccttagataatttgtcaggctctgcagaccccagctgtcaaatccaaatggagctgggtttactgctgcaggcttaggatgtcagctcagtcacgacctacgttcaactgaggccttagaaattaagtagtaaaactgccaggaaatcagaaagctacagattcttttcttgaaatactctaaaagtgatagttaaagctaacaattctgactttcttctctaccagagaaggggcagccggaaattccttgccctgacaattttccttttggtgaactaagagcaaatgtgtaaatgggagtagaaaggtgaagtaacttgagagtgaactgatggtacatccgaaagaacacagccctgccaaggagagaaatgggaaaaaatattaatattatgtggccaatcctacctgtgggttgctgtggcttgcctgttctgtaaatatactgcccattattgtcaagacttgaagtcaaaaaactcatgggaaaggaataaactcagagtgaccaaactcaccccgatctgataggaggtggaactgccttatgagagaaaaatggtagaatttacgttaattcactcattcatttattcatcttaagcaaacatttatgaagccagacattggttacagaagatacgaggacaagagcatggagcctgccctcaaatttatcatagtgcagtgggagttaggcttgcaaaaaaacaaactgataatgtatctgacagatgccgtaatggagagtacagggcaagtgaagcgtgaagaaggtctcctgggggatttgggatagcttgatgggggaacaagggttgccacttggcttgacacttgaagagagaagtcaagtggagagggagggcaagaggtttaagacaggaagcaatgcaagcaacggcgactccagagggagactccaccgaggggaggtacttggggaaatgggtcacatgtatagaatattatgagtacaaggtattggggaacagcaagaaatgagcctggaaagaaagctaggtttgattataagaacccttgtttgccttgctaagccatttagctcttgtcttctatgtctctggaattccttcaaatccaaaggtccccaggtctcaacaaacacttcagggacaaggaggagcaaaggctccatctctctccactctcttccttccacctgccacagcttccatcaaagcagcccactttttctgcatattattattattattttaaaaaaatagactatgttttaatgcagttttaagttcactacaaaactgagcaaaaagcacaaggagttcccatacacccctatccctacacatgcataacctccctcgttatcagcatccttcaccagagtggcacatttgttacctctgatgaacctacagtgccacaacattatcaaccaaagtccatagtttacattagggttcactattggtgttgtacactctatgggttttgacaaatatataatgacttgtatctaccattatagtatcatacagaatagtttcactgctctaaaaaatcctctgtcttgcctattcatccctccctctcctctaactcctggaaatcactgtctttttactgtctgcatagttttgccttttccagaatgtcatatagttgaatcatatagtatgtagcctattcacattggcttctttcacttagtaatatacatttaagtttcttccatgtcttttcatagtttgatagttcatttctttttagtgcttcatactacattttggaaaaaaaattcatcctatgccaaaaacagttatcaaaaccttgctcaagcttgtgataagccattgaaaaccttgggtcaggaataagacatgatcaaaggtattagaagcaacatgaaggctataatagagggaacagggttgaggctggaggcagggaaattaattaggagttgatgatgaggcagtggtatgaaagatgtagaggaaggaggtgattaggagaaagaatgagtagggctggtgatctctggatacagaataggaggtcttcctgagtgcaggaagatgcccagactcctggattgggcatgggggtggatgagctgaaatctcagagacaggagacacaggagggagctgtgagggcagacagcactgttggggagtggtgaccaaagagcttgtgacctcccagcttcagatatctagagaacaaggggaactctgtggagatctctaggctggaaatacagacccaggaacttctcacagtgatgaccctatgattgtcattgagatcacctggaaacacagaagactgaggtgtttggacaggtttaggacatctggctcatggtgtctgcctgagtgtatgctccctgagagcagggactgcctatttttctacactcctattgcactttagcagatcacagtatctggctagtagcaggtattcaaaatatttttgagtgaatgactggagagatgatcaattgctaagaaatgacaaaaggtccactgaataatagcaaggatgcagctgaagtcagaaatcatgaattgctgaggcccagcccagttctttgacttcctccagtggtatatcaatgaagagacagaattgtggggtagggagtggagatagagagaggcccagcatcagggattgtcctaaaagagcgttggagaccggggaacctaccacatacacaggtgatatggggtctaggctgggtttagacccagagctgtttcatcagggctcttgcttctacagttagaaaggagcatctgcccacactgacttgctccaaaagtctcacattaggagcagtaggccggtctgattcattccatgggaggtaacacaccacaatgtccagctcacctgtgtgtgcttgaaaggggctgactttaccttccaacattcactctggaatgggcatgcttcccagcaggcaagatgtctgcaagaaaaaaggcacatcatggttaatttgatgtgtcaacttgactgagccatggaatgtccagatatttagtcacattttattttgggtgcacctacgagggtgttttggaatgagattaacatttgaacttacagactgagtaaagccgattgccctccctaatgtgggtagcactttcccaatcagttgaaggcctgaataaaacaaaaatacttgccctcctgtgaataagagggaattcctgcctgaccatttcaaactgggacattgatcttttcttgccttcagactcaaactgaaacatcagccttcttggatcttgaaggctgccagctttcggagtagaactataccattaactcctttgagtctctaacttgccaactgcagatcttgggatttcttggcctccataatcacatgagccaattccttataattcctctatacacacacacacacacacacacacacacacacacacacacacacaccctattggttctgtttctctggagaaccctgaggagagattttgttgatttttttttcaaaacatcatgcaagtgtatgtggccaaccagagttaagtatttgtaagtgatataggtaggaagatatggaaaacctaagtaaggagtaatgtggtcacttgctcatttttcagctgagcacatattaaacctaatgtaaaataccgtcatccaaatggagctttcctgggctgttcgcaggtcaagaggacaatttatgcagccctgtcagatagggtttgatctggacctaagcagtgaaggagagaaagaacacccccatacctttgggtccctgtttcacacatcctcaagactttaattcctagggaatgcaaactgattccaaggaaatgttctgtgtccttttaggcagctgcttcatgcttcgtccttgaagaaataaagtcataaagtaaaatacttcttaacaccttggaggacttatatgagtctctcaaaaggtgtttcttctcaactctggctgcacattgaagttacctgtttaatttaaaattcagataatctcatctcaacctagaccttttcaatgaggagctccacatgcatgtgtttttcaaatgctgccctgacggttctgaaggaagtatcagggttggaatacattgtcttatctggatggattaagatagaaaaatgtgtgaactgatatctagtgtacccagtgccagcagccatgattcttatctacatggcagcagccgcccgcagatctaggcctgggagctggcctgaggcatttccaactggactggaaagcctccaaagaggagaatctgccctgcttagggctggcctcagggcaggtggggtgagctggcttccctgccattcgactcctgccatctgggtgccagtcttgccttatgcccctccctaaccaagagaactttctagagcaaaagcagtgaatcttaagaataaactgtgtgggcttctttttaatgcattcatatgtgcagaatgtagtcctggctcatctccgtctgccttagtgatgctctcactgcactaaatattttgacactaggagaacacgacattaaatatttaacatggatggtattatttttatgacacccttcatgattcccattcttgttgtttaggccgatataaactagctagctcacctattataacaacataagagcagcaataataaatattatgaagtgcctcctgggacacttgagaggtagttttaaaatgcaagctttccctgaaagagtttaccaatttttctgcataacacaaacagagtgaactatcgtaactccgaaatacccatagagtttaaatggtgtatgaatattaaacatacaagagtgttttaggcatgtcactctttctggaaagtctaacttgaataaatgtcatgatgcatacatattaaaaatgagcagacctttgtatttttccaaaattgtctaaaaatatttcttcctagtttcctacttttatggataaaatccttcttaagaattgctgacaaaaagaaagaaagaaagaattgctgacaagtggttgccttctgaatcagcagggactgctggccacatggctttgcctctgctcccaggagtctattaggagtgatgatatagcttaggtaggagtgtggcaacctaatatttcacacgctgtcagagttgaggcttaggggagaactcgaggagagaaaatagaagggtctgtacacagaggggtttattcaacaatctgggcatgcaaacaacccatgtgcatgcatgcacgcacacacctcatctctctccatgcagccacaaagggataagtagccctcatttgccaacctatgattcaaaaatgaaacaagtggcttcaaaaccattagtaatgggggacaaaaggtcctctctaggcccagatctgggcaatttgctgaaattcatcatttataaagacgatctcactaaacatcattacagccatgagatggagaattagtccttgcagccaccagctccattgtgagaaaacagggtcagggagaggcgatatgtcttgttcaaggccagtgttagagacagcagactcacccattttctatccctccctgctccactagcagcctcgtcccttatggcccatctacttccagcctccaagcacacacagccactgctgtcacccacatctcttcatgtcccaaacttccgcttcctccttgaaatgagaatggctgcaccaaatgtgtagggccccttgcgtctctcacattcaggcagtagtcaggtgatgtcatgattaggttcggcatgactctgggttggcagcttggtgaaaatgtctttactttggactagaaaatgtcagaacctgaatgactcctgacatccatctccagagttagggtagacaatgacttatgaacgctccacagacagaatggggaccggaatccatgtctcttggcccacgatcaggtgtgctttccccatgagaaatttcaaagtaaggatgcaattgagtgcaggcattttggtttttgtgtggataccatcaatgaagctcctagtgcctgcctttccctcctttgcacactgccctaaaggcttcacgaggtccccatagttcctgtactctaagcagcagcctgactaaggcacatcttgtgtatatacaagtctattcatgttgtttacctcgggtttgcctgtgcattctacatttatataaagattatttttctaaactctgtgcagcataaaaacccaaatgaaatttttgtaatttcaatcaataatgcaattaagcttatctaacagtaaggcaaaaaatagagaatcatttgaatcctgtctgccagtggagtggggctgtgctgtgtctgtgcctgcctctggtatgcccaggtgaggagagcacagggctgcaggcagtcatctctgaaagtgcagtgtacgtggctgaatgaccctccaggggccaatgcaccgaggatgactgtgcagacattcataggaatgccttaagggcctcagctgaatgaagaagaaataaagtctcagttcttttcaggcgtattgagtatgaatgaatcagaaaccttccacagtaagccaacagaaaacccagctcaaagcaagccaagacgtcagctctagcaaaaacacaaatttctaggcccacatgaaagaatttctaggctcacctggacagtggacccatatgggtttatctggggatcaaactgtgaattctgtgagctgcaggtttgttctattctcaagctgtcctgaaataggcaagaggactgcagaagcttcatgcctcacatcccattggctctggttggtttatgtatccatccctgagccaatcatcaaagacttcagtctctcaagacccaccctgacactggggaagggtactttaaatccatccaaactgcattctgggagtagggaagtgattcattctcaaaagaaaattaaagaactcttagctaaagaggggaaatagtggctgaggtaataagcagatgaccaccatgaatagttaagaagaaaacatattcctggatctgggatgccttcccctacttatttggcttatctgagccctttctatgtcattggtagccatagttgaaaactgaaattctcccagctttttctatggcatgaggtatgctcagagttttgtgagtcaattcaatttgcctaattgacgaaattttccattgcagggtaaatatacagctttgccttcttgatatactctctcgtttctatgtttttaataatctcaaaggattagtgagacctaaggctcatttacaaataaaagcttcatcctaacacctggatgatgaaaatatgcaaagaaggacctccatgagagagaagcagaaaataccatcaatactcatttcatatctgacaactaattacaattagaggaaaaagaggctaccaacacataattataggaaatgggtgatgaggtaatgagcaatggctaaattggagctgacggtctaaccatgaggatttctttagctgaaaagaaggaagcaggacctgatttggttctgtgcctggaattagcttcatttttcttcatagtctcttactttgcctcccttcccatatctccaccttatgcttgacaatagcctttcctttggcccttgctgagctgtttcttttggcagcaatgtctgtaactgctctctgaagaatagaggacacaggactggtcctgagacatgttgctacaggtgaccttctgtctgacttcgttacctaaccccaccattctcagggcaaaagagaggagcacagcagtccccctccttttcagtgccttccagggaggactggttggctgtcctggccctgctgatggatttgctgcctcggatgttgcctgcgtctcagtttgtgaactcttagacactgcgactgactcggtcatccctgtaaagcacggccaggcactttttctgtcattttttcatgtgttcatggatttcacaaagatgcagtagacgctgtgctggggaaacagggagaaacgacacacagatgcctgccctcacagagcctatctagggagtggaggagacgtggttctcaggatgaatcagatccttgggctatatgcccctaaaggacaccctgcattttttacttgcgtttgatggtgattaattttttagcctgacttatttcctgctggattatcagttcagaacacatgactagaacagagaaaaaggttctcaatatacactcatttatggaatgacgagtgaaagaattcaggaccacacagtcagtactctgaaggaaatataaagcgtcatggaaacatgtacaagggctgcctaagctagggttaagggaggtcatgtaaggcttcctggaggaagagtagtaaaggatagattgggaaggagccaggtcaaggagaacacaaggaaaagaacaattaaacaagaatgtgatagaagtagagaggcagagagatagaggtacaagacatagaaatggcccaggggaggaagtgaccacctcttttgggggagtaggggaaagtgctgctggaagccacctgatgttgaaggatgaatagcaatctgtcagcttgacaagggaaagaaagccacaggcatatcttgttaagttttctatttactcctcacttgggttttggcttgattgttgctttcctgaacattcaagtctgggctagaggcttcctacaagttcccatcacgatccctcttatcaatatgttgccccgtggttgtatttattttcatatttgcctgtcttaccactggattgagagttctaggaaaaagagaccattactatcatttgccattttgacactaccatctggcatggctctgggggaacattgggggtttaataaatattttctaagtgaattaatacatacatttcaggaagaggagcagcttggaagcctcaattagcatggcctggagagggagccatgtgggagagaaaaatgataacagatgactcagaaagattatgaaaagcactgaagccatgtcacaaagcttggtgtttatctgttgtgtgattgggagtcatgaaaacatttaactccaggagtcacttggccagatacattttagtcagctcaccatggtcacagtgcagatggcaaggtggtgagggttgagaatagaggtggggagacaagctcaacgacttgagtattctcacttttacggaagattaaatgtagcaatacatcaattgcccactcactgtaagccaagctcatcatactgtcagcatatacagacagcccatacggaaggtatatcagggcagtaaggtaaatgaggcttgaccaaattggcaaaagcaggtagagaaaatacaaaaggaaatatatttaaaagcataaaataacatatcagaaaaagatctctaatataggtgtcatcatagtaaactacaaagtttctgagattgggtgaggaaaaaaaaatgctagttcctagatattttctgtaaggaaaaggtcaaagataaatagaaaataaataaatgggcaaacagacaaatcaaagaagaaaaggaaatcaaatttgaaatgtaaaattaatatgaaataaacaaactagaattcaaggcaaagaaaagacagtaatgagaggtgataactagtggggtggagtccctgagaaagaagaaggagttgggatccataagataagtggaaaaataagcattgaatagaaaggacacccttccacagtggcaggaagaaaggaagagaagatggtactgttttaatttatgttctctttgaagcaggctctgaaacaaggatttgaaggcaggtagtttgatgattttttgagatgtgagattggaaagggaaggtgataaaggacatataatcaagtcagtgctagtgtgggtaactgaagctggaattcccctgggactcgagccagtgtggaatgcacacctacctgagagtgagggagatggggtgtttccataccatagagagtcatcaaacatctagaagccccagggaaaacgggcagggcaccaattgtgtctgccatgggtcagatagtagatatggcaagaagtagagagggttatagtttgtcttgctttattttctttttgaagcaggaggcactattacctgctgaggttaaaggaagaggacgtaggacctgaggttgagaaaagtggggcaggtttgaaatgcacacattggagaaaactgactagaaaacagaggactgttgagggtctatgagggactagagacaaagaatttacactgtgtcagtctctatagtttgttaatttccccagcacagctcagcacctcggttataggtgatgagcagccagatagtcagatttataaggatgtgggtttttgtcaggcaggtgcaatgaaaggacagtgaatcaatggacttgagaataaagcaagagaaccttctaaatggtgaaccacatcatctagccaccctgaccctcctggataaggaaggaattgaagacagacattagacagaagagaagggaaagagtttgaagtcagagtatgtggggagaatgtacaaaatctgcaagagtgagattctagctcgtggagattaatgaccagatcttacatatatagatatatttggaattaaataaggcataccttcacccaggttctgttgtgtgcatgttcagttctatttttcatggcagcattgctatcttgttgtatttttaccccatcaacattttcttctgctccatctaaaagtctatgtctatctttttattttattttagttccagggtacatgtgcaggatgtgcaagtttgttacataggtacatgcctgtcctggtggtttgctgaacctgtcaactcatcatctaagtattaagccccgcatgcattagctatttttcctgatgctctccctacccctgcccacccccaacaggccccagtgtgtgttgttaccctccctgtattcatgtattctcattgttcaacacctacttatgagtgagaacatgtggtgtttggttttctgttcctgcattagtttgccaaggatgatggcttccagctccacccatgcaccagcaaaggacatctcattcctttttatggctgcatagtattccatggtatatatataccagattttctttatccagtctatcgttgatgggcatttgggttgactctgtgtctttgctattgtgaatagtgctgcaatgaacatatatgtgcatgtatgtttataaaagaataatttatattcctttgggtgtatacccagtaatgggattgctgggtcaaatggtatttctggatctaggtctttgaggaatcaccacactgtcttcctcaatggttgaactaatttgcattcccaccaacagtgtaaaagtgttctgatttttctgcagcctcaccagcatctgttgtttcttgactttttaataatggtcattctaactggcatgaaatggtatctcattgtgctttgatttgcttttctctaatgatcagtgatgttgagctttttgtcatatgtttgtaggctgcataaatgtcttcttttgagaagtgtctgttcatgtcctttgcccactttttaatggggttgtttattgtttcttcttgtaaatttgtttaaattgcttgtagactctggatattagacctttgtcaaatggatagattgcaaaaattttctcctgttctgtaggttgtctgttcactctgatgatagtttcttttgctgtgcagctctctagtttatttccatttgtcaatttttgtttttgttggaattgcttttgatgtttttgtcaggaagtctttgcctgtgccatgtcgtgaatggtattgcctagattttcttctagggtttttatagttttgggttttacatcaatgtctgtcttgcatattttttttaaaattgaagtttatacttgaaagtttgtgatatccacagtgtcctaaatgcatgcaatttatataagcagtgtaaatttaagaaggattggtcttttattcagggggattagtggctgctgtgttgctcttccaattgacccattggaaccacatgaaaacagtggattttcagttacctctgctaagagaagggaactgtgaaatcgaaaatctaattgtatttttgtttgtctttggaatgcactttctatttctatttgaatctgggtgtcacaggcataacatgtcagtggaaaatcaagagtcatctacagttaataaaatatgtaggaacaatataaagatttagtaccccatctcagggtagcattcggttaagcttttagattgccataataaattaatcattctgcatggcaccagtgggagaaattccactctgaccccatcaaagtgatgcgtcccacttgcaccttactctagcaggactggtggcccttgtaatcttgtcccagaaaacgagactgctgatattatttttttttatttcacatttaaaaaaattctgctaagcttcttttgctacagtcatttgctgccactgggatttttgcagaaggttagtagtactaataaaatgaagggcaaagcaccaaagagaatcttgaaggaatagtctgtaattctttatttggtcagggcgaaagaccctgcaaggtattacaatctccattttggggtcaaggccaccttcaaccttccaaatttttcttcatcctctaggaccagtatttattgtctctcttcctgtcactccaaggcttctcactgtactgggacctcatagagttcattcctacaacatcccaacccactgcttagacaagttgtcatctcggctgccattacagtcacagggggagcttttaaaacatacctgtgcctgggcctttcctcagaccaatcaaaccagaatctattgctttggagcaatacatcagcttcctaggtggtcctcttaattgggccacagttgaagatcactggcctggataaggagctccaaattctggcttcctgtgcagctgaaaggtggcctggctccccacctaagttacttgctcatccaatgactgagtccactggaggctttgagtacctgggaacatttttcttcccaggcagctgcagcaagcacagccagagagcagggcagatgccacttttgatgaccaatgcaagaagcaaggggcaggtgaggtatttgtttttcacttagatttcatcccaagttaaaattcagaattttgaataatgtttgaatgttttagtctattcatcattcttcatgtgtcacttcagaataatccataataagtaatacatttttctaagctttgttaagacaggtatgtggttagaattgatacattccaatgtcgactgtggctttcactgtgagttctgaaaaagtcatttatgttcttgtggaacttctgctacttcatatattatctctttggagataataaggaaagtagcatttagtgagcacctgttgtatgcttgtactagtactatttgtctagtactattgtctagtactattctagacactgacatatactattgaaatcattgacagtgtaggctgaccgggcgtggtggctcacacctgtaatcccagcactttgggaggacgaggtgggccgatcacgatgtcaggaattcaagaccagcctgaccaacaaggtgaaaccccgtctctactagaagtgcaaaaattagctgggcgtggtggcgtgtgcctatagttccagctactcaggaggctgaggcaggagaatcgcttgaacccgggaggcggaggttgcagtgagccgaggttgtgccattgcactccagtctgggtgacagagcaagactctatctcaaaaaaaacaaaaaacaaaaaaaaaaaaccaggatagactatgtcatcagactacctggactcatcctggctcagccacttaccagcaaataaactcaaatcacagattggtcgtgggttttaaacaagataatgtctataaagggtatagcactgtgcttggaacgatgtaaattctcaaaaaaaaaagtgttaatttgcatcattgtgattttttttttttttttttttttttggttctcacaataccgtgagtaggtatcattatccattttagagataaacaagtctcaaaatgaactaattatccatgggcataatcaatctcaggcgtgttggaaggaagatgaaaaacttacctttcagaattgttggaaaataaaataaataatttcagaatgtgttacttagcctgggagatagttaatctgcaaagctggactctgttttgatattggagagacagtgatgaacaagacagacagccctgtccttgccaagcggaccttaaaatctccatctcactttgacactatcacgaagtgtgcacacaggccttttgatggcacagtcttcaccacagatgtatactctttccgagttaacagaaagttctactctcttatcgtaagcagtcctgaggtttgggccaatcacaaaataatgaaaaatggagcatcaccagacgagatctttgctctccaggagtgccctctgggaacatttccctcgtttcccacagccagggcccctggtgccagcaggaagagaaatggacgccatcagtgctttaagatggcaaatgcaagctttattctaccatcataactccctggatcgatgctgacctcccagccaccctccaaaatgttctcccattgtgtattcaggtgtggtggctggtgagtacccagaccacaaacttacataaaggccaggaatggattcatttagattaacttatttccaagcaatgaattaattaagaaaaaagcaactgcaggcaatacatgaatacattggacattacttctctgctcatcacttctcctctgctggttcttgaattcaatcattcatataacatttcataagcacatcctctatgccaggttttgtatagtctctggggatacagagttcatcctgagatgttgttaatctcgaaactgtctcaagaaggcttgccttgtgtatttgagaacaattcaaaatactgttgagataaaaatatttatattttttgatgtctctagttacctaaatttctggataactttgcatacagcttgttaggaaatgtcacttcattcctgtacaattgggactatggttataacatcatcacctctatgccaaagcatggctgggaataccagcattcttacaatggaaacttgtcttcaggccaggctgccaggagctgttctttgcttctcctgaaccataattaatttatagtctatcatttcaaaggagaatgactctgtagaatttggactaagtgcaatctcccaagattgaagatgtaccaacattgttttatgatttactattgctccattttcttctttaacatgttaaattgcatataattactgcaaagggaagaaatagacttagaaatagactaagagtcagtgcataaaaagagaatctatgcatagtcctatgggtgatgcaaaaatatcctgtccacttgatacagctataaattttctttaggaaaaggacattacagatttttttaagccgaaatcattaacagttggtatctatcagacacagatgaaataagctaatccttatatgtaaatctgtaaatctacagggaaacatgaaaactgggtaaatttgagtgtaatatggttgggaactttttaaatctttgggtttttgttaaattatcccttatatattctctcagttttaatttttctgtattttaaaaaattcttagtcaaaaagtacatgaatcattttatattcctctttgagtttttattaatgatattcaatactctaaatatcatgaagttcatatatacctcaagaggaagaatttgaaaggactgttgcaatatatttttccttctttttttacaacgtattatcttgttttcactaagagagtttatttgccttgccatggaattaaaatttatttcctcgcagattctgacagctctataagcacacactgtgttttttatgtacagatagaacaagagttactcaaaattattactgtttgggagagaacaattcactgaaccatcaaaaaatatatccctgcacaaaggtaaagatttgacattagcttttcacagacaaaagaaagcataaaagaggacacattgactttcaaacttcttgacggtagcatttttccagacttcttttcatagtaacttactgtggaaaaccaaaagataaataaaaaagaaataaaaatgtatatttgaacacatactatattccagacactatgaaaataattcgcggggaaaaaaaagaattttcaatcttaataatagttcctattttagaagaagatattgaaaatatttaaatttgttttaaaaatcagaaattgccatttagtcctagtgtcacatggaaggtgtctaattttattctaacactgtgttttttatctacattaactactggatacatttactacaggagttcttcaaaaagcaaaattactagggcataacaatgcagattgttttaaaggccctggaaactttattgtaagaaataattttaaacatttaaatgtcagcaggagaaaatatgaggaattttgaccaagacatttaggacaaaatattaagaaaatgtaaacactgcctccttttcatctttaaaatgtaggaagggctgtgacttgtagaaactcttgctcatgaatggatcttctagtaacaagaatattttttaaataaattttgcttctgattataaaagtaataatatttatttcaataatgtgggccaaaaaactaaaacacgcagagaagaaaacatgtatctaaagactttttggctttattttattttaaatttccctatcaggctcaagatgctaacttaatcagtttgggagtgtcatgcctacatcaggaaatttaaggaaattaagccattaatttaagttactacatatcatgaattctaagatccaagtatggagagtaggtcattgtttctaggggtagatttagtgcactgaaatttcattcctgttttgcccacacagcctctagagagcaatgtcaatccttgcagtctgctttataacacaaaactgcctcttctaaacttcacatccccaccgttcatcctatttccaatgtcattcccttgtctttaaactgtaccaatcagattaatggagaaacagaacaaaatggttccagacagatttgccctgaaacaaatcttaaaacaaaatggagctaacagtattccttggcactgaaatacataaaccttaaatctaagaaagaaagaaaatatcaaatacctgtacatctctataagcatcatgaggaactttaatcaatcccagatgtttaaccctcaaaacctcaagctatgcacaggcattagaaggtcagcctccaactccccacaggtttttctgggaggctcagccagccatccccatcccagcctttcctaatgaaagactgggctaccctctgcctctgccctcccagctgcagacagcctgccctaggatcccttcaacagcaatcacatctcattgttgcccagctctctgccctgatccagaattcttaaaagggtttgagggctaaaagtcaaggatggctctgtgcatgaggttggagacactgctcctcagatgacaaaaaacctgagataaatcctgatctcaggtgggactgagagaatttgagagcagggaggtggccgaggagagtgaaggcaaacatatggagttcttcatctagacagccagtttgggggcagagataggtgcaaagcttttttaaaaaatttcatttttagttccgggatacatgtgcaagatgtgcaggtttgttacataggtaaacgtgagccatggtggtttgctgcatctatcaactcatcacttaggtattaagcaccacatgcattagctatttatcctgatactctccctctcaccgccgccccctcaacaggccccagtgtgtgttgttccgctaaacaatgggaacacgaagcttatcataaggaaggaaggttagtggggaaggcattcagcagagggaagaacatgggcagattgtaaagcaggatgttgttacaagcatttagagcaaacctgggccataccatttggctggaatagagcataggggctgtggggaggtaaaggagcatcatcaccaggaatcagcatggggctgtggagtgtccactaagcagctgtggcaagtcacttcttaccactcactgtcactttcttatcatttcctcaggtgaggaaaatagatggaatctttcagaccctgtagttgtgatagggattagagctgatgtatgtaaagcacctagcaccgaaggagctaggaaagcacaatggatctacatggtggaggctgaggatgtctttctcatttggccatagtttcctattttattaagtgctgacacagaaactttaaatagtggagagggttctaagtaatatttagtccttacacacacacacacacacacacacacacacacacacacacactattctttacttgtaaatggagatgctgcttgcacttcacctgcctgaggaggcccacctttatttctcctggcctttaccacttccttacctacttttattgctatttcaagctcttttgtaaaaggcaggtgtgaaagcatcccacccctcagcccccttgaggacctgggtggcattactggtacttgaaagaaaaggtaatgaaagtaaaaaagaaaaggctaagttgctatcacatttgtcaactctggccagatgctcattagcaacaggctagaagccaaaaatgaaagaccaggctgcagcttggatccaaaaataagggccaggctctgtggaaaatactgacagatgcgagccagaacaaggaagaatgctttgtgtgcgtcatttgaaaaagaacacgtccaagcacccagacataggtcttcatgtagtttatcttagtggccacagtagggttgctcagagcattgttttgcctccaaatcacatgggatgcttgataaacatacagatgccccagctgcagctcatatctgcagaataagaatctgtgtgggggtcctgggggattctaatgcaccctgaagagtaagacctattgatctgagattgggagaattaatgcttgagctatgatggaggctggtaagcacttaggaaatttcactgcattctcccaaaaatcctgtgaactagttatgattattaccattaccatcccatcttgctagtgagtggtggagtcagaactccagcccaggcctcctgatgtccccttacttacttagccttttattctaggcctcaccagcaagagggtatcttcattccatgcccttcaattggtagagagtgccaagggcaagaagccaattcctcacctccattacctgtctttacatcccagcgccatcatgggccttcccctcaggccagatttctaagaatttggttctgtttgttttgttttgattctgcatgaaataaagaaggttaaggtaactatgtagcttccctctcttattgaaataacagtgccctctctacaccatcccgtgattgccagggtgcaggagcatgtctgctggatttaaatcccagcttttactccaccacttactagttatttaaactttgggcatgtcatttaacctctggaaaatagagatggcagcaattgagtaaaagaagaagaaaggcaagtcagggtgtaaagaaaaggatgggctggatgctgtggctcacgcctgtaataccaccactttgggaggctgcggtgggcggatcacagggtcagtagttcaagaccaacatggccaacatggtgaaaccttgtctctaataaaaatacaaaaattggccgggcacggtggcacgcgcctgtaatcccagctactcaggaggctaaagcaggagaattgcttgaacctgggaggcggaagttgcagtgagcccagattgtgccactgcactcaggcctgggtgacagagcgagactctgtctctgaaacaaaaaccaaaacaaagcacaaaggaaaaggatgagatgctaccggtatgagaagaatataaactgtggttctcaaccctgactgcaattagagttatctgaggatcttttaaaaatactgatgccaggattccactcccagaaattctgatttcactggggtgtggtgaggaatcaggtcagcaataccatttatatccccccaggatattcaaatgcgcagttgtggttaaaaacctcttgttgaagatagtgaggaaaacaaccaacgttccacaaatgctctctggttagagacactttcttagtaagggtgagaatgcttactgattgaacaagcaattattactcacttaccctgtgccaggctccagtgcaatggctaaaatttaaaatttaaattaaacttaaacttagtccctgatctcaggatagttgcagtctaatgaggaagtcacagccaaaaataaactatgcggttacaatatagtgtggtcaatatggtaatagcagttagttcaaaatggtaggagaagagtaaatggaatgacttcttctcctttcaaagaaaccatagaatcatgaaataatagagatgaaggaagctcaaggttcctaattttgtgcataaggaaacaagaaatcaagagattggaggtttctcagagtcacagagttaatgcaagagaacctaaaaaattctaatgatgtagcaagacatactttaactcaccaggggaagtgctaagaaactatggcttagcagcactggactctgaagctggagttctgggtcctgaaaaataagtagaatttggacataaaggcatggggaaggtttagattttcagtggaaggctcagcccatagctcaaaggagaacatgctcaccagggtaatgacctggagcttaaggatctcaggtggtggccaacagcttagggctccctcctccacatcaactctagttttgggcttacacctatttcttgctggatacgcaatttagagggatgctcccacctccagttccactcctctttgggggttatactatacaactgagacattgaacatgttaattttacctggtgtattgcttaatttcaatgtgacctagggtttgaacctcttatcttaaattctttagtgacgtaacagattaacacctcaaaatagatgaaatgtctctcaattatgactacatttggtcagtcttgactatattaagctgcagttcacatgtgctctgtttaccaaacttaaaatcattaaatctatattgaaatgtgttgaattggctctccattctccccatactctgaccttggtgttctcctagaggtttcaccttctctcacaccctacacatccttttacaccagtaaatactattgcttccccttcaaaatttatccaaaattcaaccactcctcgccatcctcactaccaccaccttggaccaaaccactgtcatgtctcacctggattatgggaacagcctcctaactggtcccccatgtttcagcctcgcctctgcagtctatccttagcacaatagcagagtgttccttttaaaagaaagtcagattgtgtcacttctgtattcaaaattattcactagcctttcctaggtccttcctatgattgacatgacatgatctggcccccatgaacctcaccttctcttctctggccacactggcttcctccttgtccttgctcatgttgagcaagcccctacctcactgctccctgcaactggaacactctccctccagataagcgcctggtgagccccttcactttctttaggtcttttcttgaaagctcctttcttagtgaatcttatctggccaccctatctaaaatttcaatactgattcctagacatttcatatactctatccctgctttataaaattgattctctaacattcatcagtcaacattatgtattttattttacattttatttatttgtaaaattaacatttataaacactatatatttaacttatttttgttattcctttttctttacccatatatctgtttcacgatgggagaaataattaccagttttgttcactgttgcatcccaataaactaagtacaacacctggcacacggtagactcaataaatacttgttgaatgaaaaagtgaggaaatgttaactgtggcataataaatattaatattataattgcatttacatattctcttcttgatagctataataatatattcaaaccatagggagaccaacctgcactatagaattttataaccttaagatgatttagacccaaattaagggacattctacagaatacttgatgagtacttttaaaagtgtctacatcatgaaagacagggaaagactgaggaagtgtcacatattggagtggattaagaaaacatacaattaaatgcaatgttggatgctgcttaagatcctggaagagaaaaaaagacaatgaaattccaaaaagatctattgtattagtactgtacccatgttaattccctggttttgataattgcactatggtgatgtaagatattaaaatgatctcatctaaatgtctaaatatcctttatactccaagcaaggcagtcatttaaatggtaaacatgttttttgaatgagtacgcaagaagtaattaccctgataatcaccaaacgataatgaggtaaccaagatagatgtgtgtggtgggcagttttcttctttttacctttcatccatcatttttctgtgctatggtagatttactccaaggaacctaacacaggttttcaaagcaaatattccttggtccataaaggggtttaatcagaagacacaaaatagttcaaagagttatctttatactctcccttcttttaaaaggttagaaataacaattgtcagtttagtaaaatcatcttgtaaataacatcccactaatttgagattacacagtgaaataattgtatgccattctaggtctcaggaaagcatgttctcattagagggagaaaaatggttaagaaaactgtcacagagggtttttgagaatcatattaactaacaagtcaccttagttcttctggagtggagcacagtggaaaataaaatcatagaaacagagttcttctgtctagaaggctgttgccccgttcctctccagcaggaggggatgtgtcctgtctgtgagaggcaactcctcctcaggagtagaaagtggaccccacctacactgggccacttacccatctgcttgctggaggcatttcagccaaggagaaagactttcccttggcctttttccacaaaggggcatagctgggtgggtacccagggatagggagaaacatttcaatcatctagagactagaagaactaaagattattgataagcattattcatttttctataagtcataataaagatgtttgtttggtaggaaatattcatttttctataagtcataataaagatgtttgtttggtaggaaattatcccaaaattttaaagattaataacagtcaacaaggcaatgtaattcaatttaaccaacacttactgaccatgtactaagaacccacttctattctagggctgtggagatgcaaagacgaatgaaataaaagtgtagccctcagacagcttactctctagtaaaagatataaactctataaacaagtaggtagaaaacaaatgagtagcaagtgtcgaagggccagggaggtagtcatcatgaacaaaataagctgaatataagaatgacaaactccaagaaatggaagcaaacactttattcttattaaattatggaataggtatgtaataatgtaaatatatataatattcatatgctattttatattaaattttaaaaacattgaaaaaggaaaacaattattgctatatttttatttcataattcattactgctttgacttggaatcagaaacctcacatctttttttctgtaccaaaacatgtttcaggccctgtatttttcactgtgatgtacagaatgcagccttaaacacttatgccaggagggtggttggtttttttcagattaattttggagtcgagcctaaacataggctcttcctaacatggatggaattactactgtaaatggttcttatatctagaatcacctcttccaaaatgtgtgtacaatcctggctttcagcattgctctacttagacttcaaatagacttcagtaccgtttttgcattacagtttgataatgtctaatcatagcccaacataggtgctatcaaaaaataagaaaggtaagctaaataatgttatttcattttcataaagtttgaagtctgagaacatttttagaatttggttttcaatggcatagttttagagaataaattttatggtatcttcatttctggaaactgatctcaatgtaggaaagtagatgaaattattcctttacaaatgaatttcccaaaaagttacctttatctggacggagagaagctcacaaatgaaacatttgtgcaatacttgtgactgtacctatagaaaaatagtcaaaaaatatagataagttgtagagtcagcaaaaagctcaggactttgggctaatcttcactgctaagcagagatagggctatcccctgtgatgacattaacagttaaaaaaatctcttctgcaccacagtgcaagtaagccagcaaattcattaagcaaatgttgacctgattttgctcagagacatagaagaatagccaattagtggtattaattactgaatccatggcttctcccattttagctttgtgcccaaagcaatttctgatgaatgaggaaattaatggacttggggatagtgtacctacaaaatagtgccacctatgggctgttacttgaccggcctgacattaactccacacatcctgagagctccatctataacacttggtgactttgaccaatgcattctacatccaaatggtctgagacctttttcataacacagagtcagccatttcctgatgttttgcctttcatgggctcctgtttctgaagttccttgaccccttcaaaattctcaccacaccacaaataaatatagttaacagtgtgctattctctatatctgtgttctcatttgctgcaagagaaaatgccacccataaattaacttgtcctgaaagttctcaatcttatttttaacataccaagctacaaagttgctcattagactaacatttacaaatgcctgttgaggctctggacacataatttctgcagcattcaaaagagactcttttataaactgtgttgtctgtaaaaaggttttgatacccaggcaattttttcgcttaataaagaactgtatttcacagcaactcacttattttattctcattcaaaaacaaatgctgccatttcttcagtccattaaattttccaacacccatcttttctgtgtagcagtcaaagctgatttttttttcaatggtgccttaagatgtaatttttctttgcaaacattctttgtctggatacacttcccatccacccacccccccccaaaaaaaagttatgctcctatttttttcttataataattgttttttaggagatgcacaagttcattttcctcttctttttacactaagaaaaatatcagtaaacacatggtggtaaaaagctactactctttgatttcagtgctgggaatacaacaggaagatgtggaggctttaattaactgagagggcacagtcctctgatttaggggctgtctacctggtgaggacatcagctctttgctgtcaaaggcagctggaaatcaaaacatttcaagaaaaatcttctaattgtttaaatgttggcaacttattcaaaatttattaaaataccaagtggatcaacagcattctagtcaagcaaaacaaggcgccctgtgggctgcccatctgcaacctctggatacgtagagtataaaagtaaaacaatttataccctacttttattttagtccctgagaagtaagagaaaaggtacaattatatgaatgtattcctatggaatatgaactctaagtgccataattaatttggaaatggtctaataaggcagtgtggtgtggtaaaaaggatacccttcttgaagccagtccgtttggggaatcctgggtattccacttatcgagttggttaattttcgattcctcatctggaagtaagcataaagtgatctggtaagcttcttagtatactgtctggcatttggaaagtgttcttccataaatggtagctaggactgttattacaaaatgcaaaatatgcattttcgaccacatttctttgtatgcctcccaaatatcacttgtgcccaggctctactgctctcactcctgccgtccctccctggtgctcccacatttcatctcacggcctgatggtgtaggcccctgctcatcagcactctctggagtttcccacctcctttcctggccggtgctcttgcctctccctagaatgtctgtccctttcttcttcgttcagttaacccctgtgagactcgacctagctgtcacctcttctaggaagtcttcctagaatgccaccaccctccaatctaaatagagcactcccttttatctgccttatgttcacctcagtcatagcatttgtcaaatggtcttataaaccgtgagctcctgcgagacaggaactgggccaatcatctcactgtcccttacacgtgagtgcaatgcttttatgtggcatgtaattaggaatcaaaagaattcattccctcctttaggaagggaaaggaagggaataaatcctccttttaggaggatctatccataaaggatggaatgaataaatgaggtgcctggagaccagcatagcaagtgcccactccacttcagcttcccttctactttacaaagtttcaaacgtctttggctgctgagtgtgcatctctccccttgccttcccaaaccttactcctgctgctgtctccactctcacccaaaccagtggagatttccattctggaatggcaggttatgacagagaaggcacataagtgtcacctcctgagtcttgtaagtgggcactggaaagacctctaagagggtttcttttgaaaagtaataatgaataaaaaatacagccactatttggaggcaaagaaggggagaactataaccataacccaaggtcttaccttcactttcagaacatgtggcttcttagctcagtgggagcaagaatggatcttgtacactagcatccatggtccaatagcagaagggaaagcatcttctaggacagggcttccaatagtatgtacagtggctttcagtaaagaaacagcagccctttctccagagggatacagaccccttctggaatacttagtgagaagaagacagactagaccaactagaccacagcccacatgtgcccctcatccaggtacctttgtgaactacccatacaacctattgaggtagtcccaaagtaagaatttcccttattacgcacaatattagaaaaatgatgatgaataatatgcaaatatttattattttctaggaacatgggtgacatttggaggtcaaatttcagatgaggtaagttacctttggcctctattatgctaatgaaagaaaatgcagagagagctgtattgcaggagtcctcttcctgggaccctgacactctacagggataaggtttaattcacaggaaatggtaaaattgactcagagattattgttgattttatttttcctgttgtattttttacatttagactattaatagcccttgaagctgtacattatatatgcaggttgaacagtcagagaatgaaacaatttggaattaacattagtcactttatgaaaagattgtattgctgtgatgttgttttgctttatttgtttgtttacttttagctgcaattaggatgactaattggtctcagtttacacagaagtttctcagttatagtattggaagcccacattgcagaaaccctctcagtcctgggaaaactgcacagttggtcacctggcttgggcgacttaatctaacctctctgagcctcagtccatcctatataaaatgagatgctaatgctaactttgatggtgatctgttgaaagaattaacacatcatgcttatcagatgtttatatagtcctctgactagtaggtagcagacactcaataaatggcagctatggtaattatatttacaataaaattcctttagatcatcatttgcacagtcaaaacagtacttaccaaagtgatatttttatcatttcctttaaggaataccttcatggcataagtgaggtatgcaggcattgagcaccaagaactcccctgagggcaatgccctgagtccctctgatccttccgtgtctacctgcaagaagagtcagggatagtgtctctgagtgggtgcactgagtgggatccagtcccactctaccattgaccgacctggtttactaacatttatgtgtactaatggtggccacatcaataaaatgctctaaccctctaatcagcaggatggtggttaagattaatgagatgatgcctgtaaagtgcttagtggggtacctggcccagaataagccctttacaaaggtagttcttactatcattcctaacgagacagttgggaaacagaggcttttctccacagctccccaaatcaccagtgttatttagcagatctgagagagaagtcttaactgtatattcttgtccatcctaatgcctgttccctgtattgggcacatgtcaccttataaggcttgtctcatgggggctccccagggatgcagactttaagctagagagtagcatgcaggacagttattaggaagtgttctcaggatcagcacagggcagggaagaaagcagcactgggcagacagagaacttgggtcatgatgcagcctcaacaatgacctcagccaactccatggggatctccaaagctgagatggttctgcagagttgtctcagtttgggacaacataaaggactgggcctttatgtccttttactgaccagtcattggaccagaggctgatcgggaagcaggtctgacctcgggctaggtgactctctctagccaagtgcaatttccagagagggctgacagaggaaggccatttgatggcagcattcctagcagctcagggaataagtccctcggttccaaaggagaacctgagggcacatcccagagtttactacaggactctgtctgactggcaccaggaaggggtgtatggaggaggcacaaagggaaagccacagaaaccagagcacaggctatggacttgaagtcccatacaaaataggtggcaagcagggagggaggcctacagttaataatccactgtatccagcacatatataacctactactgatggtgcttggaagggaaaaagacagaaatatcttccctttctgagcagattggccaagtaaagtgcattatttccccctagtcttcactctcctcttcacagtgtctgctctctgctgcaatgagccaagcttgcccgggtcgtagtgtgaagggctgacctctgagatgaataatttcaaaatttcaagtctaaaaactacgataaagctgtcatgaatggctgctgaagcactcacctcagatgcagaccaggaaaatagctattgtacttccagagagcatctgtggccttccctgggtccctgaagagagaataccagcaaagagaagaagggagacacagccagattcagcctcacccatcacagaattatttgagctcaatgctttccgtgtagcaaaaatgcggaccaatagcagtgagttcacctacctcgattttcctgctttctctctggcgtcaaataatctcaacacaaagtacatgcaaatatggaatactagggctggccacaccacagtgtgctgagttaattgttgataattacatgactgtcaacactttctcaggaggtggggatgtccccatcactgggagagttcatttattgaattaccatttggcagggatattatcaaaaggatacaaacaccaaactctgtaaggtgcctctcaaagatgatttggcttcatcaaaaaataaagatagatgttactgatatgaataattatttacttaaaataatgatgagagcatattaacatcttatagcacttaattttcggagttttatttacatttttttatctgtaaggtagttaaggtacctttaactataggtaacaaaaacccaactcaaatcaggttaacccataaaagaaaaattattatgacttttacactagaagtgtagatgaagagcaaacttcagggccgcctcagtctgtgactcccagtctgcttcccagcgagtctctggccgtgtgggtctttgtgtatcgactgcttaagaaaggcagctgccggaaacctaggcctcaattagaacagtgactccggggaaagggtgttgctcctagaaactcagtaggaacaaagaataatgttcctagaagtctccggcaaacttctcctcatatctcattggccagggtgtgtcacatgacccttcctgagcaactcactcgtaggccccccaggcccccgctagagggaggtgaagtcagctttgcctgaggcctctgggcttcatgcaggaggaggagatcccagaacaaaatcaaccccattttgcaaaccaggaagctaaatttacagagaggtcagatgatttgcctacgtttatttttctagtaagtaggaccctcaaggccagaaatcactcttcagacttagttggtgatgtttttcattatttcacattcagtccttcaagttcaatgattgggaaacatctctgtcatcatttagtttaaatcttcatccagaattctccatcttatcttaaaaaaactctctagataagatttgtgtacatatccaataatataccagtatgtcatatgacatacacaggctaatataaaatagaagcacaataatttttaaaacataggacagtcataacaggaaaaacttgtcttaacttttaatctccagttaggatataatttaaaaattgtaggaatataagataaatgttttaatggtagtaaattaaaagcagtaatagcatactattatgctaaagaatctggatggactccattttgctagcttaacatttttcttggtaggctaatttttaaagcaacagaaaaatagtttattttggaaatgcggatgaagcaactttagcctgccatcaaaacataatggaaaaatcaattaaaattatttgtgaggtgtgtaatttttcaaatgactagtaagtcaatcggcaaaatgaaaaaatggcccttctccactgctgtttatggctatccctctctggctattccttaagctgtgtatagctattctgtactcttctgtcatactcaccacttgcgttcagcagcacaaagcaaggaacaaggagctttgaggtctgtttgcaggcggaacagtgaggagctgggttcctggtgagtcagaggcacgctgccgcctctctgtgttgattcaatggctgctctacaatggcgcctgagattttgctgagctgtgggtggcaggagttttacaacagtcacagctctgtctcagcctcaaggaaaaagtcacaagctttcaggtcaggagtcatccagctgccaaaagttattggcttggagaaaggagttgaggaatggagtcacacagtgatacaaatggccctctttgtcagaaagattaagatgccataaagaatgttgtcaaaccagctcttcccagcccagtgagaaacacaaatctatccactttgggcaggctaaatcccagccttcaagtaacccctcagtgccctatgtctgaaggaaagaatacttctgtcctatggatactggctgagacttctttctttccctctccactaaaactaagaaaaataaggagtggttagtgagaggtcagtgttcctaaagaccggtagaggactcaaagttgcttccaggtttggaaagcatttggcttttctgagtgacctttctctccccttgcaggttgctgaacggctgatgaccatcgcctatgaaagtggtgttaacctctttgatactgccgaagtctatgctgctggaaagtaagtcagtacctgtttgtgtcactcaaatggcatctgtagcaccaaaagaatcagcccagaccatttccagcatgttggtgaaaaggttctgtcctttctccacgtgttggcagctctgctctgttctgccctctaccaccattactagaattggggatattgactgtctctggcactctctgctcacccaaaccttcctgcttctggaccctgtatgaagaatgggctgaaggggtatatgaccaggaagcaattgccatgtctatgtgaggggcagcggagtctgatgccagagtagtggcagaggagattgagaagtattagttgaatacgtgagtgaccaaatgaatgaacagattccaaaatggttgctcaaaagttagtctttttatttcataaccatatctcatagtttttcagcccctgaggaactgggacatcctccttgcagggaaacaggagctctcactgttgaactgcctgtccctacactagcattacagaaagattagacgtcaaagtcaggatcccccaagatgccaaagaatctatcatcttttgtaagaggggatctcagagcccattctgaggacaggaagggctgcagagagtcctcgcttcttttgtgaaaggagtcacatccaactgcaaccttcctttgaacccaaggcagatttggagccctaagacagggcttgttaaaccagaacacataggaaatgcgccaggccaggcctcaaggttcaggccatccaagtcccagcctaaccagcacatttcagaatagatctggggctccctggcctcctactgggaacatggatgtccagctctcagaaccaaggaaactaaatagctgcccagctgtttgaacagctctgcaattttctaactgaactgtgaggtataatcacctgcaggcctaattcacctccttccaggttagaattacaatcaaattgctggacttgctgaatcaggatgatcagtggatggtcccagtgcattttccttgcatgagtttcctccttttcaagaagaggtctatgtttaaggaccatcaaggaggttcagagctcacattcttgatgctttctgttgaatccaaggagagaaagtaaaggttatatggtcttgctcctttctgccttctacccctttccattgttttcttcttgtggaatcctgcttagtaccaaatggcactaaggtagaaaaagggagaagtaagtagcaagtctgttagagtcctgtttgtattactcctgtgaggataatcgctctgattaattattgattgtcggtctataattgagataggtttccactgtgaaatgcaaggttgcaaaaggtaaaggagagatagggaaaaacaaaagcaacaccaatgtaagactcaatgcttgtctctttggggcatgctccacagctaacccgcatcatggcttattgcaagctatacactctaacaaagacagaactctcacttaagaccaataatgactagccatgactcccatccatagcatcctaatggacaaggtgctaattccactgatctcccattcactaagcctctgagaccccagctgcttctgacaatgttggtcttactgggagggacatagaacatttgtctcctcaatcttgggtcccagcctgggtaggtggaagaggagaggatggtggatgccttcagtatgcctctgcaacccagccttaggggcaggaaggacacttcgttatgtcttcctctgttttgctcctatgacaaagtttgtcactggaacctaagatgttctgtacgcgagtgttctctatgtgggacatctaaacccacacatcggttctcagtttatacctgggagcaaatattttttatctaaacaatgtgaggtgtcattgttctccatagtcacaattgaattgcttcacagcaattagaaggaaaactgactccctttggacactaccaagctggacatttatatatgggatcattggttcaaaaacaccaaactgcaaaatgactgctgctgcttagtatcaggactgcaggcggtctcctgccagcgtgtcaggatttggcaggtgcttctggaatgctccggagcaggattttgcaggcacaagcagaaacagcggaaactgtgctaccagccgagagcggcttctattttcgggatatgtaggcactgagagttcaaacaaggaatggttcttgtgttctggattgactcttgcttttccaggacactgcattctaagacattatctgtttccccttccagggctgaagtgattctggggagcatcatcaagaagaaaggctggaggtattgcattcgccataattatttgtttttaaaaaggtattattttgcaccagagaaggaaaaataaaattatatgacacctgaccaaaaggctgtcaaaaaaaatcaactgtttttaaagcaatgatttatagtggcttgaaaataaatgccggcaagttcacttctggagcttcaaaaattactgactagtcattgatcacaatgaattaccaaagagttgagcagagaagggggggatgttcatgaaatatttgtgcatgaaaaagtgacaatttcatggcttctgactgccatttgtgctaatctcttgcaggaagtaacttgacaagaagctgattatccccccacacacatgcatttatgtttgctgtttattttattaactctggatgcaaaggaatgatgaaacaagaagactttgggataaataccccaaagctttcttatctgaacacatttagtcagcatctctcctgtgtgcccaggaaccctattatctggctattcagaacaatgcttcatctgctatccttgagaaacatgaggggctgtgcttacacgtccctttccaacacctcctgtagccaaagatagtggtaataagggaagctataacatctatgggcagtggggaggtaatacttccccatttcactatagatttcagccccaacagccactacttccccagcacgagtacagaattaagcaaagcccagcaaaggttactgaacaagtttggggtcctcctctgccctggcataatatctgctgattaccaaataaatgacagtgtaatgatattagtgaagacaactgtggaaagagctgtgtactcatgcttcaacacttagcatgtattttctaaaatttagtctagagaaaatggacattctcaaagagttcaagagtggttttattatgcttttgcacacatgatttaaactctctctaggaagcaaaactaagaaggtgaaacagacccatgtatttttagggctgcttactccccactctgagataaacttttggtaggaatagagggccctgtggaaacagaaaaccaaatatttatagagatatgaacaaataaactttgatgacctactttctccttctcccttctccctctcccccatcccagggaactgtaaggatgttaatagaaaactatattccaccttatatatggaaaaacattcatgttcccactcagtccttcaccttgcctgagttactttcccactcagagtattggtttacccatcactgcctaaatagagactgtatccattcgctatggttgctgcaacaaaggaccagaaactgggtaacttaaaataacagaaatttattcttgcatgtttctggaggccagaaatccaaaatcaaggtttgacttcagggttggcagggccatgctccctctgacattctgggtaaagttcttccttgcttcctcttagcttccagtggttgccagccatcctgggcattccttgacctgcagctgcagcactttaactcttctctcatgtgtctaagtgtcttctgataaagacaccagtcatattggattacgggcctcctctacctattaactaattatatctgcagtgatcctatttccaaataagctcacattctgaggttctgtgggttaggactttaacatatctttttggggtacacacttcttcaattataacagaaaccttggagataattccactaatagtacagtgaggtctgcaacaaggcgtaggctgctggagtacatctaaggaaggagggaaagtatcggtgcagtagctcttttctttcttaacacccagagaacattaaattatcactctccatagctgcagaacctattttatataccttttgtagaaaatagatcaccatgcattttccacaaactgcctttcattcttgcaaataaaaactcaagctattattatactccataatgtttatatcagttcacagttgcccccgtgagactggtgaaaagataaaccatatcatcatagctttgagcctataaaagctgtttcaactagcacacttgacttctggtcctggcgctaccacttgctagctgtgttatccaggacaagttattacacctctctgattctcaatttacccacctgtaaaatggacagcataacagttcatgaagtgtcatgctgacagagtgagataaggtatgcaaaagcattttgaaggctgtgctgtatcactgtaaaatacattatcattctctacccactcagaagagttgctctaatagcctctgtgggagtcagtgacaatttgccaggctgctgtctactcttgctctttgaacatatagttaatgtgcatatccatataggccaaatgttttacaggaagcctaactttgaaaaactaagtctgtggcagtgtttgtatagaatatgcagctttgaataatcaaaaggactgcattcattttttataatattccatccagctttttgttgaaggttgaaagtgctaaaggagaccgggctcccctgtggcagattgctattataataggtatcatgaggttgatgtattaacctggaaagtacatcagccctttcaggttgtgttatctccaggtacatgtatttatcgaccttccattatagtgattcaaattacttttggggggattcacttcagtgggatggggctgctaacattttcaacaaatttttcttgttgcaaccaagttgtcagagttgtcaccatcattccccattggttatcattaatcatactaggtttttatacctgagagccctgaggcgttgaccctacagatgatggaattataaacgccttatttcaagcgctcctgaagattggccttaacctttgaatctcaaatgatgttttctctagaccagtgcgatcaaattacataccgagggaaaccaaattgcactgagatctgcttcccaattttattgtatacctgtagttctcaagacatatttcttattccatgatcataatgctaggattgcatttcctgcccttggttgtggctttcagaaggtaataagtttgctgatgagatatgcacatttcattcccctagcagtaaaatggtagaaacttgagttaaggactttaggactgttttcctaaaatgacatttccatttaataagacactcaaagacatttttttcctgtttgttctaaatatttactattataattcacttcatcatttaaatgtctatgtagtcagttcctgcctgtgaatgtgatgttagaagggataataacttggagccacaaggatccatgttccttggcagagtggagtcctcctgggaggagttcatatgcaatcagcgtgaggccagatactgaatacgtgttcattgttgtttgttcatttgacttactaaagcaattcatcccctcagtcttttcactttcatccccacacgccatttctgaccctccatgctggcccaccactcacctttactttgctatgtcgacatgggcttgctgtcagttcccaatctgacttgttatcactgccctccacctcctccaggcaaagatcatttccattcagcctcttcctctaggatccgactttgagtcccccgcactagcttccctttgtctttatttcagtgagatggattaacaaatttacctctttaccaatttttaaaatgtgaggtataataacaaattctttctggtgctattataataatatgactcggtacaataacctgcatttatttactacttctctgtgtttgtctttttgatatacaggaggtccagtctggtcataacaaccaaactctactggggtggaaagtaagttatttttcctactaaacagaaaacaactagtagttcatgcttttttgctgttaggcagttattttacatataacgtaccaaaattaattggcttagagagagggttttttgttttttttttgtttttttctcacactaaggaaatagcaattagcctaagatttcattttagcaaggtaatcccaaagaaatttagtgcaaagcatgtggtcacttgttactaagtgattaatgtagatttttcaaataccaatctcatacttagaatcatttccaaaatagagttcaaatttgaggaaagaaaaataggcacaaagcatcacagaagaaaagtcactcaaatctgccaaaactcagagacttctacagaatgcaaagataaaaatatcttgtctggctccatgtctaagtctctgatcatttctgcagagggctctgaaagtgctgatcaaaaggaccatctcactggagaataacatggagctacctgtatcactcgctgtcaggccaaatgaaagagaaatgctctctgttgtgggatacagagaagatttcacaggatgaattggcttcttatgggcctgctggcatttgaactggtacttacattattcagcaggacttagaaggctggcctttttgacaaacatgtaagaaaacagcaagatattccatataccagagcaatcattggtactgtgcttttccatctttgagacagaaatcgcaaaaaaataataataataataataataatgctggagttttaacaaaaagcaaaaacaaacaaaaccttatttaccttcctataattgatagggaattttttttaattagaggcagaggccaattcttctttaggaaccttctaatcaaaatgtctatgtgtatatacacacttgcaaacacatactctattttgttgttggttttgagcctatttataatgatatgaagacagaaagatggaatttaaattttttattcctgtagtaatctgtacaaaaataaagcaacatcatgcctatgagaaatgtggattttcattgcccgagctttgattcacagtgccattgctcagtgctttcgaaatgctacaaaacctttcaggaaatgagacagtctgcaagaaccattatatagtagaatatgtagtagaatactacctacggtattactaatgtacttattaagaataccaaataagaatacattcacaaaagtgaatggtaaatattatatttaaaaagaagctgccaaaggtattgatgttgaagaaacatgttatggatactttaaaattcaagtaccatatttcattctaattggccagagcttgagaattgggaaggcaaaagtccttatgattaagggtctgtcttctgggggtacgaatttaaggaacatttgcttcatcacattttaatttagttttaaaatttattttggaagtcaaaaggcacttccaaatttgcttcctttatcagaaaagctaacaaaaaagttcagcagcctggcaatcttacaataaactcacaaacctatgtcaagcctttttattttctctagattggttaagaacaaggtgaaaaggtcgtacagtgtcttgagttaaatatggacagagtgtacgtggctgagttgctgttaactggagcctggtgttgagcatgttagtggcttggtgacagtcgtggatgattcatctactgagatctccaaagaaaaggggttcagtgtgttgcccaccagacttctctccttagcctccctccagtggtgtagaatttgataagaacagggtgcaaaattagcaattcagaccagagatttagagaagaaaagaaagcacactctcattcaaagttatttgcttctttttcttggcagagctgaaacagaaagagggctgtcaagaaagcatattattgaaggtgggtacttctgcttcaattttatttttggttgtgggcccctcattcaagaaaggtatcaaccaaacaaattcagaacacactggaagaggaaaaagttctatatgaaaagtgccacaatcaaccaagtttcttcttggggttaaatatagggaatgcagagatgtagaggggagaatgggaactcaaaaggaaaaggcaaaattgtatagaactcttctcattttcagctattactaatattaataaaacattctcataagactttttaaaagagctttattgagatataatgtacgtatcatgaaagtttacccatttaaagtgtacatttcatttgttctgagtataattacggagttgtacaccaaacaccctaatctaatgtgaaaacatttttatcccccctaaaataaactttatacccactagaagacactccctatcacctcctcaccccctcccacagtcccaagcaaccataaatctactttttatctctatagatttgacaattctggacatttcatgtaaatgagatctcatgatatatgatattttgtaactgatttctttcacttagcataatgttcattcatgttgtagcgcatgtcagtattttatccctttctttgccaagtaatagtccactatatggatagccacattttgtttatccatttatcagttaaagtgcgtttggcttattttcactttttggctactctgaataatgctgctatgaacatttgtgtgcaaatttttgtgtagacatatgttaagactactatagtttttagtttttattttattattatttagattttttcatatatatattttatttcaatagcttttggggtacgagtagtttttggttacatgatgaattgtatagtagtgacctctaaggctttaatgcactcatcactgagtagtatactatactgttttagaagggaatatacatatgcataaaaaatgtgtagaaaattaccactaggtaattgattcctggtgcattacttttgcaaggcacccaaaactttgtataatttagaaataaacaggaaataaaacagtcaacaagaaccattatgtaataaagtactactactctacttaatcgtgaagattgtgagaattgtgagtaatttttatttcttgcttgtctatatattatcaaactttacacttatactttttgcagtaaagaaaaatgttaagagtttatactagttcgtgaagtacagatgctcccaaatttatgatgggattacatctcaataaacccatcttaaattgagaatatcttaagctgaaaatgcgtttaatacacctaacctactaaacatcatagcttagcctagcctaccttaaatatgcttaaaacacttacattgccctacagttgggtaaaaccatctaacacaaagcctattttataataaaggctattttataataaattaaatgtcacatgcattaataatttattgaatactgttctgaaagtgaaaaacagaatgttgtatggaaactccatgtacagtttctactaaatgcatatcactttcactacatcataaagttgaaaaaccataagtcaaaccattgtaagttgtgaactatctgtatttcaaaaaaaatccaagaattttgtaactttggattcatgattgatcattgaaacaagtgattttctcctttttaaaaaatattttcatttaggaaatactaacatcaccaaaaatgtaaaatgtgctctaatctcaccacttcgaaaatcaaaatagataaggaagccaggttctccatttgctcatccaatctcatcccatcctagagtctgacaatctggtacacatcttcttcaccttttctctatggttgtactgacttatctgtctatccatccatccaaacactggcttatattttaaatatatatataaacagtagaaccaggccacaaatattaacctaagccttgatttttttcttaattaaaatacacaacttaacagattattttcagtttttagcattttaaagaattatacaagtgaccatccttaggtaaatggggtagattccagagtggcattgctaagtcaaagaattatacaaattttaacacaaaatcactttctaaaaggaatatgccatcctgttagatgagctggtcttatttatctccttatttatatatttatttattagtgagtttgagcttcttttaacaattttgttctttttctggaaattcactcttcatgttgtcaggctatttttcttttgatttctttgtcttggtcataatactttgcaggagctctttgatactagtgatgttcactttttgcttggtcatatgtattgcaaatattttctctcaggctgtcgtttcattgtgaacttttttctctccttgaacctaagagctaatgtttcatttgagtatttttattccaacttggaagctgaagatctttatagacctataaacaagactacgttgaaatatcttagacttgcaatagaaaaaaaatagtttcagtattcaatcactgaatttaaaatgaagacatttgaagccagatctcagaatgtatatatatgtattctttcttgattgccagtgtgaaccatatgtgtgtgcatgcgtgtgtgtgtgtgtacatagatatatgccataataattaaatcaccccattgtttccaaagtctttgtataggtttggtatctctcactgactgtttttttaatataattttaagcatatgggctttcaaatcagacctttgttcaagttccaactctgtgatttatgagctggtgactttgtgcaagttacttaacctacctagcctctgtctccttaactatagactataaatataaaggttactatatggggataaaaattatataattcacattgagcacagtgtctgtcacataataagcacttaacgcatgttatttttgtcatcatcattgtccttataagtacaactgctagtcttcattccatggataaggatactctttactaagtagtgacattctgaaacagctacaataagtgacaaccttctagccctaagaaaagcatccaaattcctcacccaaacagcatccctgctcaggccttagtgtcccatttgacattgtaaagtcaaagctaagctgcctctcaaagctgttactgccctagcattcctgctccagcatttgccctcatgacttgtattctcttccatggagtttgccagtgacaaataactcaagtcagcttacagaaccacgctgaatgaacagggcagcagtatgtttcccgaaaagttcttgttttttgttcttttctttttaatctaattaattagaaaagagagattcggaaaatggttcacactggcagttagcaaagaaatataaaatcgaagagaaaaagaatggagaaggtctgctactatgctcctcactgcatctccattgctttaatatttaccagagtgtgtacataatttcagggttctctctttctttctttctttctttttttttttttttttttttttttggagacagagtcttactctgccacccaggctggagtgcagtggcacgatctcggctcactgcaacctccgcctccagggttcaagcgattctcttgcctcagcctcccaggtagctgggactacagtcatgtgccaccgtgcccagctaatttttttgtatttttagtagaggcagggtttctccatgttggccagactggtctcaaattcctgacctcaagtgatctgcctgcaaataagcattttttcaagcctcatatgacataatagaaatatcttaaattccctccacctttaaataagtcaggaattctcttaggaactaatctctgaggatggataaaccagttcagctgaaattcaagctgacccagattcaaactttaacacaaaatttcaaacttttgagatggaagaagaattgagatcatttgttattatgttggtggtggtggtgttattttacagtccatagtttctgccaaagataaagccttgtgattacaagagaactagctcaaagtattttctaggcaggctgaaattagggaattgagtgagttttgcagaaaagcaaggacatgagatgagacccaaaataaagtttaaaaaagtttacaagttattatccttgggtttcattggtacttggttctgtgatgaaggtgacctcactcgacattggagatttgtatacaaattaaattagagaagtaccattagaggataagacagaaagttcaaattgatacagagttcaggccacttctgtgctgggtgaccttagccacctgagttagtttacagagtatacaatgagcttgatttgtgcttaatgtaggtttgaaagaattcatattgaaaggcctttttaatgagcccaaagttcttgacttagatctgcttaggtgtaatgttctccttagattcacaaggaagaggaagaaatttcactagcagattgattacactcatttagaatcacaaagtcccctcaggttctaaaatccaatttactcattcagccattccacaaacattttttaaaccccaatttgagccaatcttagaatttagcagaacagattcctttggtactggctgggcatggtggcttatgcctgtaatcccaacgatttgggaggctgaggtgggaggatggcttgaggccaggagcttgagaccagcctggtcatcatagtgagacccttgtctctacagaaaaagttaattaattaagttaaaataaaatacattcctttagtgcctaatgtgaaggaaaagaaatagtttggtaggtcaccaagtaagaataagtaaatcgcttgtatattccaacagccaaaagctgtgtccgactctacatttgcctttcaggtaaacaattttgttacacaattcaaaacacaaacccactgccattgtttttggagtaggagaggaaaataatctgagaaagctctgcttgaaactttttaattaataacaaatcttaaactctatgaactttaaaagaaaaagacaatctatgatttttcaattaaagaatacatttctgaacaaatggatttgccacaggattttttttcagtgtactacgttcatgtaaacatacatcagccatcaaggataaccacgttttgtaacgggaggcacagccatatgctgaatatgattccagtacaacccagcctttataaaagaagcaggtgtctcaaattatgatgataggtctgctgagaaaaaactagaaattatataaacaatgtatattatttaaggcaactttttttgcaagctagatagaaaagcaagtgcgtggtaggtgtaaaaggtgacaacacagcatgcttaaatagaacccttgcagaatctccaaactactgatttccttgcttccacacagtcaaacctgcaacagtgaacaccccatccacctctaactgtgccaatctgctgactgtctggaataaacatatttctttagaaacctgtgaaatacacttaaattgaattaaggttaccttctaaacagtatggttcttgttaaactttggaacctaaaagaaaaatggacttagattttttttttactgtagtcacttgaaaactattttctttgagtaatttattttcctgtggacttttgagaaattgccagtttacttctaattatctcctcaaggtcagggagcatttctcctgcttctcctgttttcctctttccacagacgctgggttagtgcggaggcacaggctaaggtcaaatagcctccagcaagtacatttgctgcactggagcacttacctccttaggttaagattggctgcccagctgcccttctggagccaaggttaatgcatttttgcatgtctacttaaacttaaaacaatacctggccctaagccagcactcaacaatcatttgctaaatggagatagaacatgatgacttgttttttgaaactaaacgtaaatggctcttaaggagatactcatgaaacatatcttaatgttgatttcatttatgtatttctacaaaattaaagcatccagagaggaaaaagcaggaatatctgatttggtttgcagtcacatgaaagaccaaagcaggaagatcaccaagcaccattttgtccttggacagatgaggaaactgaggctcagagaggctaagggatatcacagggtcattcgggacagcccaaatcagtaccctgaatcccaaaccctgtgcctcgcctcctctgaatgccagactggtccatccagctgccaagagctccatgtagtgactgaggtgctacttagactcaacttggctccccgaccacctccggttggctttccccctgactgccccatttagtaacagtcgcttcacttctcaggccaaaaatctaggagtcattcttatttactctaatctccacaccctatgtccagcacaccagcaagtccatgtattactacttacacaacctgtcccaaatgtgtacacctctcactaactttgtctgagctggatgagctgcggtggctgtgcctgccttcactcttgtgccttcaggtccctctcagcaggtggagccatcagttcaaaatggaaatctgatcatattatttcctctgcttaatctcctcctcactcgaccctccccaaccaatgtctttaaatctcacacagaatccaaagttcataccatggattacaagactttacgtgattgagatttttaaagtgagtggatagtgtcctttagagggacaatttcctttcactccacttcaaagtcagaggagggatcactggcctcagatacttgaatttcttgccaaatatcaagaaagtgcttttcagagaaagaactaaagaggtgggaatgaccaaataccatgaggctgaccttaggatcaagtccatatcattagttccaggtacatattacgaccttgaacaaggaacctgtgccaatagccgctctcaatatgcactgttagtgctccttgggatgaagactgtgtctgtgcatctttaaaccccgagagcctggcacggtctcaggataaaattggaactcaatacatgctcatgggatggaataataaatgacaaaatcacacctgtctgtgacatgcctgatcacacagtgctgtaacagtgccaagttatttgtagcctcttctcctagttactctcagcccacactgagctgtttagaagagaacggagagagagggccattgtcagaaaacaagatacttatttcctctgccaggcataggccagaactgtcattaaatgcccctttccaaaacagggggtctagtgaaaatttttggcatttggtcttctgctgtcttccccctgaaactttccagatgcgaacaccatggtataatttcacattctggttctgtagactatgttacacagctctcccaggagcagcaattctgaaggtgtcagtattgttaggcccactgcagactagagaattgagtctcaaagaaaggtcagagaacccaagtggggtccctagcatgctagagtgcagatttccgacctttcaaaccttgtgataccctgttatttgtttacttagtattcctgtcctttccttacctcctccctgcatacaactgtccccaaaagtggctcatatcatgatactttttcatgttaatttaatttcacactgtttcttgagatagctggtgataccctgtgcctgagcatcacagaaggtttataggagaaggcattagacctcataacatctgtctgccctaatctcttcatcaaagcttttaacaagctaccatcacagacaatcctttctcaatggatggaaaatatttccagaacaatattcaagcactccattttcctgtcagaaaagtaattgtggctggctgataaaccagtatgaaaaatcaaatttaaatgaaccaaatttaaatttataagagcctcatttaacatgcaattaattttatgcctataataaagagactaaagcctctggtctccctgaggaattaaagaggctgataagagaatgctaaatgctgtgccccatggaaatagggtaacatgattctcgaacactgtcatccttttggttgcataatattatatacaatacattctatttcagggaagcattaattttactaaaattaatttttttctgagtattcatagaaatgtgaccaaatggttagggctgaaacataggcggttggttcctgactccctttttaagttcttattctctccttcatattacgtcttcagtctttatagcattagcgtccagtgtttttgtttcttcccccaaaacagagaataatagaaatggtagagctcagctatattttatgttccttaaactttgttccaattagtaaaatgttgagcaaaggcttcatttgctaacccctttatattactattaaaaccaacatttacattaagatggggttggggcagtcatttatttctgatttaaaccattttaatgagttttatgtgtaataaatgtacctctagctcactataagcctattaagtgatccaaaatacataaatattaatttgcattgttcaagaagaaaaacactaactgttggaaagaagctgctttttattctaaattttgcttctggatattgccacatacaagtcactgtgaaggtcattcctaagtgtatattttcctgtgagagtgataatattcctgaaaaagctctaagactttttttattgggggaagtcagcctttcatatatttttaaaacgttctagagtcaattaacaatcattgtattcaacgcatttttgaaactattccaattctatttttttaaagcaaattcttgaaagaaaccaaacttcaactctgaatagtgctcatatttagattttggggtttgtttcctgcttctgctcccaggattgaagggctccctccagaggctgcagctcgagtatgtggatgtggtctttgcaaatcgaccggacagtaacactcccatggaaggtaagttaagaaagctaataaaatactctagaaatcttgattcagtttgagggcttattctgctcacagcaggaaatgaattgtattcagactgatcaaactgaatgtgaaaaataaaaatgtttctgactgatgccttttggcctcagcgtttaaccccaaaaccaatgctctgcgtgctgcgtcttcttcttttaaagcagttgaaggcattgggctcgtggctcccgctggttacagtgctcaccttttccaggttcatttcacttttgtgatttcatcaactaaaacaataaagttaattggaaaggggctttataactcagccatcatcgcgtcacagtaaatcctttgagggtcttcctattttataatggctctaagtctgattagtttccagtctgtggtagcaatgctcagtggtgccaccagcagggattccacagcagtgactgcttcaaaataagatatcattgcagtttgattgttgagtctcaaggagctgcaacattttatcccccttctgttataactgtttgaggaccacagtttaagcttctccctgtggaagctttcagaatgtttctaaaaccagattttcttcgatttacatttatttacagaacttgctaggatgtttgagacagaagatagtttgagaggctgaggatgaattaaaaagaatgttccagttaactgaagtttaaaatcatatggattatcacttacctgaggtgattgagaatgaagatatttgagaaaaagagcaaaaatgaatattctggttatttgaacagtatgatgtggattaccacttttaaaataattagaatagtttgattcacatgagattacattgaaggtaactttgtccttgatgattcaaaaggcaggatcttgtaataaatcaggctctgtaaagagtggttcttgttatagggttatagaagggttatagtaatggaaaagtataaatgattgacatattataaatttttctgggttgtatttctgaccataaaaaagttatggaaattattttccttgccatttgtctcattctcaactacagagaaatgtaaaatatatatagtcttataactaactttctcctacagttttcttctttcttgaatccgggtaaaattaggagtttattataaagcagtatcagcgtgggaaattttccatggaaatgacataaaactgcatattttttgtcaaagcaaagattaggtgtttgagaaagcaaatcataagcattttattagtataagaagtatttattgcaaggataatatgacgttattcaactcttttttttattttttatcttatttttccataagttattggggtacaggtggtagttggttacatgagtaagtgctttagcggtgatttgtaagattttggtgcacttatcactagagcagaatacactgcaccatatttgtagtcttatccctcactcctctcccactcttccccccaagtccccaaagtccactgtagcatgcttatgtctttgtgtcctcatagcttagttctcacatatcggtgagaacacacaacgtttggtttcccattcctgggttacttcacttagaataatagtctccagtctcatccaggtcactgcaaatgctgttaattcattcctttttatggctgagtagtattccatcatatatatatatatacacacacacacacacacacacacgcacacacacacacatatacacacacacacacatatatacacacacacatatatatatatctcacagtttctttatccactcgttgattgatgggcatttgggttggttccatgattttgcaattgtgaattgtgctgctgtaaacacgcgtgttctttaaggaatattcacactgttttccatagtggctgtactagtttacgttcccaccagcagtgtagaaatgttccagtcaattcttaatgacacattaaaacagagcactaaagttatttagtctgcaatagtgtcaagtaaaatgccatttagtggggtctatgaaagactggaattgcttcacattttaagtgcctagtgactattttcctcttttagacagtgttctttgcagttataccatgtacaggatagcagaacatctgagatttttaagaattttgttcccatcttacccctacctttaattttaggaatatattgtaggagtctctcaaacagaaaacataatttgcattatatttatagaagaaggaggaaatcctcaattaggagccaaactatgtgataccaacaagataatgatgtctcttgtatcaatatttattacatgttgaaatttattttaaaaatcttcaaagtgttttaaaaaataattgctgctgcccagtggagttcgtaactgcagcattatttagcctttatgggaatcagagaaaatttacatttttcctgagtagtttcttatatacaattccacaaagcggaatgggaagctattttatcctgagtcattttccaagctcagaagcataatgaagggtgtcaaacaatggagattcgccacttgttgataaggtcaaggcacatggcattttgtagcacagcagcaatcaaccacctcatgctggaatgttgcctgctccccctcactaggaaggggagactcaccccagcaggccaatcaacctctgaggcttattcttctgggaggaccctgcagggacattccacaggcagctcctcatgcaggacttgttccagattgaaatagcttccatgtgagcttttcctagctttcagaaaatgtttatcctcaaacttagtacactcatttgttccaaggtgggcccactggaacaaccagagtttgatataagtctctggaaacacatctatacatatagtcttttctactttactgtaccgggggaaggtactgatctgggaaataaagaagaaataggaaataaagagacaggactgtccggtggacttgggtacatttggcaccctaaaaatggggggaaaacaaggtgcctgtgttagttctggattccatgttgttgagagtcacctttgcaacaattttgtaactcatacagtgtgtgtatgggaataaagttgtacatgtacaatgggggtataccttaggaagactatcagtgtttctaaaaacattacagaaggcaaatgttatttataatcaaattacccttgaaaacactacagtaactctgttagttaatgatattctattggcgttaattaattattcaatttatttttcaaatgtggtgaaaaaatcatcaccagatagttgtccaacctttttttttcggtagtggcagaaaaatccttaatatcaaatgatactactttttttcttgtttcagcaactcacgttggctattttaggttcacttgcatccatttctgtttaagtgacacaacagtggttgccaagtatatattgttgagtatttatatattaaatctacatttattaatactatggacccttagcatttgtaaatcatttttattgatttcaactattatttgccaaccccatggagtcacaacccacgctgacataattctgctgaggcacctcttttaaacacaggggacgtagcactttcaaatgagttcagcccaacccagtgcttgctcttatttgtcactgattaccaggtagcgcggagtacaagaacttggggacactgagagtctccagtcataaactatgcaaatgtcaagggtcatgtgtgtgcccacaatgagcatcgctaagatacattttaaacaacttccatttaaatattattaaaatgccaattgtattcatgtggtttctaccatgaaatgatgttaatcgggaacattttaaaaataaaccaagacgagcttcatccagtttctacatatcatacagcaaccatttgagccagaaaaagattaactgcagcatctttataacatattggcatcatatatctaattagttttttccttcccttatttcttagaaaatcaatagacaaaaagcgagtcctctcaaaagaatggctgtaaattccaaaggtgcaatcagtggagaaaggggtgagaaacttcattcgcaatctgcaaccccatggaatacagttagacattttcaggctatgggaagatgttcctgacaatggaggggagcttgtgtactttttcctctgtccctcttgtttattttttctggttcacctagtagtaagtcatttttctttcacagcatctgccatgccatctgtctctgctacaatatctggcaacgatggcatgttttccagtcctagaaaaaaatcagccccacatcccatttcctccttcttatgggtctgtgttcctcccagtagagtcactgacagttctttatgctctatgaagctcatatccctaattctgtcacttccacaaatccctaacctgtatttcaaaatcttctctcgagctcattagacaagaaaaagttcaggcaatagagtcagtctggacatggatggacacagagcatttgtgtgtccaaggagccatatgaggagttttttgggtttttttgtttgtttcttttgactttctgtcattcccaaacaccaggctaatatctctacctatactcttctcactgctccaggaagaacagattgagcctaactgtggtcatgaaaggaaggtataagcctgtaccacttgtagacaacagcaagaagaggggacacactaacttttcgatctgaaaatatgatttttaaattaaattaaattttagttagttttttattttaaaaacacttggatttgagtccttacttttcatatagagcttgttgccaagactgattattcttacagaattcctgagtcattaaatattatttccatgctgataacggttccagttattaattttttcctgccagcagatcagcacagacataaagcagcccagatgtctcaatttcaaataagagaagcaagaccaaagttagcttcacttattcccatagtatcatcttgtcaaataacccattccataagtatttacttctttctaagccatcttttttagtgttgtcatgtgaaagcaggcatctatggatattcagggattcaggatatccaatgacaacttagaaaatgccagaaagcaaaaaacattgcagtatcccaaattttctacattttgacagttccaaaatactggacctagatatttaacttccaaagtaaaaagttttcaaaaccaaaattaaccacctaaaacctagaaacatcatttaaccacagtagatcaggccttctgcctctatcttttattatcttccctgaaagttaccttcaagccattcgaaaaaacatgatatagaaggaagaaatcttctgcaaatattatcagggagctgtccaatagaaatataatgcaagccacatatatataatttaaattttctattagctacatcattaaaaaagtaaaaagagagaggaacaacacatatcggggcccgttgtggggtggggggcaaggggagagagagcattaggataaatacctaattcatgcagggtataaagcctagatgacgggttgatgggtgcagccaaccaccatggcacatgtatacctatgtaacaaacttgcacgtcctgcacatgtatttctgaacttaaagtaaaaaaaaaaaagtaaaaagaaacaggtgaggttagttattatattttatttaatgtgatatatcaaaacttaccacttcagcatgatccattagtatccaaaagttactaatggcatatattacattcttttttttccctactaagtctttgaaatcagttgtgtacaccctaatttggagcaacacatttcagctgctcagtagacaattttaattaggatcagccacatttcaagtgctcaatagccacatgtggctagtagctactgtacttgaccacgcaggcttataaaccatattcccagtctgacagagccgcagacacatagtaggtgctcaataaatatttattgactagctggatgaatgactgagcaagtgtttgagtgattgaatgaataaagctccaaagttaaatagctccaacttcattttcctctacttgaaaacccatcttggtttcctaacctctataaacattctagtacctggttcaacatatttcaaggagatgttgacaggttgctgccaaacagccccaggacacttacatgctgtttctcatctacaatcacagtagcatccagatgcactgcatctctctttagaaatctgattgatatctaaatgagcagaaatgaataaagggacaatttggcaatacagctgccccctgagtattactgtatcaattaagattatttaatgcatttcatttattaccctggccaggacgttcccaaggcctctggtgtacatcagatcaatttaaccccctggtttgaaagcccgggacagttgagttttcaagaaattaatttggagaaaatgattttcatatccaagaagatgagccaaacccagccaagcttgttgcaaaaaaaaaaaaaaaaaagtgtttcaattttaaaaagcagttttgtttccattttaactgcaaattcaccaaaaattttcctgatactttaggcctatttagctgatgttttgtcctgtacagaccaaaaaaattgtgtcataaaaagacaaatttatttcatccgtcctaagaaatgacaatgggggacagtagggttcacttcaggttctttccatctcaagttcgtctgtttagaaaatctcatgtttctgttcatagtggacctcctcattggaacaatatttctgcagagtggactagggcattagacagacacaacttcaaattctggctttgctacctatcagactgtacacttgggaaaagctactatcctcacagaggctcactttcctcacctgaaaacagaggaaacataaagcaccatctgaatgagttaacaatgtggttacagcacctcactcacagctggggcaaacaaacgtaagctccatttctagaatgccctaggtaaggcatgtaaaactctcctttctctggatctcttctcagaggtaatcatgggagaagtccaaggccctgaaattataatatgatgaaaatctaatggagatagccaagctgcagggctgcacaggatctgtgatgaagtcatgtaagattcaagccatggagttggcagtgtaattttcttatagccctttttttcctcctaaaattttgctctgaaactctttatgccctttaagctgatttaatcataaattttccagggttaatctattcagcctgaaaggtgatcttgtgcctgtgactttattttcaaagatgtctctagaaaaaaaaaacaactcaataataggattaactcattcattcagttgatattcactgaatacttactatttaagcactgttttgggcacttggagaagcagaagttaataaacaaaaatcctatccttagaaaaatcacattcttgttggggagacagacaaaaagttagtaagaaagttacattagatggtgataatagaatggagaaacaaactaatcatgggagggggctaggaagttatgggggtagattttagttaggatgacctaataggaggaaatggtgggcagtggggagggggtttggaaaatagcttggactcctccaaaatagcaaaggtatggcattaagagtcagacctcaattcaaatcctctttctgttacgagccaattgatcttaggcaagttattgaacttctcttgtccctggttttcttatctgtagaacgtaggtaataatatctgctctatagggttattgtgaggattatttgagataatatacacaaaatgcttaggatgttgcctagtaactactcgaaatttagagctaccatttttgttattattactgtttgtatagtactgctgtaatttttttatgcaggaaattaccttgatgcaattgtagtctccaggtctactaccaggttatcctagaggtctcaaagaagaaggctaacacaacaaattaagatgcatgagtcacatggtttatcaaatcaattaaaacacattatgagaagaaagaggggaagagatagggacagttaaaataattacactagaattcacgcaggagaaagaacccagctacttaaatcttgggacacacagtgctcatgtgacctgttctctctatctaccacattgaccttctccgtggtgtgattatataggtcaaatctgaggtttcagcaaggggctcagcaaggaaaagatgcccgggtcagtagtatacttggaaagacacagggacaagcccacctggccatgacctgtagctcatcatttggcctgatgaacagctaaggactatttgcattccttgcacagaggatttctgtggctagaatgggggtcaccaatgggtggctgactgaagacttaagttctcatattttatgtatttatatttagtatatttcaaatgtttgatgtcgtatgcatatggatatgttgtcaatatcacctctttccattcctccctcctatctgtgttcagcatgcacattctctactttgttgatggccactatgactcaggggttactaatccacttagttttaccatgctcatcatataaattctgcctatgtctcacaagctacttgcatctccacccagtttcatttatcctctttctttgtttcactttctttcttgagcagaactgaataatcttaagtcatacagcaaaggcacattacagagttcaccactctcagttgttgacatgttgcctcaggtccggcaaatcttccaggcctgttgaaaaatttccagcattaacaagaggcccacaaagttctgactgtggatcattctgatatgcatctataagaacagagcccctggttaacaaatgatcttttccaactgggttccatagaaagaacaagagctttagagaaattacctttactagaactactgagaagttaacaattgccaaggctgcagaaaatatgtgaagagctggctttaaagaaaactatactccagaaaaacaattgtactcatctggtgttgtattttccgctttctttggaaatcagtgattcccaaccttattccataaagtcctggtttgaagggaagattctaaagaaggatatgcttatatgctatgcagtttacttcctctattttctctcctccctcccccaccttttttttctttcatgacatctttactcaacagcgaaggcagaagagattcaatctgtatcattcagtaagttaaaaaaggaaaaacaaggtgggccaaatgtttgggagactattgtaccttctcacaacaagtctgtggacttcaccaagctccaaaaggatgcttttttcttcttcttctttttcccttaagttgtttttagttaagaaaaaagagagagagagagggagaacagagagtgcttctgctcaccccagctgtcaggtgaaaaacagagctgcttagtattctggggctgtgggtttatgactcatgtgcacttccttctgtgagttgtcatttctctgagagatatttggagttgtgacaaaatttaactccatattctgaggggatgttgactggatctcaggagaattcatttctgtaagttcctcgatctgctgcagcagatctgcagtgacatgcagaggacttggagactaacatgacttagcagcaacacactctgagggtttactggcatgctgattgaatgcagtgagcagagccacctgtgtcagggtaatcgaaaattctcagacagccggggataaacaaataccctcgagtctctctcttactttctgtacaaaaggaagtattaataatgagagtaagtggttttgttaacccccctcctgaatatttaatatgtgtcctaaaaaaatatgaggtctgcaatcagaaggtgagggcgttagtcttaggtatataaacttggctgagttgctcagaccttcagcttctcagtttttcatttgtaaaatgggaagaataaaaatattctagctatttccaagattgttgtgaagacaaaatgagataagtggaaacatgttataaattgtaattgtcctgcacaaatattttgaggttgttgttgttacatatgtttacacttttaggaatatataaaccttggaagatgtaataatcaaagtttcagccagacaccaagaaacaattgaaatgacattttagagtgagatgccagttctccatttgtactttcaaatgaagtgtgcaagagcttgttccatagctctttcttcccccaactttttattttgagaaattaaaaacttatagaaatggtgaaagaataaacacccaatactcttcacctacatttaccaaattgtgccacattttgcctttgtttttccctctcttgttctttgccattgtgacatttcattcataaatattttctccagtatctcctgagaataaggcattcttctatatgaccataacacaatcatcatactcaagaatattcaagccatattcaaattttctaaaatgtcctttataggatttatttgttttgcttttttggggggggcatgaatcctgcagtacatttaattgtcatgactgttaaatttttttattttattctattttagattcgggggtacatgtgcaggtttgttacatgggtatattacataatgctgagctttgggcttctagtgaactgatcacccaaatagtgaacattgtacccaatagggagtttcttaagactcaccaccctgccaccctcccctcttttggagtccccattgtctagtatttccatcttcatgtccttgtgtagcccttgtttagttcccccttacaagtgagaacatgacgtatttgattttctgattctatttcacttagaataatagcctccagctccgcccatgttgctgcaaaggacatgatttcattcttttttctgtctgcatactattccatagtattttccacactgttttccgagggcccaggagggttgctgcatcccattgctggtcctgttcaggttgatcactcgattcaagtgatgtctgccaggtttctcccctgtgacagtacctctttaactttataactaataaataacctagaatgtgattatttgagactatgtgaatagcctgtcccccacaaccttgttttagcacccaccaaggatccctgcctgtgtccgcttttataaggagggctgtgagacggtgctttcctgattccatcagctcctctttctttaggagttggttttcttctacaaagagaagctttcccttctgctcttaccctactctctgttcagtgactctggagctcctcactggcttcaaaagtataaaagttgagagaggggagtaaagggggtctagtgagaagggcacgtatgaagaaaactgtgctgtgagctccatccaccccagcatgggagaaggctgcctcttcattgccaccctggttgggatgggggtttgaaggccattcagatggtttaaaacattacccccatgactggggagcatagtggcctaggagctgatgcatgcctggaaaatccaggggtaaagaggtgggctgactatctgtcttggtggcaccactgggggagtgctgacctcctgggactggtagggaaggtagttacaaatgtctcctgtgtggggtcttcttgagtcctgcccttcagggcctcctggaggatgaaggctggaggacagggatttgagggagaaaatagagaaacagagaaaccaaacatacctgacactcttgtagtcttctagcctaaacaggtcccagcttgggcagaggaaaagagtttgagtttgaagtttgattgagattgttggaggatgtgcttatgacttaaaatgactttaggtctctgtattaccatagaatgagcagaaaagatgtgggaccagtctgagttttcatcaaggccaaaggatacttgctctactgaatgttaaggaccagtaggagatttaaaaaaattaagctgaaggattacattatcattagttatgcttgttacacgtttaaatacctaagtttaaatctgacttaaattacatgcacatgccaaaaaaatttaactcttagtttcagaaacaaatttgtttactttatatgaaaataccattaagtccaatataactggaagtttaggaaaaccttatgtgcttaagattcgagtctccataaattacagaataaagcacttggccccctgtataaaattcatacattatacaaagacatccctcatactccagcactacttcaccccacataccctccttgggaatctgaaaacttttgaggtgtcacttcaactttgggaagtaattatttgttaatgttcaaatagtggaaaatattatatgccacaaaagcctcaacctctgcagtttggaatttacccatcatttctaaatgtatccccatgttaagttttatgtatttgttttaaattcaaaagggaaagcgtgtgttgtgtctagctccagtgaagccaatcatacaaaattgctgataattaaataagatacttttagacttaaaattttgacaatccaaatatagtcagctcagaatttgcttattcaagaaaaccattttgtttgtttttaagggccagtggatggaacagtttgtacagggaagcagtaggaagggaaagaaagcttagtgttaaccaatattcttctgtattaagggcaaaaaggaaagcattgtatcatcgcctttgaaactagaagcaagtttggtaattaaacaaacccaataaccactttaaaatgaatgtttttatctaatgagataggagataaacccatctgacaagagaattcacataaaacttaacaaaaagccaaaaaagggagataaaaaaaaaataaaaaatgggtaagaggaaagaatgaaattttgtttctctcatccctactctcttcctgagcagagatcaaatgttgcaagaccctgtctcaaaaaccctacgtaatgcattttaaatgtcaccatatagtactcagatgacccacagaagaacatgacatagtataaacactcaggtgcaaaacctggccttgtgcatttattcatatccaactaatatttattgagtgtctactgtataccacagcatacataggatttattagagaacaacatagacaaagatcccagcccctgttgggcacattctttctggcaggagagataagaaacaataatataacaaaaagttaaattgtatagaatattagatgttgatgggtgctataaaaaaaaaaaaaagaaaaactaaagcagggaaattagaatgggaatgcttaggaagttggagttggccattgagaaggtagggtttgagcaaggacttgaagaagtcaggtgaatagccataagagagataaggagactacttctggctgtagaaacagtgcaaaggccctgagatgggagccttctgtcatgtttgaggaacgtcaaggacatagatgtggctgcagcagagtaaggaagggggaaggtagaaggagacgagtttagagaaataagtgaggccagatctttgggctctctgaatttttgacaaaaaagtgacgtgacttgacttacatttcaaaaggatacctcctccttggattgagaatacgttataggggcagccttctcaatagccaactccagagtcctaagcattccctccttggattgagaatacattataggggcaaatgtaggagcagggagatatgttaaaaaatggttatagcaatctagatgagagaatagggtgcagatgagggcactagccgtggactgtaatgtggttcagtttggataaataatgaagttagaggcaacggaagttcctggtgaattagatatgagcgtgactgaaagaaaagagtgaagaatgactccaaggttttaggcctgagtcaccaaaaggatggagttgccatcagttgatatgggattcatagctgatatggaaccagctgtggggaagctcaggggtttgagtttagtcatcttgagtttgaaatgtttattaggtggccaagtgaagatgctgagtagggagttagacaccaaagctgaaactccatcttgggatgaaggcataaatttgggagctgtctgcatgcgaatggtatttcaacccttgagaattgatgaaatcacacaagtagtaaaagcagaaaaaaaagaagatatagaaagaaaggactgaggactgagctctgggactctccagtgttaggaggttgagaggatggggagaagcgtgtaatgttcaagaaagaaataaagaaatcacatcaaagaggaagaagggatcaactatatcaaatgttaccgataggtcaagtaagatgaagacgggatcagctatatcaaatgttactgataggtcaagtaagatgaagactgaacattgtctattggtgttaacaatgtggaaatctttaacaacattgacaagagagttctggtgaagtaagaagggagtgggtgagtaaaagccacttagcctctgactcacagtttcctaatttggaaaaaagtaaggaaacatctggaattagcaggacaaagtaaaaatgcttctaccctttccttttaaaaaataaaaagctacccaatacacaacacagagacaaagaaacagaaatagaaacttcatttctcatgaaagtgtcagtgaactgaaaacctagaccaatatgtatgaaaatggaaaagggatgaggattataaatgacttagcagaactgaggaaagattttttttaagtgcctgcagatgagtaacaacttaacatgtaccacacaacctcaggatggttcatctattagagaatccaatgtcacggaagatgggggtgaggcagggaccaggaacaaggtagttctttaaaagaggatacagagctactaaagctcatgtccccaggtctgcagtcagtgtcctgcctttctcctccaatgaaggaagaggagttttattaactggagacattgagttgacaggctctaagctgagagatatcaggcacagagcaaggtggagccaggctgcaaataaaaagactatgagacttgagaccccagaccccttctctcacccatgtccaggtcaccagcagccaggtcacaccctccccatgcagaagacagagtatctcctaggagacaattaactgtcccaggaaaaattctaacagatattgacattgttgtggaagaaaaccctattgaaaattacagcatgaatggcactagtggacaaacaccgttcaagcacaattttagtgctttattcttaaatgtgaactgaaacccaaggatcatctgacattcaaagaaagtctctaacaggaaaagaagctcaaataaatagaaaaaagaaaacagagtaatgcagagagatacagaaatgttcaaagaaactataatatacttggtgatataagagaaggtactacatcaatagaacagaaacgagatggaaaagagcaagaacaacatagaactagaaaaagattttacatatttaaaatacaatggctaattttttaaagtcaattagaatgctggacattaaagttgagaaaatattccagaaagtaaaagagaaaaaggaatggacaataggagagaaaagataagaaaataaggttctgtccacgagtccaacatcttttcaactgaaggatatcttgagagagaacagataaaatggaggagggggagttatcgcaaagcaatacaagaaaatttccagatcggaagaacacaagtctccagatggaaagtgcccactcagtacccaatacagtgaatagagattgacgcaaagaaacattatcatgagatttcacaactgaaaagagaaagaaaagcatcctaatacatttcagagatttaattgaatacacacatgaaggatccagaaaaaagattgctggattctcaacagcaacatggggaaccaaaacaccatgaagcaggccttcaaaattctaagcaaaaagatgatgggcaaactacaaaccaagggtgaagaagtaatgtcattttgactttcctgtctctcaaacacaatttctccacaagctgctggaaaatatgttccaccaacacataaagataaagccacaaagtggaagccatgggatccaattcattaaagggaggagaagaattttccagataatgggaaggaaaacgccaagaggacagccatgcagcaggcacagaaagtgaccagcagagactgcagcaggacgatggagggctctagaagaaatgttgccaggaaaacaaaaaggaactgagtttcttatcagcttgaccatgtggaaaactgtactgagagatatttggagctcggctgtagctccaaatcaaactaaattaataaagcaattgtttaatgaaaggtaacatgaaaatatatgggagaaaggaaatacaatcattatagatgactttgctcagccatggatattaaatacttagtcataaaaatgaaaacacagtgaattatacttacatttgtgagataaacttaacttgcttatgatgtattattttatcattttaaatatcatactatatctggtaagctaatatttaatttaggacttttatgcctatattcataaaaaaaattagcctgtaatttattttcttatattgcctttatttggctttggaggtctttttactcctcttatagggccacaggactctataaataatgaatatttaatacacgctagctatctaatattattccttgatgaaaaaataggaggtgataaaattaggaaacaataaaaagaacagaaccagatagagaactctaagtgtcctgattagcactgcatagtatcagagaaattattcgattctggaatgtaatttggctaaatttaattacaccatcctcttttaaaacatcaagacacagacaagaatgtaagtcttttgtttcaggtctcatagctaattattggaggaactagaactagaatccaattatccagaattctgactcctagccctagtgctcctataaaaatgtatattaatagatactaactatgtcacctctaatttggttggtgataggtacattccatttcaaaaaataaaagtgaattgagcgtttctttcttacctacaataaacgcaggaccatattaagtgctataaagaataaaaaagaagataaaagccttaacatattggttacttcttttaattgctcattctgaagtgcaagcccctccccttgaatctggacatgctctgtgacagctttaaccaaaacaataagacacaagtgatgttatattagtttgggggcccaggcctaagaagctggcagctttcattccacttttttttagcactcactctccaagccctgaactgccatatggagacaccatatatacagagaagtacccagccaatcctcagttgttccagccatcccagcccaggcaccagagatgttagggaagaaattcagatactcctacctcagcttctgtatgactacaactgcaggaggagtcacaagcaacacccagctgagtccaacaaccccaaagctgtgagaaataaaatgtttaagccactaaaaaaatgaaaacacaaaatatgaacttaacccaaagttgagatatgaatatattaataagatagtgggtgttgaaggatatatgagaggaagctaaaggcttcatctccaggagaggtcaacagataatgtctcaaaaggctgaaccaagagagcaatacgtaaatattattgagaaatacagagcttaataccagagtgcacagctacgtaagttggaagtagttccttctgcagtgcatggaaagagttcaagggactgctgctttttgttacaagcctttgagcattgactctttaaatactgtgcatgtattactttgacaaagctaaagagtaaaacaataaccacacaaatgggataaaaataccagtggttttgagtggtcagtattaaatatggctgtgtctgtcaaagtctagacacagtccttagggtttagaaacacacaaccaattttagtttttccagcccagattccttgatcagatgccaacccgtctctcaccagatccctccagaaatatgcccacaccagagccccacccacctcttcctaaacaagctgtagggagcctgacttcttcctcagtaaccaccaaagtgggctgtgccagataatccattgcaggatactaagaaaatattactatttctattttacagcatcctttttctttttttaaaaaatgaatccttcactgaaattatattatcctttttggagtttctatttgttgtatgtacttttgtctatttttaaactttccactgatataatttcagacataaaaagtaaggaaaatagtaccaaagatttctatatgcccctcacccagattcccccaaatgttaacatcttctgtaaccatttagaattatcaaaacctggagattaacattaacacaataatattatataatctgagtcttattcatgtttctccagctgcccactaatatccttttctggccaagatcacacgttgtagctactcatcatgtgtctttcatctcctgtaagctggatcagctcttcaggctttgtctttataattttgacattttacaagactatcgactactttgtagaatgttcttcagttggagtttttcaggcatttcctagtgattaaattcagattaagcacttttggcaggaggaccacagatataatgttgtatccttcccaatacatcatgctagagggtgcagaatgtctagttttcccattactgaagatgttaactttgatcacttggttttatggtggtacctaccaggcttctccactgtaaagttacctttagtaattaataagtctctttgggggagatacattgaaactatgcaaatatcctgtttctcatcaggatgatgcgtaattttagcgttcatcagtgattcttgcctgaaaccagcactgttgtgcttgccaaggtggttttctatttccatcacactttcaacgtttgcaggggaagggggcagattggcattctgctgtaaaaaagaactctctcttcttccccatttatttgtttatttatatcaatatgaactcatagattctgattttgttctatgacttataattcattactagcattattttgttatttatgtccttttgtttgactgattgggaagcataataaaaaatttggaagagcatggctcttagggctgccagtgtttccctagacttttccctgggaagccatcctaatgcccttagttaaatttaaacaccctcctttctcacctattctgcatggtgcctccttctctactcagcacttatcttttcctgctttattgtagacaatagcttatgagtgaaggacagcttgggaactaatgacctgtttctccactgttctgtatctgtcctgtcaaattcctatgttgaaagagattcacgtgtgaaagtttcaaggcaatgaaggccaagtagggaaaagagacttcacattgctgtgtcacagaggagtgccttgtagtcacacacactgagcagccatctgtatgaagtaagtgacctcaggaagcagaatatggttcctgtgggttcccaaagaagttcaagagttaacatttcattccttcaatgtaacctgttatgttctgtcaaagcctcttgatctatcttgctggttacaagcaagtttgccaatttttttcttttttttccaacttttaagttcaggaatacatgtgtaggatgtacaggtttgttacataggtaaacatgtgccatggtggtttgctgcacagatcatcgcatgacccaggtattaaggccagcatcccttagctattcttcctgatactctccctcctcctaccctcaactcctcaacaggccccagtgtgtgtgccctgcagtgtgtccatgtgttctcatcattcggctcccacttataaataagaacacatggtatttggttttctgtttctgcattagtttgctagagataatggcctccagctccatccatgtccctgcaaagaacatgatctcattcctttttgtggctgtatagtattccatggtatgtgaggttgtgaagaaaaaggaatacttttacactattggtggaagtgtaaattagttcagccattgtggaagacagcatggcaatttctcaaagacacagaaggagaaataccattcaacccagcaatcccattactgggtatgtatccaaaggaatataaatcattctattataaagatacatgcacatgtatgttcactgcagcactattcacaaaagcaaagatgttgaatcaacctaaatacccaccagtgatagacttgataaagaaaatgtgatacatacacacaatggaatactaagtttgctgatttctaacttgctgaagtgttctctgtgaacaacagcagactagagccagactgcctgctatcaaatcccagctccatcacttactagctgggtaaccttgaacaatttacccacctttgttgtgcctcagtttcctcatgtgcgaaataagaataacagtaataaccctattctatcatattgctgtgaggaataaagtagttaacatgtaaagtgtttagaacattgctaggcaccttacaggtaccatatgtgttaactgtcatttttaataccccggaaggtaaaagacccttaatattaatgtaagggagcatctcaaaatgtctcatgaagataacacaaaagttcagaccataaagagttagggtgaactaggagtctggagtctgtgcctgatgaatgtgtagtccctgagaaggacaatacattacacattttctatcactgactccttcctactgccctttgcctcacaaccaggcaggtgtttcccctgaagcacaaggaaatgtgtttgtgtgtgtaagaggtgggtttgggaggcagggagtgagttgaaggagccacagagtaaatatgtgacatttttctccatgtcagttttgtaaaggcacaatatttgtaaagatttataaagaaaaatattattattgttttaaatcaatttctttcttatggtgatacggtttggctgtgtccccacccaaatctcatcttgaattgtagctcccataatccccacgtgtcttgggagagacctggtgggaggtgattgaatcacagggacaggtgtttctgtgctgttctcatgatggtgaataagtctcatgagatctgatggttttataaaaggcagtttccctgcacatgctcttttgcctgccaccatgtaagacgtgccttcgctcctcctttgccttccaccgtaagagtgaggcttctccagccatgtggaactgtgagtccattaaacctccttttctttataaattacccagtctcaagtatttcttcatagaagtatgaaaatagactaatacatatggtatagaacgtttgcatacatttttatgataaacccaaaactatctaatactacttgtttttgtagccactttagtgggtcatgtagtagaagcaatgtcttaccatgataaaccttgatgaatcattccttagcagaagattctaatggagaaaataagggaaaacagccaacattgtatggggaatggggaagagcctcagaaacagcaaggaaagtcccaaagaaagagattaagggccccagatacaaccaggcaatgtgtggaatagtgaaataggtacaaggaaataaaatggggcatcctagggaagacccatggagacaggacagcctcttctgtaatggcccttgcagtgacagttgcccagccactactgggtcagcctcacattttaacatatagagtgacagatgctctattttaaaatattaacattaatatttaaaatattaaactcctccttgctgggtaattcactgttgaaaaactaagaaaagcagtctattctaacataccaagttttaaacttaccttttggttagttaacagatatctgacaatataaataagtgccacagagctaaaatgcatttgagactgccagtgagctgagctgcatgagttaagtggaggttttaatatcactaacattaagaaagcatctccttccagacatgtgccatggcacaaccaggaaggaaggccagctctacactattaaaggagcaatgaagattgcttcctgttatagcatgaaactggatttaccagcagaaaatctcattagggtaaatatttttttactcttatcaatcctctgctaagattcttgctttattccttcatctacaagacagaattccttttaaaatagttaaaagcctgtcccaagaagctgatacacagacagctgtataaataaaaatctctagacaggataatagaataagaagttatgtgtcaagattccacatccgtctgtctgaccaataaggatgacatttacacaatttaaaagatcagaaatttaagacttgagtcagatatctgcaatgcaatgacagatgcttccaagtataaaaataactgttccactaatgaatatagaaatattagatgccatgtagaactggtggggtttggttaaatttattttttagcaactcaatgaacattaggaaaactattcttagtgagtatgttgcctaatacatcacattctgataggcccaaaggcttgtttcttcaaatgatatagatacatagggtcttcgaaaagtttgtggaaaaatgtgtattatgaaaaaactgtgcatggactgcatatttattttgtgccaaaataaactcacactaacttggtatagcatgtctaaacaagatctagtttgaggcactaagaaggataagatgtcagtttgaaaagagcccctgtcaaagcaacatgatttctgctaaaattgaagcaagtcaaacatcagatttatagtgaagcttgggtgaaagaatggtgaaattattgatgctttatgaaaagttcatggtgacagtgcccccaaagaaaccagcagtttaaaaacggataaatcattttaagaatggacaagacaatgttgaagatgatgcccacagcagcaaaccatccacatcaatttgcaagaagaaaaattcatcttgcttatgcctggatatggttcagctgcgtccccacccaaatctcatattgaattgtaactcccacaattcccacgtgttgtgggaggaacctggtgggaggtgacttaatatgaggcaggtctttcctgtgcggttctcatgatggtaaatgagtctcatgagagctaatggttttaaatacaggagtttccctgcacaacctctcttttctttgcctgttgccatccatgtaagacgtgacttgctcctccatgtcttcctccccagccatatggaactgttaaatccagtaaacctctttcttttgtaaattgcccagtctcagttatgtctttatcagcagcatgaagatggactaatacatgacctaattaaagaagaccaatgattaacagtggaaagaatatccaacaccgtagatatctcagttggttcagtttacacaattctgactgaaatattgaagttgagcaaagttttctttccatgggtaccaaaaccattgcacacaatgctgctgcagacaagagcagagctttcactggaaactttaaacaagtggaatcaagatgctgaagcatttctttgaagaattgtaacaggggataagcatggcttttccagtatgatcctgaagacaaagcaaaatcaaagcaatggctaccaagagatgcaagtggtccagtcaaagaaaaagcagactggtcaagagcaaaggtcatggcaacagctttttgggatgctcaaggcattttgcttgttgacattttggtggaccaaagaatgataatgtttgcttattatgagagtgtttttgagaaagttagttaaggctttagaggaaaaacatctgggaacgctttatcagagagtccttctccatcatgacaatgttcctgctcaaacaaaggcaattttgcaagagttttgatgggaaatcatgagggatccatcttgcagtcctgatttggctccttctgccttctttttttgtttcttaatcttaaaaataatcttcaaaggggacccatttttctttagttaataatgtgaaaagactattgatatagttaaatttctaggaccctcagttttttaggggtgaactaaatggctggtaccactgcttacaaaagtgccttgaacttgatggggcttaagttgagaaataaagtttatactttgtattgtcatcttttaatttcatctttccatgaaatttttgaggtcccttcatattgttaaccctctatgtgcatcaaatcacataatcaaaagagtttgcatgaaatacaaatgtggatgaagaaaaagggataaagatattttgcttcattctgtttgagcttgggggctagtgggtagggctggttttagagagaaatttaaaactggcttcatcaaattttcatcctcctgaacctgattttttcaaacataaagtgggaatgtaataataccacctcatacggctgtggcaaaacataaatgcagtaatggaaaaattcccagcccagagccaagcacaaggtaggcactcagtagagtccatgccctctctgtccctctgttgccatgtggcctaggaacccagctccctggtgtgacccacaagacccaatctaagcagagtagaaattgttgcttgtctacccagcagccaccctgctttctcaggtgcccaaattttcatatgggggtgactcttttccaagattgccagttgacccagaggaagactgcattactctctccttgccactccttggttgcaaggtaggctctgggttgtaagctaaatgatccttttgtttttcccctttggccagagtcattggtttatgtgacaggaacagcctagagtaaatctcagaagtctttcttggaatgatgaagcagagggcccagctgaattaggtgcaaggaagcacatgacctcacacgttactgacagccacaccagtgccacaagggaaaccagcctggggatagcagagtggagggttagacaaaagattggtcctcagtgatttgtgggaacaatcattcctgaagcaccatgtgactgcatttccagtgacatgagcagataaatcttttacaatttaagacttccaattgagttttcaataacttactccatttaaaaagaaaaaaaacctaattaatacatcaagaagttagagacatctttatttctcagtaagaaatactgcaacccaaagctcaagagaattgcaaaataaaaaaactaacaattcttaaagatattatctttagacatttttatatattatagttaaatgaagggtaacaacaacttatatctttccacatgttgctgattaggtttattaattgtttctgatatataaaaaagtctcgtttagctattctaagttagaataaattggatctatcaaataaacctacagagtaggttaatttccttatttatttctgtatacgttttgtagatcattcattctggtacattcactggaaaaatcaggttattgaaaatcagatgtttgtggaagtatcatcatcaatggcagtgatgagtaactggtaacacctgctttgaaaattttctaggtcaaaactatcttgaccacgttctatgatagaatttgaggggcttcactgactacatatcaatatactagcatagactgcagcagttgagtctcatacagggataagatagccttctaaccaggcaaatgtcctgaagtaggcctttccgtctctactagaggccgctgtcattgtcatctgctcctttgatttctaaaatataattaccctcaatacagaacaccagtatgacaaggggaaaacattaataatgcatgagattccatagtcagcttccattctcctcctcggggaactgctatttacctccatagaaacaaaaggaagggaaaatgagagtccaaaaagcctgcacaggcaagaagaaaccatttagaatattttttagaatattaagtaagtaggaataaaaagattttaaaagatgtgcaaggagtatatggtatatgaataaatttataaaactttactgaaagacattataggagattgaataaatgcagatatatcctaagtccatggacaggaagacttagtaccttttttttttttttttttttttttttgagaggagtctcgctctgttgcccaggctggaaatcgcaatgatgtggtcttggctcactgcaacctctgcctgcgaggttcaagggattctcgtgcctgagcctcctgaggatctgggattacaggcatgtgccaccatgcctggctaattactgtatttttagtagagacggggtttcaccatgttgcccaggctggtcttgaactcccggcctcaggtgatccacccccctcagcctcccaaagtgcagggattacaggcgtgagccactgcgcccggcctgacttagtaccttaaagatgctgtattagtccattttcatgctgctgataaagacatatccgagactgggaagaaaaagatgtttaatgggacttacagttccacatggctggggaggtctcagaatcatggtgggaggtgaatggcacttcttacatggtggcaggaagagaaaacgaggaagaagcaaaagcagaaacccctgataaacctaccatatcttgtgagacttattaactatcatgagaatagcacgggaaagaccagcccccatgattcaattacctccctctgggtccctcccgcaacatgtgggaattctgggagatacaattcaagtggagatttgggtggggacacagccaaaccatatcagatgccaattctgctaaatgtgccctattccaaccaaaatccttccaagcttttaaaataatttgataagctaattataaaatatataagaaagggtaatgggccaagaagagccaaatgactcctgaaaatgggtaaagtggaagggaaggacatgccctatcacagtaccagcactcattatgaaacctcagtaattaaggaaggtactggctatgggataaattgatgtaatataatattagtccctataatagagactccagaaacagacactagcatttataaaacattgatatttgacaaaagtactctagaacatcagtgggaaaagaagggactattcaataaatggacatggaaaaagtggcattctattttctataatatgaaaaaaaaatgaaaccagatccctaccttacaaccacacacacacacacacacacacacacacacacacacacacaaattcaagatgaatcagaaacttaggtgacaagaacaaaactttacaaattttagaaggacaaataattctttttcaaattttaacattttcatttgtgtcagggaaatatcccacatcagggtaagacccatgttcaaactataaaagttgcttttttacagactgagttagttcagtaacattgccaaaggaacccccaggatgctaagaggatcagtgtcctacaacctagtaatgataaaacttttagcttcacaaatgaagatataagtcaggtatctaggaaagttgcacagtcctgtaatttcagttcacttaggtttgtttgtttgtttaaatttgttcattgccttgctccagataaaatttaaactgatgggtttactttcattttgagtgtttttaaatgaattagaattcattgcactattcacaaatcctatagaatttgacatatgcaataatagcattgtactctatactcattgtggatgccacctcacttttatcaggatagaataacctctttaattactaccatttagcattaaccaaacacagcaaactgattacttggaatcaccaggttttagtagaaaacggtggggctatatttagattatgttgaaagaaaaggtgcaattttgtgaaccatattctacataattatttcttggagcatgtcagcaggcagtggtaagtctaggtgagaagctggaaaaactgggggtggtgataaaagaattacagggaaataatgaggatagagtagaaagctctcttattgctttgggcaagtcacttcgccattcttatctaaatgtaagatgaacaactgctgtcttgctaggattaaagagtacatgtctggtggagcaagaaataatattaagaggatatagcatcccatagcctccccttgtagggagagttgtacaaggagtgagcagagttcccaggacagcctgtgtctgtctgtttgggagaaatcacagcaaggtcaagctctcaattcagggaactgttcttacttgcaagttctacaaatgggaattttaggttctaaagttttattttcttagagatgaggtgaaagataaaggtggagggaaagatcacaggggcaatgccacaaagctcaaacaagaccaaataatctctcaacctccatttatttattctcttattattatttttagttgacacataaaaattgtacatatttatggagcacagtgtgatattttgctacctgtatacaatgtgttgtgatcaaatcaaagtcattaacatatccatcacctcaaacatttatcatttctttgtgttggaaacattcaaaatactctattctagctatttgaaaatatagaacaaacaattgttaactatagtctccctacaaagctacagaacactagaacttattcctcctatctggcagtaatattgtgtttattaaccaaactctccgtatcctcctttccctcccactcatcccagcctctagttaccactattcttttctctgcttctatgagatcaactgatttagcttccacatatgagtgagataaatatgagtatttatctttctgcacctggcttatttcacataatataatgtccaccaggcttatccatgttgccacaaatgacagtatttaattcttttttagggctgaataatattccattgagtatctataacacattttctttatcaattcatctgttgatgaacacttaggttgattccatatcttggctagtgtgaattgtgccgaaataaacatgagagtgcaggtatctcttcaacatatgatttcctttcctttggatatataatcagtagtgaaactgatggatcatatggtagttctaattctagttttttgagaaacttccatactattctgcataatagctgtactaatatacattcctaccaacagcatatgattttccttttctccacattcttgccagcatttttttttgtctttttgatggtagccagtctaatgggtaagatggtatcttatgccttgtttttgtttttttagagacaggggcttcctgttggcccgttgtatgtcttctttagaggaatatttattcagatcatttgcccatttttaaattggattacttgttttgtttttgttttttttgtttttttttttttgctgctgagttgtttgaattccttgtatattctgaaaattaattccttgttagatgaataattcacaaatattttctcccattctctaggttgtctctttacactgttgattagctcctttgctgtgcagaagcttttagtttaatataattccatttgtctgtttttgtttttgttgcttgtgcttttgaggtctttcccataaaatctttgtccagaccaatttcctgaagcatttcccctgttttcttctagtagtgtcatagcttcaggtcaggtcttacatttaggtctttaatccattttgggttgatttttgtacatgatgagaaataggaatatagtttcatttttctgcacatggatatccagttttcccagaactatttattgaagagaattccctttcccccagtgaatgttcctggaacctttgtcaaaaatctgttggctgtaaatatgtgaatttatttctagtctattccattgatctatgtgtctgtttttatgccagtatcacactattttagttactatatctttgtagtatattttcaggtcaagtagtatgatatctccagctttgttctttttgctcaagattgctttggctattctgggtcttttgtggttccatgtaaattttaggattgttttctctatttctgcaaagaatgtaattggaattttgatagggattacattgaatgtatagattgccttgggtagtatagtcgttttaacagtattaactcttccaatttgtgaacatgagatgtcttcctattttttgtgtgttctcttcaatttctttcatcagtttcataattttaattgtagagattttttaccttcttaaatttatttataggtgtattatgccatttttgcattgctataaagaaatacctgaggctaggtaatttataaagaaaagaggtttaattggctcatggagctgcaggttgtaccgaaagcatggtgctggcatctgcttctggtgagggcctcagggagcttataatcatggtggaaggctaagagggggagagggagtgtattacaaggctagagggagtaagagagagagaaaagggagatcccagactcttttaaacaaccagctctcatgtgaactgagtgagtgagaactcttatcaccaaggagatgatgccaaaccattcatgagggatccacttgatgatccaatcacttcccacctggacccacctccaacattgtgaatcacatttctacatgagatttggagaggacaaacatccaaaccatatcacttggtatttaattttttgtggctattgtaaatgatattgctttcatgatttatttttcagctagtttgttgttatcgtatagaaatggtactgattctcgtatgttgattttgtgtcctgcaaccttaatgaatttattgatcagttctaaaagggcttctctttttaactcatttattttttcaaggtgaaggctgggctaaagatgaccaaacatttttcaccatggtctcctgcataggtggtctagtgcttcactttggaactcaggggtacttaaaaacaacagttgctgttcagagcctttggacttgagctaaaagtgagactaaaagtgtcccatttcaataacctatttcacattttagaataaggttctgaaatcatatttgggcaatatcaaaggctcacttcaaactgtctagagtcagggaaaaccagtgtgtggcagagaggagaggttgaggaccatgtgctctttagggagggttctctcagggtagctacagggtggaggaaaatgcattgccttcagagacataaagctccattcttgggtcggagttttgaagaaggttcaatttctccagatagaagaggttttattgacttggctcagtgcatgaattcctttctagtctcttgaatctgttctgttctgattcagaatcagtttggccagtgccctgatccagaaagcatattccctataaactgccctgtgaagaccactctttctttaagctttgacagatcagatgcagacaccagccctttttttgcctctcttttcaaagagtcatcagattttagtttttcttcgaaaaaaaacaaaaagaaagctcatatttcccaagtcatttatactcatcatgaactatagccatctgtgtattaaatgcaaagggatggatggatataaccacacaaggcatcacatgttcacaaacacacaatgaggtgaattaagtaaatgctctgttagttttctctccccaaaccatcttctccatcaatgcattatgcaaagaacctctcacgatgacagatcacagaacttcaaagctagatggggtctatagactatctgctgagacctggcccaagtgattttatctttctgagtctcaggttcttcctcaacaaaatgggattcaaatattcccacctaaacagttactgtcaagattaagtatatgcttaattaatatcaatctgctcatttgcattgaagaaactgagatctcagcaaggacaagagatgtcaaaggttagtgactgtgatgggaccaaaaaaaaacaatgtctcctgcatcctaatacatgctctgtaaggcaaatggaaccaggctgtcctcagacattcagcaaacctttaagatatgtgactcatgatccatactaaggatgacatcatttcatttatgattataagtttccagtcctctgaagaatgatagtcctctatctccaggcatcaagctgagaggattctctgcagctcagaatatgaaggactgatcaagattcaagatgattcctctaagcttcaaagcagtacagttataaaccaccaccaccacaagcttctgaagttaaataaataaacaacttaaggtagataaatcacaaacagctgacctgaagtaaaaattgtgcctaggtctaggcctattttttattagtgttaacagcaactcctctgatgaaaccaaattcttgcattataccagtgttgtagcctccatcttgatccttgcctcttaaaaaaaaaaatctgatatcagctgggttgaaccataggatactgtcaatattaaactattatggggctctaaaaatagcaattttatttggttaaatatataatatgttagtgtctaaagtggtgcctttgcttgttagataatcattcttcttttttacataaaagtataacatatttactggaaatgtgaaaaattaagaacaaaattgcatgtaattccactaaataatacaattattttgcatgttttttctcagtattttgcaagcatatttaaaatatttataattgttaataatattcaagcttttaattatgcctaaaaacttcactcctaacctgtttcctcatctagaataagaaggaactgcactggattacctctaaggcttcttttgcttttatcttttttatcttttgcttttatctctgtggccagattaatttgagtacattttatctgatcaaaacattaatttctaataagcatatttttatctttacccctatggcttattgttcatgcagtacaactatttgcttacaactttcaaagttctagggaacattttgcaggaaaaaaagtttaatgtgagctaccacttttggcatgtgatccaatttagaaaattaaaatattgatcaaccaaaattgttttcactcagaacaaatagttgtattaatttctttgacataaaatgcatattttttaaaacattgatggcctacattactgaaacaactgtccccaaaatgttagaatctgggcctatttgagaagaaacctgggccattttcagtttgtgttactgtttcaaattcacaagttattctacacccattatcccacgtcaagctttgaaagaatttcacaacatccatatcatttctcactttacagaaggaaattgagtactcagggaaacaaagtggacctgcagcatttatagggagccacctgtgtgctagggatacagggagtatgtacgagagctgcctgtggcgggtgagcgctggggaggcatcattaggttaaagaataatgattatttcaacctggaaaggagcgcagagggaggacttaacaaagtctttcaatagtttagtcagtttttctaaaagtttgtgattgagagctaatgaaactaatacaaaggccctggctcactgaaggaggctaggacctggacctcagcatttttgccaaatttcccaggcgattctgattcatggtggtggagtggggcggaggggaaagagggagaggaagagagagagagagtagatatcatactagctatctgtttgcttatgtactaaggcaaataactaaagattatagcatgaagcacttgggttagataaaaaagcaaaagaggaaatataggaagacgtttgtatccattgaaatggcttacttgggaatagtataaagcagtgtgtgtcagcattacttgaaaggctgcttaaaacacatatgcagactttgtaatttactaagtctggggtgaggccctgggatttgcatttgtaacaagtttccaggtgctgctgctgctgctgctgctgctgctgctggtccaggagctacaccctgagaccattggtgtagacaagcacgttggttctaaatcctggctgcacactagaatcatcatctgggatgagtttttaaattattatcgatgctggggcctcacccccaagagattctaatataatagaatttcagtggagcctgggcctggatagtttgtaaagcccccactccaggtgtttctaatatgtagtcggagttgagaaccactgggattaaggcttctggaaaactagggaaggagcccagaccaggagagtcacattcagtactgggttatcaggtttaatcacatttgtctgagtctcctttcccagaggcaggtgatgcagtgcactaaactatctttctaacatcctttcctcactcagaattgttattctgcctaggaggcttttaaaaggcatctccatgttatgcacttaacagtatctagaagacagttgatttttcctttcagcaatgctgccctctagtgttcttaattattcaaatcatgtaaaaacccaccttggccatcagtatggttgtttcctattagtaagctaaacgaatttttctctgaaatagaattaaattttaattcatggcaacatgaatctccaaaactgcagcctcttggttctcctgcaatttctccctgcttttgatgttgcagcctccttccaggacaagaactcacagagttcccttttcccaattccaccaagcttttctcttcagagtcaaaactaaacaatgaggaaaaaactaccagcaacaaaaagacctgaggcattggagtgcctcgcagaggctctcctcacctttttctcatttctgctacacatctcatgcctccttttacacttggttcacagtttattgagactagaattcatcaaacaggtgctgccatgtcttcccatgatggttctacaaacctccctgggtcccatcatcttgacaaaagtgtccttcttacctctaggggctctgtccctcctccctctccctttatcaagtctctctccctcttccttcccagccccgaggccatttcatcaataactccctcttcctaggtcactccaaatggcacacaggcttactcttaatgtcccgtgaccctgaatatcccttcagctcctgtcctatttctcttccaaacttattgaatgcattgtgtttaaggcctctccttcttccactcattcttccattgagtggcttccaatggctccaaccttgcttgatcccatcacatcactgacactgaagctgcttttctcatggtctgcagtggtctccctacatatggccaaatccagtggacactgtttggggctgttctgacacaaatgtccatggcgttccaccctgtgggcatggctccctcttgaagtgccctctgctcttggtctgacacatccctgtgtgccggcttccctcctgcccctttggctgccggctacccagcatcctgcatgggtcctctctctaacccctgggctggccatcagaaactcttctcttttctgtctatagactttccttacaaggctcatccattttcatgaatttaaatataatcaatagactggtaactaataaatgtatatacacctctggcccagattgctcactgtcgtatttatccaactattaaatatccacttgacatctcccctttattttttattttttattttttttgagacggagtcttgctctgtcccccatgctggagtgcagtggcgtgatctcggcttactgcgagctccacctcccaggttcatgccattctcttgcctcagcctcccgagtagctgggactacaggcacccgccaccacgcccggctaattttctgtatttttagtagagacggggtttcaccgtgttagccaggatggtctcgatctcctgacctcgtgatccacccgcctcggcctcccaaagtgctgggattacaggtgtgagccaccgtgccccgcccgtcatctcccttttagtatctcacatgcatctccatttttcacatgtccaaagaagaaccctcgatttttctcccaaacctgttcttccttcagtctcccttatctctgtaaacagccagatatctgggaaacagctttaattcctccctttccctgaccacactcagtccatctgtaagtattgtggattctgccttcaacatctattttgaatccatccaccactctctctgtttgccatcatcaccctattacaaatcaccctcatctcctgcctagaatacaacaataccttcctcaagctctttctacttcctccagtcctccctgttactaatgattctccacagcacagagactgttctgaaatgcaaactatattctaccatccccttacctgataaaatgttaatgccttgattaaaccttgaataacatacaaatgacatggtttgccctctgccaacttcatctcatacccctgtcctccttccctcccattgctgggactcactaagctctgtccttcctcagggcctaggcgcatactacatcatctgcctcgaatgctcttccactgttcttcacaaggatggttccttttttcttttttatgcctaaacatgattgctcttcagtgagaccttccttactgcactaaatatgtcttctctttcatttcctgtcccagtcccctgtgttattttctttataacactttacattttataatgacttacttgtttacccctccatctctcactcaacttgaaactccctgagtccaggaaatttgtgtctgttttactcacagaagaatccagcaaccagcacagtgactggcaaacattaagcttttaatacttgtgtgttgtataattaaatgcatgtgcaggaagagtcacaacttccactccatcttcactgcttttgtcaaggactcccacgtgcccaagccacctgtcagcattctgtgcctgtcttacttgatggcagagacagagttaagggagaggccaggtccagtttattctctgttaacctcttctgtgtttatcagcatgtttgattcaccacagtatctccagcacccagaacagcagacacctagtagatactgttgattggctgaactcccagctctgaatgacacaggatgtgaagggaaagggagctggtgcagtgatggagacatctaaagacagaatctatctggggcagagattcatatcattgttttcaacttctggaactgtttatcataggcacgcatctccatttgtataatgaaagagaagaaaagcggttccttacacttttttaatcatatgttttataaatggagaatgaacttcatagttttagttgctaggcaataatttgatattctagagtctttctccaagaaaaagaaaactattttgcttataagccagcttttacctctgttggacacacaatggtgaatgaaagcatttccatcttccaaaaaagaaatcaagggcaattaaaaatagtttacagaaggacgggagcagtggctcacgcctgtaatcccagtactttgggaggccgaggtgggaggatcacgaggtcaggagatcgagaccatcctggctaacacggtgaaaccctgtctctaccaaaaatacaaaaagttagccgggtgtggtggcgggcacctgtagtcccagctactcgggaggctgaggcaggagaatggcatgaacccgggaggcggagcctgcagggagccgagatcttgccactgcactccagcctgggccaaagggcaagactccatctcaaaaaaaaaacaacaacaacaaaaaagtttacaccagccaaacaagcaaagaagctaagaccctgactctggccatttcattccaaatcctgttccgtatcaatctagacagtgcctgctcatgagaaataataataataataaaaaaatacatctactgcaactctactttgagacaaggatttggttcttctgaagggcatttaactgactggtattactgagaaataaaaaatcccaaggcctgtgaccctttgaaactgtcgagtgacctggcatcctgttaaacactgacctgctttgtagaagaaatccaaccctgtctgtgaattttaactaagttaaacttgagggtctccatgctctcttgttctgcagcacatctggctggtgccaagaggatttgctcagctccatcctctggggaagggattcattttcctgtttaggaaatgtgatgtcgagctccatgaggctgatgagcacgctgggtgggaccacaaacaggccccagtgaaatcaattatgtgggtgtcttaggacaaaatttggttcaaagtgatcaaggacagggtgtgtcattgcaagctgtgagccacggtgacttcggctgtttgttcagcatttaatatgtttatctttctgctaaacacattgttgttgagtcacctctcttagagacccattctgtgtgaggtccagctctgcaagtccaatatacaaagacaagcctttcaccttcaatgaccttacattctacaaagttgaaacaaatgccttctcttacttctcactttagtcgggaaggtactcaggctcttaaaaaggtaaatcatgtattctttattaggccaggaatcatcaagcaataaaagtaaaggaagaacttaaaatggtcattatattttcaatatcatttagtgttgttgctgcaaatggaaaatggaatgtcagtttgcccaaaggtaccatcagccttcaaaccatcaatatttcctgtcagactataatgttgtcaccaatattaggctaattttattaatcaaacaaacaattgcattaagcttctaagctttggctagaggagtaaaaatcgcataactttgaaaagtagacaaattcatgaaatgctgtctgtttgaccttccacagaaattgtccgagccatgacacatgtgataaaccaaggcatggcgatgtactggggcacctcgagatggagtgctatggagatcatggtaatttaacttctatttttaaatggctattgagtaccttattattgcttttcagatgccatgcataaattgcaagatcttttgcaaacttttctcacaatcactatggcactggaattctagaatcaattccatcattacagagatggatattggagccggagctcatccgttcagaatacaacagagaatacagtgttctttggtggcaagagggtaaagtgaatttcacagctaatgagatatattaacagagtattctagttttcttataaaaaactgtattaactatactgtttataccaagctaattacagatacttttatatgttagtctaagtcttatttctttaggaacttaaaaatagttaaactacattttctttatcgtagtgtacaattcacaccttgactaatttgctctggacttaactcaatccaaaccctcccaaagaattaataagggtttcctacctttcatattgctcttagtgaaatcggtggtgacaaatttgcttattatttggcatcctacatgtttcttggtttgtactgatttcaccaaagtaaacatttctcatgcatacaaattacagcgaagccttatttctcatcagtataaatttggttgtaatctcattcctccctaggaagcctattctgtagcaagacagttcaatatgatcccaccggtctgtgaacaagctgagtaccatcttttccagagagagaaagtggaggtccagctgccagagctctaccacaaaataggtaatcttcaaaataaaagctactgagtatttttaacaagagaaagatcactgattcggggaaaaaataaaaacagtgttattgaaatgctttcctaaatgtccctaattaacatagacattgtaagaaccatgcattccagagattgtagcagaatcaaaatgtagcagaatctgcatttagtctacagggtatcactgatgaaagccaagcagagttgtaaattgtgactggtatttcagctgtactcagcaggtgttcaaaaaaaaaatgcatactgaataaaaggaacaaccaatgaataagttcatttttcattggtgcttgctcgagtaaacaatgactacctttcaaaaaaaatcatggatatatacatctgtatccactaccctggccctggcactgagttagaaatgggaaattcaacaactattaagtcgggtactatacatttgtgcagatagaactaatgccttcagagacaggggaaatatatctatatataatatacccaagaaatttagacattaggaaaagatgaacaagccacattttcaggcttatttatcaaaagtttccagaaataactttcttcctaagaaacagaagttcatatgagcaggaaaattctgggaaaaggagaaaaagataaaacttcaataacaaccgtaataattgttattattgctctcacttattgagtgtttactatgtaccaggtgtgtgctcctgctgtgtaccaggcactatgttaggtactaaatggacaaggacaacaaaacttcgtggatgagccacatttttcaggctttctgatatgcactcccaagaactgacagtccatgtttaattggctgattaaagaatgaaacacaatttgtaagctcctaaattgtaatggaaaaaaatgcatgctgatattaactcatttatctggccagcttttccctataacctaccaaattctgtttaaacactactgcccccaccgccacccaccttttgatcccaatttgcacaagcaactttctaagttttttcttctgtaggtgttggcgcaatgacatggtctccacttgcctgtggaatcatctcaggaaaatacggaaacggggtgcctgaaagttccagggcttcactgaaggtatttttctcaatgtctagaaaaaagcctgggagtaggaaggagggaagaaggttggtaagaacagctctgcagcagcctagggcttcccagctcaggctgactgtgttgtccaggccagtggcctctggcaggttcccctaagccttctggaggtcttggctcctggccaggtatcagtcagtccttcataatctgactgcgttgaatattctcttcttctggggactaggaaaaaagtgcccagtgacctgattggacttgcagggctcaaattcctacattgttttttattcttatattaaagaaaacattccatcatttgaaactgataaaatgcaaaatctcttttctatataagaggattcttacattatttccttttcttgacaaacaaagtgtaagccataaaggcttaatccatatgaggccaaaagttgtagctgagtatggttgacactttttattgtgtgttgggggcagtgggttagaagggaagacttcaggagacagatacatagcaaagcttctatcacttaaagcagcttaaattctgctctgaagcaaaaagatattcaagatcattgacacaaaattacctccattcaggacatcttgatgactaatttattggagagtactcaaaaatctctccttattaataacaacatgcctgtttttaaaaacttgagagaatgtgtaataacattagaatcacaaattactctctattgtcaagggagagagaatacaggcatttaaaaaatcagataaaccggagtccttctaagaggaagtataagcctgacacaacttcttgcctccatcagcactaaattattgggaaaacagctcaagtcaagtctgaaccaccaatcctttaatcattgtggctgtggccactgtgagcttccctaatcagaacattttcaaggctctaggcctttgactttcctttctctgtgtaacagttgagcttttgcttgtttgttctctaaaataatacaacatgaatacgtcctaaagcctgatgacatggtcctatttctagttttgtattattacaaaaaacaattttcctagaatattaaataaggtcttgcttctgaaaattaaagattgttctgaaacaagtctaaacaagtcagcaaagacagactaaaagcatcttaggaaagaaggtataaaaagaggaaggcaagaagggagtgaagaaggaaggaaaggaagaagggaagcactgagaattacaattttactaagtacctactatgtgccaagcactgagctaagtgttttcattcatcaacttttattctcacaaacagaatggatacaggtgacttttagtcagttgagctaagcatgttgtcatatgttctttcagaggcttgctgaaaaattcaaagcatttctatatatgcagagtgtttgttctcacaataacctgctgagaggcagaccattttcagatgcaggaactaaaacacgaagaccttaaataacaatccaagaccataaactcgtaacagaaaaggctgatattagaacccaggtctcctggctctcaagttaattgcctccctcaaagacatctttatttctctttaaacccaggtttttaaaggaggaagaagtagctatgatgtatttggagtgcatgattgtctaacctccatcactgtttgagaaaagcttgcaaacagctgaaaaatctttcacaaattcactagtgaaaggaaaaagaaaaaaagaaagagtaatgaatgtttgaaggtggctaagcccaaaagcagcttgggaaatatttctattggtgacttttataaagtcaactctgtatctactggaacatccttaacaataaacattaagagctctcaacagatgaaaggtggctgatcacaaagtatgcttctttagagctctgcagactctcaaggctctacattatcaatctgagtgttttcggagtaatatatgtgcacttatgaaagccacttgagtatcgttaccagagcaaaaaaataaaaagtaaaggaggcaagtatcagagcaacctttggagtgaatgaggatgccatgaaagagaaagagaaagaaaagaaaagaaaagaaagaaggaaggaaggaaggttaattaaattaaaagatagatatctgggcaagtagataaataaattggtaacgttcatcccaccctaaaagagaataagtaaatagtttgtgtttcacattggctattgttatactgataagattaagatgttaatattttgcatctgttgtagtactgaactgcaattgaaggataaattaactcagcataaaaaatacctatctagggctcttttagaaagtaacactctttttctggattttctgggccccctcctctggccccactactctaacaatgatttctaaatttgtgttatcagctctgacttcactgctgaactgcacagcactccttctttgtgtctattagacatctccaagtagaagtcccatgggcatcagtcatgcctaatggaatctatcctcacccccagaacctgccattccttcttgcttaacagtgcctccacccatccatctggttgtctcagtcagaagccaaagcattacctcagactgcctcctttccttccttattcctgttcaacaaggcaccaaatcctccagactctatcttgactctaagatccatcttgtgcacagcccttgtttggatcttcaccatttcttacaagatttactgtagtagcctcccatctggactctgatttcctccccttttctcaacaacccaccattgtgactacttaatctttttaaaatattaatctgaccatatcataaccctgcttaaaatcctctaatgatttcccaatcattgcttataggacaaagccataactttgtcataaagcattcaaggaaattcccttgggatctaagttgagcctattttttttcatttgtgtctcccatatcatactacttcattttccatgcaaatgcactgtactctcctttgcctcccagaaatgtccttcttttcattctcctgtggaatcccttcttattgctaaagacaaagcttggttgtcttcctctctatgaagactgtcataactttacaaaactgagctatttgtaccttctctattattccacgaacacttcttacagggtcttctaattctctggttgcgagtaacaaaatctgatcagagaatggggactctattggttcacaaagacaatccttgagaagtacggagtggcctcagcaatgactgcatccatggacttgtacattgtcatgactttccatcttctctatttctctctacatgtgggtgtcattttcttctactataaatgaggccaggagcaggaaaactggtggttgcaggcttgcatttctaaaggcatgtaacctaagataaaagcaatcttttctttaccaacttcagtccagagatgactggacaagcttaggtcatgtgccaccctgtgagaccaatgacagtggccaaaagggtaaggtactgtgatcagctcaggttgtgcaccatcttgtcatggcattttccattagaaggcagtaaagacatagcttgtaaggaaatcattgacaggagtggaaccccaacaaaaaaacacttcccatgttactaggtaatgatttgtgaatacatctaggacacaaactgaaacctgctcatctgactcatcacagagcctgatgagtacgtaagaggtacataagtctttgttaaattaatttgatgagccataacaaaatcaataaagtctgatcaagagaccaggtgtatagcttctaaatagaaataaatagtgcaataaaatttattggcagctcctccctgttgatggcaaaatgctttctagaaaaattataggccaggtgtggtggctcatatctgtaatcctagcactttgggaggtggaggtgggcagatcgcttgagcccaggagtttgagaccagcctgggcaaaatgacgaaaccccatctctacaaaaatacaaaaaattagccaggtatcatgctcacctgtagtcccaaatactcaggaggctgaggtgggaggatcacctgagcctgggaggtcaaggctgcagtgagctgaggtcatgccacttccctccagcctgagcaatacaatgagaccctgtctcgaaaaaatattacaaaattatgtacccctctgtcaaagaaaaataagaagcatgcacacctcgatgaatcaaagttgggagagaggggtggtccaagtacatcaagtgttcatattaagaaactaagcatattgtacattatggtaaaatttcagaaggcaagttttcggctctagcattttacctagagatctcaacctcattagtgactttgtttttgttttgagtcaaagactttgaagtttaagtaaaatagtcaacgatcttggttgttaaattattctagacagtgttcagaactgaaatgtgactgattctgtccatggctccagtttcagcctgagttcaatccaagattaactaacaactaattagggatctggggcaagtctcacagactattcttaccccaatatcaatacctatgaaatagggacatataaaatcatcatagcattgggagagggcaaagaaataggctttaggaaaatttagagttttgtaacatacataaaactaatagccaactaatctgtagagcaaagctcattcaattgtccctttgacaaatatttaatgagtatacccagactttgtgctgggtgctgaggacacagggatgaatgggacagtctcaaccctcaaggagtagctccgggacttgtaatagggacagacatatgaaggggtgaattatgaaataatatggaagccacaagccctgtggagtcccacaggactgctggcagagtcacactgcattggggaggaggtgtcatgatcaatctgaaaaacgggaagagatttattttgactccacggaactctggtttctctgcctcctccctgaccaccatattggttgagcccctcctccttgccagccataagtgtcagaactggagatgctgacatgaacaacaagccatccctggcttctatctgctaggtttagaaaaaccaacatgtaatcaaatcattgcagtgcagtggggtgatagaatagggttggatgaggagatttcaccttttgattcatagattactgtccagtcagcaagcagggtttattactgccacaaccacacccacctccaaccttcctacaaaacacacttgtttgcttccatatttaattaacattttaattaagcctcatctcctatctctgctaacattttctcatttgtaaagcagttaaagctgtttatttccaacacacttttgtttcctttggtatgaggaaagcagtataaaaactatgcatctactttttaaaaaccctaatctgcttgtatttccataggttaaagcaacaatgagatttatggtgttgaacatggattgggactcaataaataattgcttttttctttttaattttttttttacttttggaagtctgtctctgaaaatggtgtgtatgtgtgtgtcacacacatacacatatacacacacacataaatagaacttgtaacccaatcctaagaaagagaatgcactgcatacaagatttcaaaaacggaaaagttacaaaagattgattgataaaccaaccactctttacatgcatggtatatactgaaactcagaaattctaatactaataagaagcaattgttcaaaaagcagttggctattagttttcaatctttgttagtcggtttgaataacattcagagatattggtcctctgaaagatgttatgaaactttagtgaggattggtgatgtttttcccactgaggacaccaaaagtaagttcagggactctctgacatagacagcactctggcccaggaagtctgccccggccccaaggcagtgtccattgttcacaatgcccacctcatcaccactggcaccaaatgtcatctctggagagatgctccaggccactcttctttttgaagaagctgaggcttctcagagctaaggctgggaaaactttagccatctcctcaagcaggctaccaggttaggagccagcccataagcctttgagatttaggagacaaaactggggcggcttgcccttctccttttctcatcggcaaaataactcaaaaaaatcacaataaaacataatgtggttacccttttctttggaaatattgtcttagaataatgaaaaaatgctcaaaaaacaaaagccagcagcctattgaaatcatgtgggtgcagtgtccatggcccactgcctgttgcagagcattctgcggtctctgggaagataaagatctgcgatggctattatgtattatgtcacaattacacgcaagagagaaagtccacattaccacacagtgtgatgatttttaattgttttccctaaaacagactaacactcttacaaatactcttttcccctgggtgttgctgcttaagtgctcgctttatgtagaagagtctattgttccctttctcatagtaagagcagagccttctggaaactaaggcattgagaagttctaaaagatttttatctttatatttaggaaattaggttcattttgtagtctatagatcagggtcagtttcttctcattggctttaaagaatagtttcctgttttgagtttctttacttttttaagtttcaatagttatacaataggtaataacatttgcaaagtctttatctactttaaaattttaaaaaccaactcagtacctatcagttatgccatgtctgcttctaggaagaagctgcagaagctaacaacaaagccccattataaaaagaataagagattagcagtgaattgaaagcacgggggagaaaaatagttaaacaaaaatgtaaaatagtggttttctttgagcagaaagcttggcacccagctttcttaataaaaaggagacataatagatcttggtaagttgtaaatgtacttttttttttgctacattctaaagttgggctatcccaataaaaaacgttacttcttctattggacaggctaggatttaagtgcttgtatgtcacggtcagggttataacaacttctgtgcaggctgatcaatttgaatggtgaatattagtcaaaatcaatctgttttgaaccaataaacaaggagcaagatcgtgaggaacatttctttgcatgaaatcatccctgtcagtgtgaaacataagggtcaaaaaattcagaaaatcattatgaggttcacatattttattgaattaccattctttgacatcagatctttaccagacattaacatttcaatgttatgcttttccccagtgctaccagtggttgaaagaaagaattgtaagtgaagaagggagaaaacagcaaaacaagctaaaagacctttccccaattgcggagcgtctgggatgcacactacctcagctagctgttggtaagaaaattactaagctatggggtggtagagggacttctgctgagatcatagttttctattgctgaccacacccttaccatgataaaatgtctattgcagggacagatgatctctgaagcataaactcctgctaaatataaagtgagttatttgaggttccccagaattttctacatgatagcaaatttttcttacttctttctccttgctcttataacatagtttaaatgagaacatgtcagtgataacatacactatcacagatgtcaggggtgaactgtgtagtgacatccatttcttctggctcaaatttctgtctgttgaaaactaaaccagggttggtgagaagatgagatacagggctgtgacaggcccaaggctactgccacatgaaaagctgatcctagagaaatagcttcaccctgaaagttcttgaaggccataaacgttgttcttctaatgctgtggagtccatgaaaggtcatgattgctggtaacaattgaaaaccacacgcggctgggcacggtggctcatgcctgtaatcccagcactttgggaggccaaggtgggcggatcatgaggtcaggagatcgagaccatcctggctaacacagtgaaaccccgtctctactaaaaacaccaaaaattagccgggcgtggtggtgggtgcctgtagtcccagctacttgggaggctgaggcaggagaatggcgtgaacccgagtggcggagcttgcagtaagcccagattgcgtcactgcactccagcctgcgtgacagagcaagactccatctcaaaaaaaaaaaaaaaaaaaaaaaaaaaaaagaaaaccccaaaccacatccactgtttgagagaaagataatatgaaccacattcaatcatgggtgtctcagtcaacgacggacaacatatatgtaggtgatcccataagattataatggagctgaaaaattgctattgcctagtgatgttgtggttatcctaaggtccgagtgcaatgaattacttgtgtgtttgtggtgatgctggtataataaacaagcctactgcactgccagtaatataaaagtctagcacacacaatcatgtacagtacataatacttgataatgataataaatgaccatgttactggtttatgtatttactatactatacttttcatctttactttagagtgttactccttcttactaggaaaaaaaaaaagttaactgtaaaacagccttatgcaggcccttcaggaggtattccccaaagaggaattattatcacaggagatgacagctccatgtgttttactgcccctgaagacttcccagaggaacaagatgtggaggtggaacatagtgatggtcctgaccctgtgtaggccaaggctaatgagtgtgtctgtgtcttagtttttaacaaaaaaaaaaaagtttaaaaagctaaaaaaacactttttaaaaatagaaaaaaagcttataacaatataaagaaaatacttttgtacagctgtacaatgtgtttgtgttttaagctatgttattacaaataagttcaaaggtttttttgtttgtttgttttttgttttgagacgcagtctcgctctgtcgcccaggctggagtgcagtggcgcgatctcggctcactgcaacctccgtctcccaggttcaagcgattctcctgcctcagcctcctgagtagctgggattacaggtgtgcaccaccaagcctggctaatttttgtatttttagtagcgaaggggtttcaccatgttggtcaggctggtctctaactcctgacctcgtgatccgcctgccttggccgcctaaagtgctgggattacaggcatgagccactgtgcccaaccaaaagcttttttaaattaaaagtttataaagtaaaaatgttacagttagctaatgttaatttattattgaagaaagaaaaatcttaaaaataaatttagtgtagcctaagtgcacagtgtttacaaagtctatggtagtgtacaagaatgtcccaggccttcacattcactcaccactcactcactgactcacccaaagcacctcccagtcctgcaagctccagtcatggtaagtgccctacacaggtataccattttataccatatttttaccataccttttctatgtttagatacacaacaccatgtgttacagccgcctatagtattcagtacagtaacatgctgtacagatttggaacctaggagcaataggctatcccatatagcctagatgtgcagtaggctataccaactaggtttgcataagtaccctatgatgttcacacaatgaggaaaacgcctaacaatgcatttctcagaacgtgtccctgtcgctatgggatgcataactgtatcttattttaaattttctagtgaccacattaaaacattaaagtgaaacatgtgaaattaattttaataatggattttctttaacccaatatagccaaaatattatcattccaacatgtaataaatattaaaaattgagatattttactttgttttctacaaatcttcaaaatccagcatatattttacacctagagcaagcacattccaattcaggctagacacacgttgcatgctcaatagccacgtgctgccaaaggctacacactgggcagaaaagccctgagacttctggttcccttactaggggatatttgtcaggttctatagtaagcacctcaggctcactctcactgtcttgtctccttcatcaccataacaatccgcggaggtctatactattactagtcatatcttaccgatgctagtggaggattttctattactatctccacttataaatgaagaaatgagataaaagaattcatgtggtagctatgagaaaggaataaaatgggtgctgattctagacaaaaaaaaaaaaatcctaaagattaagaaatagcaggaattgggacatatcagaaacactaacccaatgagataaaaagctcaagataaggtctatgcaaataaaataatttaatagaatatttgttggtagcttgactcttcagaggttggaaggcagagaaatgttagttgcaattagcagtcatagaaagatagaaatgggaggtgattttagaggggggaaaatgccatgtaccgtagtatatgtatgactggtgctttaatcctttcttcaaaaaataaaataaaatcaaacaatgtatttaatgttattacttagcaactctacagctttaacaagcacagtaaaacatattagctatttgaccacaggcaagttacttaacctggtaacaattttctcatctgtaaaatgggtataataatacatatcttacaaactagttgagtaaagggaaattatatatataaagcaaaaagtaggtgctcagtgagtgctaataaagatgataatgttcttgcagagagtagacatgcaaaacttgaaattctgtctgctcttagccatggcaagcaatcagagtaatatgcagagaaacatattctgcacaatcatatatggtttttagatagtaacatgaagtattaaacttagccctgaaagacaggaaagaacactctctttctacagaggaaatctttacaagatttagactcttactagatattagatatacatgaaatgccttctttacaggatctgagtttaaattaaaacatgctttttttccccttttcctcctgtcctctcagatgtctttctcacctgtcacttctttctttgtaaataaataattttgtttatagccacaaaactctcagaatcaaaagggaaattatttccaggcacgttatctttgatctgctaggagagtgtgggagagggatcctccggcagaaagcaaactacttgaacccaactgtgtgcctgctccccaagtcacacaggtatactggagccagcattcatactttgttcttagtgaacaggcactctggacatacttgctagtgacacttggttagaggtgctaattatccagaatcagctgcagttgctaccatggaagtaaccagctctgcccagtgggttctcctgtgccctacaggcccattaggggaatcagctgttggtgacctcgagtagtcaggtagtttatgggcaataatttacctagaacctgctttgtcctcagaactacctttaaggccaaaaatagttctcagtgcaaagcagcaaataatgcagtcaaaaaaaaaaaaaagagagagaaagattggattggtacttttatacagcactattttgtattttgcccatgtggaaattcagtgattaccataaaaggcctggacacggtaacagcttaagagtatcagttgacaatatggctgtccaaatgggggcagaagatgtgcttggggacatccatcaatcatccatgcctatgtttattcaacaaacatttaataagttcctactttgtgcaagacactgggctggtggctgagcatccaactgcaaataaggcatacctcacagcctggtgggcaagtcaagaaaataaacagataattttaatacaggtcatcatattaagaagggaacaggggataagggaattagagtaggagcttggaattcagggaagtactttaggagcaggcaatacctttggggaatctcaaatgacaggcaaatattagtgaggcaaaaagaaaggggaaggcaaaaggacattccaggcaaaaggaacagcttgagcaatgtgccccagaatgaagggagaggaagaggagaaaagcagcaagatgcttggagatggagaggatttaaagacaggtgagtgctcctgaagcacaaagttcaaggtagggagccatgaagctgcagaggtaggctagaaaataaggtttgccaaggtaagaattaagaacctcatcttacaggacaatgagttatgtcaggcactagctagggaagtgatatgatcagatttgtgtttagagagactgctgctggctggatgagagctgtatgggggaaatataaggggacaattcaagcaagaggtaggaaaaccagttatccaggagagagatggtgagggcctgagtgagggcagcagtgactgaggaggagaagacagctgaaccggagaagacagctgaaccaaagcagtcattgtcaaactgagccctgtatccacacaatggaatactctttagcaacaaaaagaaatggtatacgggtacatagtgcaacacggaaaaacctagaaaacatatgctaagtgaaaaccagacacaaacgaccacctattgtatgattccatttagatgaaatgtccagaaaagacaaatctggagacaaaaagtagatcagtggctgcctggtacttgaggtagggatcttattagggtgatggaaatgttataaaactgcattaaaaatggtgaaggttgcaccttaaaaatgatggttggtaaatttataaaaattatttaatgtacacctaaaatgggtaaaatttttgatgtataaattttacctcaataaagttggttaaaaaaaaaaaaagagcatggtcccagatagcagcatcagcataagcattacctaggagtgtgttaaaaatgcacagactgcaccccagacctgaatcagaaactcagcgggtgagccataacaatgggtgtttcacaggccctctggatgattctgatgcataccaaagtttgaaaaccacttgattagaggaatatttaggaggaataatcaactggacttagcagttaaaagggaaaagggggtcagaacaggacagttcttaaagagtactcccaggtttccagattggggagccacattgctggtgatgcccccaaatgtgattgggaatgcaagaaggccaggcattatagcaagaagtttgcggtgctggtggggcatctagcaggaaggcccagcagacactgcatctatgagtccagcaacactgagttccaggcagctaaggactcagaagtccactgtaatcaccagcaggctcctggggaccttagcttctggacacagcaagaaggtgactgggatgtgaagaagatcagtaagggaatctggactgaccttttagaagtttaagaggggaagaaggttggggcagtatctaagcaggtaaaaagggtcagaggaagcctattctagaatgggagaaattttagcatgttttgttgacagaaagacacagtaagaaattttgaaatggggtgatgggggcggtgggatcatgtatgaatcaagtccaagaaaaggcaaaaaggagatatctccaaggcagagtttggtcttggacagaaaccgcacacatcctcttctgaaactggaggatatggatgtggatgcttatgcagcaggagagtggggaattaaggaatattccaatggagggacttgattttctatagacattaggacaaggtcatctactaagagtgagggggcaggggttgatgggatggtttaagagtacaggtttaaggtcattttcgggaaaagaaagatgaccaagggcaagagtgaggctggccaggctggctaaagccagctgggagggaagacgtgaacgcataggggcaccagaccatgaactgtgagattctctctagcacgctcagctaccctgaagtagaagccaaaaacgcagatgcagcactgatggggatttgctaaggaagcagaagaagtgaggggtgtgagggttcataagagagtaatttagatcatcaacacaggatgaatcttgggttaggaagaaagggaggtccagagagggctgccaggtaggtgggaaccaaggaaccagaaacctagagtctacaagagttccaagcaacagatgtggaaaatgagaccatgaatacagtggaaagacaggaggttgtgggccaaggtagaaacaggaatccagccatctgctggtgagcagtgttaggtgtttccaggaacaatgtgtttctagggtgggtagcttgaatgccctggttgaggtgacagggccttatgtggaaagcaaaaaggccttaagccccgagccaacccaaatgcattgagtgttaattaagagacatatagtaggctagcaattggaaaaccagcggagaagcaagaaagacagcagtgcatctgtgttttctgcttctacttgagggcagctgagcgtgctggagagaatcttacaatccattgtccagcgcctctatgcatttgcatttcccctcccagctgggctttgacagattctgtcaaatcttctacacaacagggggtgctgctcaggtttttaatcctaggaagcactgtacatcctccacaaaaagaagttaataaattttggctgcaacaaacagctgtagcaggtgtttataagctaatcaacgattggaagtgctttgataaactgacccagtgtcctctcctcccagcgtggtgcctgagaaatgaaggtgtgagttctgtgctcctgggatcatccactcctgaacaactcattgaaaaccttggtgccattcaggcaagtactgcagccccttccaacatcagggaatttaatggtgcctttgaggctatctccaggcagtgtcccatctctccccctctctgtcctgggtggggcaagagtagggggaacaaaggcaacagaacactttcccagtacatggatccagggttgtcctctgcctatgaacaggcagtattcccaaagctcatttcttgggatggtttgtttctgtggaagagtgcattgcagtgttatacgtggcaactgacttcccaggcctcgccataaaagccggcctgataacttgcttggaaatttaagtcataggacaatatacatacatcatttacttgtttgttctttccacaaatattgcccacctgctgtgtgctgagccccttcttgctgttccctgaacatcttgtattccccctcccatgatcttttatgataatgtagtataactgcctgtctctcctgttggactgcaagccctctgaggtcagacctgtgtctttgcttttccacggttttccagttcctagggtacttactacatgtcccttagttaacactcaagatctattgaataaatatttgccatgttttaagagaaatgggctcaaaattctattttggacttccaggatcacatctccctagaagcaaatttaggaggcccatccccattccctatcccatgagatggccactggtccagggcactagatggggcctgcagccatattctggggagcctgtagtggcagtgggtgggttgaaaggatgttcctgggagctctaactagaggggtggagtttagtatctattgtgaccacctcctttccccaaaggccacaactagtcctgagcctatcctactctcaaccctgctaaaagccctaggaacgatcctgcccacaattcctgccatagccactacctggtaaggttatctatttttctcttgctcatggaggaaaagaactgtctcacagcttcttccctatctacctgtccctgcaacaagcacacagccctgttaccattcccaaaaggaaacaggtggaggtagcaacaaacatgatttaaaatcttttttaaaaatagcccagaatacactgtggaataaatggtatagatccctgcccattcccccaacctttcttaggactgtgcagccgtgtaatcacctctgcctctctgcttctaacaactcccatatccagccccataactcctactggattctgtgaggttccctgtagctacgtgaggaattctccctcttatgttcatttatgctctgggaaaagataagggtacacagtgatgaggggacagaacagtttgtacaaaaaagaactgaaattcaatccaatgatttcagtttcactaatatttatggagcacttattctatgcctggcatcgtgctaggcagtgggaggactgagatgagtaagaacaggacctggccttcaaagagctcatgtgctggctgagaaacagtgaattaaaatatctatcccttaattcattcaacagatctttgagagcctattgtataccaggtactggagataacacaggaaagaagaaaaacactgtctaaccttcaagggatgttttacgtgccagtaggagagacagataaatagcaaaatgatttcaggttatgaaaagggctattaagtaaataaatgtttattttactgagactgagaaatgggtgagcctacattaaatgtttttgcaaaaagcccctctggaatatgtttattccgagggcttcatgtgccttcattttttacattctttgacaaccattcacaagtcttcacacagcatgtgaagagtccaggaaagtgcattccagggacagggaagagcagtggaaaggccctgagatgggaaagaccttgacttttcccaggaactgccagctaaggccaatgtggtcaacacgtagttgagcacagggacagcagatgcactgacgtggagagacaggcagggccaggtctcgcaggacaccatggggttagagttcatgctacatgtaacaagtccttgtggagggttttaagaggagggacatgctcctatttgaatgtctgaaggtcactctggctgccatgcataaagtagaatgaagggcaagggcagtcatccaggcaggaggcgatggtggcttgaatgagggtagtggccatggagggggagagaaatggatggattctgcaggtttgggaaagagagacaccatggcttggcagaagagggaggaattgaggatttttatcatgctaatacagggagatcactgccattcctgggggcagtcatagtgcctagggatggcatatgaggcaagtctagggctgagttttaaaagctgtggaaataggcaaggcagctgacagggaaggggacacatttcagaggaaaactcttgagtaatttttcttcccaaaacatttcctccctagcaaggctttggctggcagcaggatgaggctttgcctatcctaaaggggacattatccatgcagcaagactgctaccattgcgggcttaccaatcctcccctgttctacttcacctcccccatacccagcactaaagtccacccaagacgagttgtgattgggccccacaacatggtgaaaagcagactgggtgactaggggtgcccagcagtggtggcactggctgcaaaaggatggaaaatacggagcaccagcagttgtaagaaaatatttctagtaggctgggaaggcagctgcttcaagggatgccacgtgcctaagatgtgcaggaacgaaggggcgtatataaatcagagcctgacagatgggagagacaggaggagaaaccacagctgcaggcagcccaccttcacctgcacaggttccatcctccccactcccacctaaaaggtgggagaaccgcctctccccctcctccccacatgccttaaaacccttctgaggcttcccatcacccatcagagaaggccaggctccacagcagtcgggcctcatcactccccaccacaccttcctggaatctgaatcttgagccgctctcaaccactcagagcttcggcgataacagtggccctctgcctacaaactgaccactatcccagcctagcaaaatcctactccatccccaagttccagatcaataggaacccaatcctgggaggactttactaatgcccagccagccccagcaacattagccagacctcccccaacccaccacctatcccaggcagtgtaacatcaagtttgcaaaactagtagcctgtggggtgtttgtaaaatctgtagtagtttacaatgtttcaaagtggggcttctcttgaaaattctggtcttgtgatactatgtcttgttttattcgagtacttttatggtttcatttttttaatgtttaaatctctttcctatagagatttgctttggtgtaatgaatgaaggattcttctcctcacgtggctaacccgctgtattttagacaaaaaaaaaaatccaacaaatccagtttctaggtttttggtctcattgttacaatctcattttaaataacacattagctgtttggacactgaaattccagagctagtgggaaaccaaattcttccttcagcttcagacagtaaaacattaaccagaatgaagtttcccaggctggcagctctattttgccaaaccctaaggcttctgaggatagcacttgactggagacaaggtcaccttggccagcaggattgcaacaaaggaagaatgaggttgaaacctcagaattggtcgtcagaattgtatttcaccacagtctccacacagggtcagacttttccagtgagaaagtctgcctttgtcccttgtcttatggtgtaatgtgtacccttggcccacttctcacagtaaatgctagccttggatgagctcatcctttcccggggcttcagtcagcatgtcggtgcaaatgactcacaaaccctcaactccagtcctccggcagctactaagctccacagctgcacttgcagctgctcagtcactcctaggtggatattccacaggcactttacactcaacacatcctattctctcccaacttcttattccccaaactacttctcctttggtttctaatctcaataatcaataccaatatacttctagttactcagtcttgaaaccaccatcttcccccaaaatgtctctcaggtccacttttctgctccactgccctagttaaggccctattgcctggcttggattgtaatacatatctaatatctgtgtcccctttccacctcctccagctcatccttcaaactacctccaggtgtctgatagggttactcctagatcagaagtcctgacaggttccccactgcctaaagtggggactccataaaatggcattcaaggctttccacactcttatcccattcttaccatccgtatcctgttcttagcatccccacacctacaccaatcactgtatactatcactccagttcacttttccatgctattccatctacctgggatgcctgttaaaccccagccatccttcaccagggataagaccaccagtcagaataaatctctccttagtctctagacctgtgctgtgtactactatggttctagccacatgtggctattgtatgcgggaaagatggtgagtccaaacagagatgtgctttaagtgtaacatgttcacaagatgtgacttagtaccaaaaacaactgtcaagtatcttttctatattgattacatgttgaaataatgttttggatataatgaagtaaaaacatgtattaatttcactgttctttttaaggtatctaatagaaaattttaaattacaaatgtggcttgcattatatttctgttggatagagctgctctgtatttctatgagccttcacttatgcctttatgccttcatttatgcagtcaatcaacaaggcccctgacctcaaggagcttacaatgtgatggtgttgggggcggggggcttagatttcagctgtggtttatgaagatatatgattctagattactttgctaaatatagagcacaaaaaaccgaatgatcaacactgctaacaatatcctttgtacttctcctcctgctctcaggttctcccaaagatgacatcacatgtggtaaatgagattgataacatactgcgcaacaagccctacagcaagaaggactatagatcataaggcaatgcatgaaccacagaagctgcatggttaaaatagcggcctgtgcccagtacagaaaggtgttactaaccagtcttttgaatcacttagcagcttgctgctcaacctctagtgtccctccctggattctttgaggtgtctgctgtcgctaccactgtgcacatctgaaaactcacaaccaagaaaatccattctattttcttatcttggactggagtcacctattcttgcattgctgtatacacctcatgcttatgcaatgggaagaatatgggggccagggggtgtggtactaccttcaggcatttggtaactcaaagaaggctgtacagatatattttttcaaaagaacaaaatccacagatgcaatgtgagttgcgtaagaaacagagtagatagactaaattcagtgaaggaaaggaattgagagatttttcttagtaaatagattattgttaagtaaatagttattaaaaatatatctcactgcaaaaaaaaaaaagcagtatcttcactcaaaagtcttgcttggaagaataagcagaaataattttatatattttttttctattttcacattcatactaacaagttttgttccatttgttattcaataaaacaaaaatttctaggtatttgctttattacctttcaaatatttactgttgcttggccccaagaatggccttgtacaacttatccagaatgtctattaggattctaatgttatgtccacttacaagtagagacagtaaaaggatgaatacccaatctttagtgacaatgcagctgatttatgaaagagagggctacactgctatggaaacttagcttcaaagaaaatgcaatgtatctgcaattaggtgttcattttttactacattttattaaaacctgctttatactttcaactgcttgtaggcacaacttctgcaagtttaaatatttgagctttacaaataaacatacacatgctcagttttttaagtaaacctgtaaaatacccaggaaggcaaatgttcattgtttaattagcactgggattttataatataatgtttggtatttttgaggcattgttaacatgaaagtcaaccactggctttgtgaaaaatgctatgtcactattcagaatatgctgggtaaattgacttgcctagtgaaaagcaaaatgttaaagaaagaacttctggttctataatcatattatatgcactaaactatatgcatgaaagttctttgcatggattaatggggcttacccttgttgcactcgaaatctgaggtgtatctagccctgccactattggctacttaccctcattaatatcccacttgagaaaaattgtgagactatactgtgtcaatatctgtaaaaagagagaaaacatgttttgtttttttttgaagggggtggtgtgggagtggccctttaactctatttggctatctgaggatgtacaaaattctcatttaattttctggtcagcaagttccccacacagaaatcactctgaggtttacagaagaactgtaatattattttaaaatgcgatttttctgtcattagttctagatatgtacttcatggttaaattctaaatctgaaaatgctagtgggagatatcaagaaattttctttttgattactagtacctgtattctaacagagagtttgaattttttgcccgtgttatcagaatgatggaaattgatcattttcagttgttcattgtgtattcaatccagcgaactgctgtatgtatagaggagctgaggtgctgtctaatgggaaatgtgatttgattgatttatttgcttagagtaataaaagcattttgtgcattcaatcttacaatagattttatctgatctttcactgtaaggcttatgtgtattttccatatatgtaaaacatacacatgtaaaatatatgtggccataaattaggcaataatcatctaaataaaaattatattggcagctaagctgcactgaatactc

SEQ ID NO: 37369 - DNA, 68857 bp, Homo sapiens
ggggctgaggcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctctgtaagtgatgccaggaccagggctggggccggggagtggggcccccgggcccgacacacgcccatcgcggcggtcgcaggccaggcgcgcgcactgagagccgaggtggggagggggcgcggcctgcgctctctggggccgaggggacccagcccatggggaacgcgggcctccgcgactggccgggaaggcgcagagcctctttcttctctttcctggatcctggagtgcggaggaggaggggagagtgctttaccttgctccttcccggggggcggtccaggggagcggacccggcgggcggctgcggtgagccctcgcggcgcaccctgccctctcctcgtggtgactctggatcgtctaggccctcccggattctgactcaggaactagggttctggcgttcttcacctttgggaggtggcggaaagttgcaggtttttcatttgtagggcctttgttgatttgtttcctgttaagccagggttttgttgtaagttccctttcccatgctctcattcagttttaagtctccgtaataaaagagtctcatttccgtggtctgcaaaacgccaataaaaaaatattgttacttctaggttagaatgcaaagagcttggaataccagtgagatggcctggcttaaaagaatttggtcaaatccatcataattccagacgtagccaccataatttgacaagacatagagcattaaaaagcataattttcctaaaggaaaaaaaaagctcctttttcttaccaaatattgtgactcaagcttaaggtaaacctcgggctcaatttatgggaattggatgacttgttttatggacatctgaagtggtatctgccacaggacttttctgtgttgttgttcaaagcaaagtacttgttgctgtctccgaatttagttaaataatagttataaagagggccagctgctaagaaaccacgtagatttttttcattccctttgttttcaaaatgtcagttatgatttagcatcacagtatctgaataccagagtttactcagtaatttctttcttcatggaaaagttcttaatataatccttggatcagggaaactaggtgaagttctgttggatcaccaactgttccacttaaacagtgattccaggggctgtaaagcataaatgtaaaagtctccctaccctccaggggttgacagatgatgacacactttgtgtaagacacaatccattctgtattttgtcttagaaaaaaaggttaaaagtgtgtttgttggtggtggtatttgtgtttaatcaaacaagtagaaaatagcctaaaattaaggtttatcagaaatatgcttcagacagaattgttatgcatgagaggtcagacattgctatggaggacaaagcagttagggtgatcttaattaaaatcagggtattaaacgtagaaggagtgcaaaactacatagtagtgaaaagatcactagagtaatagccccatacaacttggacgtaactcttcagtaatgaagatgaatgttgatatgtaaaaatcagcagctgatgttattggttcaacttagaaaattattgaatctaaaattcttgccaaatcacctcttttctggtcatggatactgcacataagagtttatcttttacaggatagcttctaaagttttatcaagacagttactcagcaaacattcactgagcaccttttaagtgcttaacacttaaaaggtgggaggttaggtctcactgtgttgcccaggctgctctggaactgaaactcctgggctccagtgattcctctgccttttcctcgcaagcagctggggctacaggtgtgtgccactgtgtagggtcagaagcacattggtaaagatgtactgtgggagcttgaaggagggtcattatctcagactgtagttcaggctactggaggaagggagtttaaactgggtaggcatgggggaggggcagaagtacatacagagttatgaatgaacctgttggtagttcagtatagtgggaggttggagtgtatataaggggaatggtgggagttgaggcaggagagcctgccaagggcaccagcttacaaagggccttgtctgccacacttaatccaatgaggatttctctgtctattgagatgtgaaggatgggttagagtggggtgaggctgaagccagagaaggcagaggactattgtaataatcccggggaggatgatgaagatctgaattcaagcattgggctatgaagagaggacacatgttgatgcgccacttagaaagtacgtttgatagagcttggaaacattgatgcaggcttgaaagaggaggtggataaaatgatcataggttttgggcttgggaagctgggcatatttttggccttttcacagatggggaaataggagtcttgggggaagaagatgatggagatacttttgaatatgttgagtttgagatgcgggtaagacatccaaatggagatgggcagaaaacaattggatagacagttctggaggtgaggagaaagttctggttggaaatggagatttagagagttatgtggctaatagttaaagcttggattgtttggatgagggcatccagggaaaatgcactgaagaacatagcagagagccaaagacggagttttggggtatatgaaacctgacaaagagtctctgtgagtaagagaaaaaccaggtgagtttggtatttcagcattgtcagatgaagagagataaaatgtgataagaattcactgaatttggtaattgaaatgagcacatagtatatgaggactaaatctcagtaatttgtaccatccatgtcagtaaatggaacctccatacatctaattgtgcaggccagaaacctagggtccatccctgattcttccctgtccttcacatccaatcagttctcccatctttaaaatgcatctggaattgatgttttttctacctccactcctagccttttagtcaaagtcaccaccatttcttgcctatattactgtgatagcctcccagctgctcttcctctttttccccctctggagtcttgctctgtctcgcccaggctggaatgcagtggcacaatctcggcttactgcaacctccatctcccagattcaagtgattcttcttgtgcctcagcatcccaagtagctgggactacaggcatgcaccaccatgcctggctaatttttgatttttctatttatttttaaatttattttatttatttattttttgggggatggagtctcgcactgttgcccaggctggagtgcagtagcgtgatctcggctcaccacaacctccacctccctggttcaagcgattctcctgccttagcctcccgagtagctgggactacaggcgcatgccaccatgcccagctaatttttgtattttttagtagaaactgggtttcactatgttggccaggctggtctcgaactcctgacctggtgatccacccgccttggcctcccaaagtgctgggattacaggcgtgagccaccacatctggctgatttttttatttttagtagagacagggtttcaccatgtttgccaggtctggaactcctgacctcaagtgaccggcctgcctcagcctcccaaagtgctgggattacaggcatgagccaccacgcccagtactcatcttggttcgttttaatccattcttcacaaaactgcaagaatgattttgttaaaatgcaaatcagatcatgttgccttcttttttaaaatccttaatggcttcccattgcacttggaatgaaatctaaacttcccatggcctgaaaagctctttgtgatctggtttctgcttacctctatgacctcaacttgtaccacccaccacccctttctcactatattcaagccacactgccatctttctgctctgtgacactcattcccacctcctagcctttgaactagctgttctgatgttgcccagggctggctcctttccatcacagaggctctaagtttcacatctttagagaggcctctctgaccaccttattctagggtacttacctgttactatttgctggtttgccgtttacttccttattgtaatttctatatggtttttcttctcttttttttcctccatcagaatctgggacagacaaatcatctgtcttgtttatagaagtattcctagtgcttaacacagtggatatggtagatgctaaaaatatttgttaaatggcagtgaggcataggcatgtcttgacaacagtttgttaggagtttgcaatatgtagttatgatttagcatggtatagtaggtcctcaatatgtgtttatgcaagaagaatatttttccaaagtgtgatttcatgcactgcttatttctcattatcagttcccttggccttttacttatttactagtcaggatagtaaaatagaaacttagtcttataaaatatgtatattttttactccaactccaggatatccactaggcttagatgctgccaaaagaaaaagataaatgttaagtgaaagacagctatgtgcaaaagaacataaaatgcaagtttgtgttttcattaagtctaatttatttacttattcaacgtaaatgaacacctactgggcacaaggcactgtttatgtatgggatgcagcagggagcctagatgctagtgagaagtgacagacaggaaacatctactcaaataaataataccaaaggacagattaaattcccaacaatcacaacttttaagaaaatatgattgatctaatatgaaaatttgcagcaaatttttgaaaaatggaacatcttatttgtattataaaatatttttaaaacttataagggatatgttatagggtttctttaaagattggtctttcccactgagttttaaaaacatgatttaattgggaaaaacatagcttttcagaaatattgctgtttcccctctatccagtagatgctggtctacctactaaatatttctcaccatccactttgcatccacactggagctaatatagtacagccacagtcatgtctctactggatgattagagccttctaactggagcctgactgtttttgagttatatcttttatctgagaatttgaattatttgtgtaagacatacatctcatgtgtacctcaaccttggaaagatttttaatcttgctctctaagaccacagatgtcattttaaaagggagagtaaaatggtaagctttggcatataatttattatagattagtctttagccccatcgaagacggtataattattagaagaactagaagcatctcctgaggtctcaagtgtcatatggctctgagacttgacccctaaggctggtgatattaagccttcatgtatcttgaatgatattccttttttccttttccactcttactttgctaagtcgtttgacattagcagtgccctagagtccagacaaaagtctttggaatttttgctgccgtaagaaagcagaggtcagttggctccgttcaccatagtgcataaattgagaaattgtggttgtctcctgggatctttatatctttgcctttaaacccctttgtttattcattatcttttttctttcttttccttttttttttttttgagacagagtctcgttttgtcgcccaggctggaatgcagtggtgcaacctcggctcacagcaacctctgtctcccaggttcagtgattctcctgcctcagcctcccaagtaactgggattacaggcataagccaccacgcccaactaattttttttttttttttttttctgaggcagagtttcactcctgttgcccaggctggagtgcagtcgcgccatctcggctcattgcagcctcttcctcccacgttcaagcgattcttctgcctcagcctgccgagtagctgggattacaggtgcctgccaccacgcctggctaatttttttgtatttttagtagtgatggaattttgccatgtcgggcaggctggtctccaactcctgacctcaggtgatccacccaaagtgctgggattacaggcgtgagccaccgtgccctgcccaaattttttttcttttttttctttctttctttctttttttttttttttttgtatttttagtagagatggggtttcaccatattggccaggctggtctcgaactcctgacctcaggtgatccacccgcctcggcctcccaaaatgctaggattataggcatgagccaccgtgcccaacctattcattgtctttttcaatgcatgtggctactgtaattttttattcacttaacaattttttcttgatcccattaggcctttatccaagatgatttcattgataaatcctccttcagtaggtttcttcttctaaactcagagtctctagaaactgtgataccttatgatacctctgatcttattgttagaacatagagcttgagtaattttgtagcaacagtgatacactgaatccagtacttaggtttaattgattggagttagaaatgcagtatgtctttgcctatcctgtgtattgcagataagattgccccatagaatgaaatctatgacttaagttttgttaggagcatgctgcaaccaactgaacagaccttgatgaacttgcaatgaacattttttcatactgggaccctgatattctactttaggatctggggagtttattacgtgcattttaaaagatgctgttatcggccgggcatggtgactcatgcctgtaatcccagcactttgagaggctgaggcgggtggattgcctgagctaaggagtacaagaccagcctggacaacatgataaaacccccatctttactgaaaataaaaaaaaaattagctgggggtggtggcgcacacctataatcccagccacttgggaggctgaggcatgagaatcgcttgagcctgggaggcagaggttgcagtgagctgagatcgtgtcatcgcactccagcctgggtgatagagtgagacaccctgtctcaaaagaaaaaaaaaaaaagatgctgttattaaaattaagaaatgtgttcttttctctccaaacattaagtttacaatgtggagttatatacatttaacataatcatgtgcttcttccagataacacttggtaaacttgaaaagatgaaaagttataaggtgttatattgtcagcttagcttcaatgagaacctagtgaccctgtggccagacagtgtctaatagttattctctagtcaagtccaggttatcattgctatatactttcttccaaagggtgttgctgagaattaggaagcatagatagaggactcaggttcctaagagaaatgtggtaaaatgcaaatatttgaaatctcctagatgtctgaaaagagaagagaaagagagtgagtgagcagttagggagatgttttaacttctccctctcccttttctgtttcttagcccttagaagttagggcatagaactaggttcatgttatatcttctgctctgctctcatttattgagtgcttactatgtgccacgcctttgctaaacgatttacttatatactcctcacagctctgtgcaataattatttttattaattttatagataagaagagtaagtttcagagagattgtgtaacttaagggtcttaagatcacacagctaatacatggtagagttgagactcaatttccaaagcacatgtttgcaaccaccctgctgtattatagaattttttcttcaaagtctctaaacattttggggaagattctggaatgtcttaagtgtttacagagtggctttttagctgtcctggggcatccagatttcttctttggggtgatgtttgtgccaagatccctcatgccttgatgctgctgactctgttaaagaggaataaagctgccgtgttgaagccatcctcaccaatcatgcagaatctgtttgtgccacccaatactctaaatgctcctcagggatttttaatgatgttcttttttttttctttttctttctttcttttcttttttgaggcagagtctcttgatatggcccaggctggagtgcagtggcacgatctccactcagcgcagtctccacctccctggttcaagtgattctcccacctcagccttcctaatagctgggattacaggtgcctgccaccacacctggctaatttttgtgtttttagtagagacagggtttcaccatgttggccaggctggtcttgaactcctgacttcaggtgatccgcctgccacagcctcccaaagagttgggattacaggtatgagccaccatgtcagctgatgtggttcttgtaggttcttctcactcatacctctcccgctatcaagagcacaagcatgaatccattatactgagtgataccatactgggctcagaatggttccttgcccctcattacacattacatgtggaagaagccactaagccttgactttcttcctttgagatgagttcttctctggaggctgtgcaggtccttttgccattagactcctggcatgcttgccttacagaatgtccaaacaggcccaggcatccaaaccaaagtctcctcccttgtacctcttcttggctcctctgccccattgacagaggttctgtagccatgttgtctgccacaagttggaggtctagcacttgtctgttaactcttgggaactttgagtcttgatcattttcagctattaggaatttaattctttttttttcttcagtgactgcaaatttagaagaactgcagtgaggcttgctgaaccttgcacactaatgaaattggtgaatggattaataatgaacagaggtgatgctaatttgtaatcaggttgaataatatggatttaagaccagaaaatgggccgggtgccgtggctcgcgcctgtaatcccagcactttgggaggctgaggtggacggatcatttgaggtcaggagtttgaagccagcctggccaacatgatgaaaccccatctctactaataatggaaaaaattagttggatatggtggcacacacctgttatcccagctattcgggaaggctgaggcacgagaatcgcttgaacctgggggacagaggttgcagtaagccgagattgtgctactgcacttttacctgggcgacagagtaaaactgtgtcttttttttttttttttttttgagacggagtcttgctctgtcgcccaggctggagtgcagtggcgcgatctcggctcactgcaagctttgcttcccaggttcatgccattctcctgcctcagcctccaaagtagctgggactacaggcagccgccaccacacccggctaattttttgtattttttcagtagagacggtgtttcaccatgttagccaggatggtctcgatttcctgacctcgtgattccctcgccttggcctcccaaactgctgggattacaggcgtgagccaccgcacccagcctaaaactgtgtctcaaaaaaaaaaaagggggatcagaaaatgctaaggaggcaggaggatcacttgaggccaggagttcaagactggctggggcaaaatagcaagaccccatctctacaaagtaaaaataaaccaaaaaacaagttataggtccacagtttttttatctgtaactgcaaagccacaaatactttgaaaattaagttttttcctaagtttgatacaaattctttggctgcaaaattcaacctgaagtagtaagatactgtttacaactgtgatcctatttggtatgactaattgtatttttcaccgcagagatattaatgtgtttgattgtgggatgctgccctgtactctctagggactactacataatatatagtataggtattgtattaattttttaaaatctgaaaaattctatattctgaaatacacctggccttaagacttttcgattagcttgttggcttgtacaatatcttatctcagaaatttccttctactcttgtaagtactaagaactacaaaatattgcctgggcaacatggcaaaactgcatctttgggaagattgcttaggagtggaggctgaagtaagccatgtttatgccactgcactccagcctggacaacagagggagaccctgtcccaaaaacaaaaacaaacaaaaaaaatacaaaatacagtttagttatttattttttcatttttagaaatgtggtctcactatgatgatcaggctggagtgcagtggctggcaattcacaagtatggtcaaagttccctgtagcctcaaacttttgggctcaggtgatcctcctgtctcagtctccaagtacctgggactacaggtgtgtgccaccaaaccccagctctttttagttctttttttgagatgagtctagctctgttgcccaggttagagtgcaatggtgcgacctcagctcatcacaacctctgcttcctgggttcaagcaattctcttgccacagcctcctgagtagctgggattacaggcatgcactgccatacctggctaatttttgtagagatggggtttcgccatgttgaccaggctggtctcgagctcctgacctcaggtgacccgcctgccttggcctcccaaagtcattttagttctttaaatgttttggtccacaaagctagtgtgctttccacttaagagctttcattgaaactcctttagaaatttatgctactttggactcagcctgtcttttattcaaggaattctaaatctgtgaactggcacacgtttgggaattgattgaagggtcctgactttctgtttttatgattcacattagactttttgttcacttgacctagaacttttctgtttatatagatcaagtaagaatttagtaggtttcctatctatttcacttgtaggaataccgtgaccagctgatcaatgccatagatctgtgagagtcagacttccagctgtgccttgactctgctgtccatcatggtaatcatgcctaccttgcttttagcagttcagtgctgccatttggcccctgtcatcccatgatccaattattcccactgcatttacgtgtcccaatttagtgacagcagttcccactgtaagttctaggctatagataagagtgtcacaaagttcttttaaaatgctgggactcccctcacagatctacttttcacagtcatgtggtgaaaggtgtgtcctctggctgggcctggtggtttatgcctgtaatcccagcactttgggaagctgagatgggtggattgcttgaggtcaggagttcaagaccaggctggtcaacatggcaaaaccccatctctactaaaaatacaaaaattagctgggcgtgatgatgcgtgcctgtaatcccagctactcaggaggctgaggcacaagaatcgcttgaatccaggaggtgaggttgcagtgagctgagattgtgccactgcactccaccctgggtgacagagtgagactctgtcaaaaaaaaaaaaaattagccaggcttagtggcgtgagcctgtagtcctaggtacctgaaaggctgaggcaggaagattgtttgagcccaagagttcaaggctgcagtgagctatgattgagccactgcactctagcctgcaacagagcaagaccctgtttaaaaaaaaaaaaagatatgtcctctggacactcacaggtgagtaagtagatcttaaaagataaatgcactgtaggccgggtgcggtggctcacgcctgtaatcccagcactttgggaggccaaggcggacggatcatgaggtcaggagatcaagaccatcctggcttacatggtgaaaccccgtctctactaaaaatacaaaaaattagccaggcatggtggtgggcacctgtagtcccagctactcgggaggctgaggcaggagaatggcgtgaacccaggaggcagagcttgcaacgagccaagattgcgccactgcactccagcctgggtgacagagcgagactccatctcaaaaaaaaaaaaagataaacccactgtaacactccagtctccctaggcctttgaatgccttcctccatagtaagccgaggcaggcctggcatttcaagttcatttactgagggccacattttggtccatgtttcagccagcaaaccaaactgttagagccctttctaacaccctgagttgcgtaacattaaatgcagaatctctgattagtgggcccatatcagtaaatttggcctaacccaacttgacgttccctccaccatgatcccatacccttaatatccattcccacacatattccccagatttctgtttatataaattagaaaaatcaaatagtttttttagagtatgtgcaccttcatggttcacattttgtacctcacctttaggagcctcctgagacttaagtctagttatagatctagaagcaaagagaggcgttgggggtaggtcctgaggagaatcagcagtgtcttgcaatgcagctgcctcaggggaggccattaaagtttcctcaggcacagcaggtttaattgcctcagatgtgggtggatggctgcttccactggcaaaaaagactcataagaatttagggattcaatgtttccagctccataagggagttcccacatttctccattccaatattcaggatccctttccttcccaatcaatgccctcactttagtagcagacaccctgcagacgttgggaattcagtttgtgctgtagttgagtcatttgcagaataagattctggatttgattttcagcaatttcagctctatggctaacagagataaggatatctttcagacataaagttttctgttcagatatgtagtgctcaagctgggaatttgaatccctgagctcatccatttcttttctcactttgtccattgtcattaggagtaaccaacaaatctcattatactcattagtttgacaaaaatgtttaaaggtatagtatatgtggtcacccagaaccttattcttatacgtgtttgattaaaagtacccaatggtgacattttgcatatctccattgccacatcatacccatacttttactactggaaatagtcattagtgtcctttaatccagttagagagccaagtcctgaaaccctagaatcaattcagagaactcatccttaagattctgctcctttagagccactcttaaaaccaaaattagggttctccagagaaacagaaccagcaagatgtgcatgtgtgtgtgtgtgcactctctttttctttatataaatatagatagataacctatctatatcttgctggcatagatagatagataggaattcgctcatatgattgtggaggcttggtaagtccaaaatctgcagggtaggctggcaggctggagacctagggaaaagttgcaattcaagtccaaaggcggtctgctggcagaattccttctttttcagggatggtcagtctttgttattgttaagacctttaactgattggataaggcacacctacattataatggagggtaatctgctttactcagagtcccccaattgtaatattaatcttatcagaaaacagcttcacagaaataactaatgaattttaaaagataagccatagtggagatctcaaattgtggtttcccatgattgtaaacaattctattctttgttgtctctattttagcactttctctttacatctcaacttggtgctatctgacttcctcctcctctcactatttgacactttgataaaggccatctgatattaccaaatcaactaacctgtttcagccttttctttccagacctttttgctttccttaacatggttgaccactttgatctcatttcctttgcctttgtgacattactcctggttctcatctctcttccctgtcttcttcaagtcttcatcctctgcctgtggccccaatgttgattttccttaggcaggttctgctctcagccctttgctagtctcactgcatgcttgtctttggtaatttcgtccatttttgtctgtttgttgacagtgaatatgtggcagctataggcattcaatacgtatttgttgaataaatggtgactcccaaatatatccccagtgctctgaactgcagaatcttaccaactgaccattacatacaactggacatacccatttgaatgtccagaggcacctcaaactctgtatgctcagaactcaactctatatatctctcctcctcaaactgtgcttcctccggcatgccactcgctattgttattgcttgctgctgtcctatttgtctttccctcaagtcagccaagccaaaaatttggtcttcatcctagaatccttccctttcctcacctcacctccctggatttaatcagatctctgccagtgtttaccttttatttctgaacccactccctcctttccattgtcccaggacaaatgccagtcattttaagttcatgttactgcaagaggcttgagactcctagatcgtctctctaatggtagtcatcttcccttcaggtctgccctcccaactgttgccagagggatctctctcttgggcaaatttaattgtaccactcttctgttaagatcctccatctctccccattatctctgggatgtacttaggtctgccatccccttccttgtactttattgattttttgcaacatttctgcataatactgctgttttatgtctccttgaattcgtgtatgatattttcactcttctgattacccttgtcccttatttacctggctaactcctatttagctttctcatctcagatgtaatctcaaggccaagcactttgcctctaagcttcctctatctctttatctaaaattatgtttttatatgattgtctccccaaatacaggaactgtgtgtcttatatactttgggtctccaatgcttaacataatgcctggaacatagtaaatgtttagtatatattagatgaactgttgaactgtactcaagtggaaattacaaacatcagagcagagagggtgaaaataaggaagcagaacctcccagaacttaagatcttaagagcagggtagtaatcagtcctcaactttgtactgtagacactggatttgatagtgatgtggctcagggccaggatgaggctggggagggaactgggccaagatcaggaaggggttgaggggtggtgttcaataagatcgtaacgtcagtttaacttacagtgaactttataaacgctggggggctagtatattttagcagatcgggttgttagtacattctctccctgtgctgagatagattgttctcacaagattgcccagggaatatgggataagcccagtagatgtttattgaatgacctcaatggctctggccatcaagctatcatagcctaaaacacccctttcttcacagtaggaatataactgacaggtgcattggattagttacattacctcttcactgggcagtgatgcagtgtgctgacaatgacactttagatatgaggatatggcctagaaacattgattggcctttttctggatcttaaagagatttcctggatggagagcctgtcatttagagtagattatctctacagagaaccaatatcatccattgagtactgagatttcttgtgtttttttgtttgtttgtttgtttgtttgttttgagacagagtcttgctctcgctcaggctggagtgcagtggcgcaatctcggctcgctgcaagctccgcctcctgggttcacgccattctcctgcctcagcctcttgagttgctgggactacaggcgcctgccactgtgcccggctaattttttgtatttttttagagacgaggttccaccgtgttagctaggatggtctcaatctcctgacctcgtgatccgcccgcctcggcctcccaaagtgctaggattataggagtgagccaccgcgcctggccaagatttcttgttttaaaattcattacctttttttgatttaactaaataatcaggtctctaccagatttcaagatatttagtacgctaatgttgaattgaaagaaccttggacttgagtcagtgcacaaaaatgaacatgaagaccacaaatactcatgtctgctaacaacatagtgatacaaataagatgtccgtgtaactactaaccccattatttactgatctccattgctgtactttgtatttttcctactatttatagctggaaatatattgatatggtttggctctgtgtccccacccaaatatcattttgaattgtaatccccagtgttggaggtgggaactggtgggaggtgattggatcttgggggtggggatttctcatgaatgatttagcaccatactcttggtgctgttctcttgacagtgagtgagtgagtgagttattgcgagatctggttgtttaaaagtatgtagcacatcctcctctctctcttgctcctgctcttgccatgtaagacatgcctgctccccattcaccttctgccatgattgtaagtttcctgaggcctccccagaagccgagcaaatgccagcatcatgcttcctgtgtagcctgcagaaccacgagccaattaaacctcttttcttaataaattacccagtctcaggtatttctttatagtaatgtgagaatggaccaatacatatattttggtttttcggagtttttttgagagagggtctcactgtcacccgggctggagtacagtggctcaatcttggctcactgcaacctccacctccaggttcaagcgattctcccacctcagtctcgcgagtagctgggaccacaggtgcacaccaccatgcccagctaagctttgtgttttttggtagagacagggtttcaccatgttagtcaacctggtcttgagctcctgacctcaggttatctgcctgccttagcctaccaaagtgctgggattataggtgtgaaccactgcacccagccaaagggactaatacatacacatacatatatacatatatacatatatatatatatatatatatatatacacatatatatatttatgtttattctttcttggcgttcctgctgcagtatgaatctctgccaaggcccagaaaagtgactgggacatagaatgaattcaggtgtttgttgaatgaatttattggtggtgtgcagagtgttaccatgctttgttggtttgttaattgaaagtttttaagtagaagagcttttgaattttgaaagaataattaaagctttcaaaaattctaagatgtaatttaccttatacagatgtagaaattgagctctcaagttctctgtatgtgctgccttcccataaacattaaacattgccatgacacccagagaagccccagggagcctggtaagcagccatatacctggggaatatagctagagaacttttgttttctgcctcactctcaaaagtgtctggatttgccccctcatttgtcatatccctgttaactacagtcactactctaaacatctactttggctctctttccttacccctcttatctgctcagaacctccttaccagaaaatgtagcaactccacaatcttttcccacccttcaagcaccatatccttttatagtttcactacgacagtttctggagctcatcaagtcttcccatccctccctgcttttgttttgtattcgttacttcctggctgcttccctctcccgctccaacttggagtccatagttcattgttataatcattcctttgtaaaggctcctacttccccagcccttctgtgccatcattgcacttacctggcaatccctcaaccctgggaaaaccctaccatctctttttacatccttaagcatttgttgctttaattattgccctctttagatcattcttactacaatacaaacatgagctagaatttctaatcttaaaaaccttctcttggttctatagtcctctttagctacatttctgggccgtaactcttagcaaatttttacaaaaatggactatactcctttctttgtatgtacaccctcccttcccactttcttctgtccagccatcccacagctgcctctgccactccattgaaacttctcctatcaggatcaccagaggactccaggttgacaaaccatattagttcttccctatagccaccttatatgacttctcagtccctcctctcttctcttggctttacttacaccacattctctggttttcttcccctctcacagtctgctccctttccgccaccttttcagggtcttttctccctccctgacctttatagtttgatgtctgtatgacttcggcttggctctcatcttcctctacattattttcctatgtaatagcatcttctcctgtagtttaaaatactgcctgtatgctggtaacttccaaaatttatatacaattcagacctctctgaacatcagacctgcatatccggttacctgcttaactccatttagaggtctcaaggtctcattgacattgcaaacttaacatttccaaaatggcaggttgctttctattccttctctccagttaaatctatccagttgctcaagctagaaacccaggagttattctccattcatcccttctcttcactcccatgtccaatctaatagcaagaagtcctgtatgtcatccctttctctcaccatctccttgcctctagtctaggtcatggctgcagtacacagcaccagaattactgcagtcacttctttggtttttgttttgagacagtcttgctctgtcacccagactcaagtgcagtagtgtaatcacggcttactgcagccttgaactcttgggctcaagcaatcctgctgcctcagcctcctaagtagctgggactgtaggcatgtgccaccacgcctggctaattttttttttttttttttttagagatgggggtttcgctatgttgtccaggctggtcttgacctcttgggctcaagtgatcctcctgcctcagcctcccaaagtgctgggattacaggcatgagtcaccacgtctagcctgcagtcactttttttttttttttttcctgacaaggtctcacttgtcacccaggcgtgctgtggcatgatctcagctcactgcaacctccgcctcccagattccagcaattcttgtgcctcagcctcctgagtagctggaattacaggcacacgccaccacgcctggctaatttttgtatttttagtagagctggatttcaccatgttgaccaggctagtcttgaattcctgacctcaagtgatctgctcgcctcagcctcccaaagtgttgggattacaggcatgagccactgtgcctggcctgcagtcacttcttaactgctttcccaatttcagtccgtattcccctccactccattttctacatagcagcaagaactattttacatcaggtgctgtcattttgttgtttaaaaccctttagtcttggctgggcactgtggctcatgccgataatcccagcactttgggaggtcaaggcaggaggatcacttgagctcagcagttcaagaccggcctgggcaacatggtgaaaccctgtctctacaaaaaatataaaagttagctgggcctgatggctcacacctgtagtcccagctactcaggaggctgaagtgggaagattgcttgcacctgggaggttgagggtgaagtgagccatgatcatgccactgcactccagcctgggtgacaaagtgagaccctgcccccagaaaaaaacccttgttgggaggtcaaggcaagtgtatcacctgaggtcaggagtttgagaccagcctggccaacatggcaaaaccccgtctctactaaaaatagaaaaattagccaggcgtggtggccctcacctgtagtcccagctactcgggaggttgaggcaggagaatcactttaacctgggaggcggaggttgcagtgagcagagatcatgccactgcacttcagcctgggtgacagagcaagacaaaaaaaagaaaaaaaaatctttgatcttatcaaattgttcttgttttccataatatcaaaaacccggcatataaatatataacaagtataagagtgtatcgcctaactatattatgggcagataccttaatagtatctttcaaataaaaaagatacttgccaacttttaaaataaatatatatggagtgcctgagggaatttcttaaggagtccatagtctatcatcagtctaccataatcagaataggaactatagtttattttggaatggattgtgaagattttctctcactctgtgggttgtctgtttactctgctgactgttccttttgccacacaaaagctctttagtttaagtcccagctatttatctttgtttttgttgcatttgcttttgggtcttggtcatgaagtctttgcgtaagctaatgtctagaagggtttttccaatgttctcttctagaatttttatagtttcaggtcttagatttaagtccttgatctatcttgagttgatttttgtataaggtgagagatgaggatccagtttcattctcctacatgtggctagccaattatcccagcaccagttgttgaatagggtgtcctttccccacttgatgtttttgtttgctttgtcaatgatcagtaggctgtaagtatttgggtttatttttgggttctctattttgttcctttggtctatgtgcctatttttattacagtaccaggctgctttgatgactgtggccttatagtatggtttgaaatcaggtaatgtgatgtctccagattgtatgcaggctcttttttggttccatatgaattttaggattgttttttctagttctgtgaaaactgatggtggtattttgatgggaattgcgttgaatttgtagattacttttggcagtatcatcattttcactttttttttttcttcgagacagagtctcgctctgtcgccaggctggattgcaatggcgtgatcttgcctgactgcaacctctgcctcctgggttcaagcaattctcctgcctcagcctcccaagtagctgggactacaggcgcacatcacgcccagctaatttttgtatttttagtagagacggggtttcaccatgttagccaggctggtctcgatctcttgacctcgtgaccctcccgcctcggcctcccaaagtactgagattacaggcgtgagccaccgcgcctggccttcgcaatattaattcttcctatccgtgagcatgggatgtgtttccttttgtttatgtcatctgtgatttctttcagcagtgttctgtagttttccttgtagaagtgtttcacctccttggttaggtatattcctaagtattttgttttactttttttgcagctattgtagaaggggttgagttcttgatttgattctcagcttggttgctgttggtgtatagaagagctactgatttgtttacattaattttgcatctggaaactgctgaattcttttatcagttctgggagctttctggaggagtctttagggttttctaggtaaacagtcttatcatcagcaaacaacaacagtttgacttcctctttactgatttggatgccctttatttctttctcttgtctgatttctcgggctaggacttccaatactttgttgaagagaagtggtaagagtgggcatctttgtcctattccagttctcagagggactgctttcaacttttccctattcattattatgttggctgtgggtttgtcatagatggcttttattacattgaggtatgtaatggacaggcattctaagccctttacaaatattaactcatttcattcttgtaataactctttgaagtcggtactattagaataaacttaaaagtatgagaaactgaggcatggagggctttttgcacaaggtcccacatcactctttcttgtctcgggtaaccctgtgattcacatagttgcagaccacatagtcacaccggaagtttttcaggaaacctttctagacatcttgttaaaaacttacaaaggggacaacttttgatgtgtaaaacaattaggaagcatgtccagagtctaagtgttctttaaaaaccaaaaaaaggccgggcacagtggctcatgcctgtaatcccagcactttgggaggccaagacgggtggatcacctgaggtcaggagtttgagaccagcctggccaacatggcaaacccctgtctctactaaaaatacaaaaattagtgggccatggtcgtgtgcgtctataatcccagctacttgggaggctgaggcaggagaaacacttgaacccgggggtcagaggttgcagtgagccgagatcgcaccacttcactccagcctgggcgaaagagcgaaactcagtctcaaaaaaaaaaaaaaaaagaacctccaaatagcagtttgcccattttctccttccaagttcacatatagaccttaataaaagttatagactccaacaactagtaaatatttttttccacttgtttcgttaaatttatttccattaaattgggagtaagatcaaaacagaataatgtttactgtcatcagtttaagaataaatgttgtgcttactccgcagaggcggatggatccactacttctccccccactgcaaaatttggttaagatgtggaaactgatgataccatatgtgcaccaggacggtacgaaaagggtttatgactcacttactgaggctttttggggagagcagggcaggcttcccatgcaggtacaagaatggcttgagaaagcaggaaaaggatactggctctccttttatggtgataagttgctgagtctggagtgaaggtccttatatgccccttcagccaggtcttggtttgaacttcccacctgttccaaaggatggctcacttgggctttcttattagcttgccctgaggaaaggggtacagcttgaaagctcttggcagtcaaatatcaaaaatgatgtcagactctttattacaaatatatttttaagtgcttgtcattgtttatgttatggggcaaaaatcttgcattgtactaaacaccatgtcactaatagtgtgaatagaagattcagcagactaatgtcaagaatgtttttggaaccttgaacacagggaatatcctgtgtgtcttttaaaaacacggaaaatacttaacatctctattttgtttgggttaacactgatgatgctgaaatgttgggtattgattgcctgggtcactatgggcaaagaagctttttttgtttttgtttagttttatgatattactgatttctgtgttttgtcatattctttttgtattttattaaacatgtttttaataaatgggcactcttattttcaaacttaataaataggactcattttactatgcatatcctgggttttaaattctgagctaagaaacaagagatagaagaaccaaatttgggtaaaattcagagtcttagatgccagaagccagggagacgctggaaaacaattattgagatgtgttataggttaactgatagttggaagacaacatgcctttcaggtttgtggtttactgcctttcattaattctgacacagtttttaatattttaatatctctgatattgggatatgccttacaattgttggcgagtcatagccagcatttttatttcttggggacacagaaaataatgtgtcttaccctcagtggtgtcttcaattacatgaactatgacaatttttacacctttataagtcttttaaaataaaaaattcatttatacttcagaaaaaatacctatgattagaccacgagttaggggagactttgcagtggtgattgccttggagttgccttgaaggaagagtgggagttggcccaacgggagtgggttggtggagaaggcattcagactgagagatagcatatacagcatattataaagagtgtgctgtgttggggaaagggctagaagtttgatgtggcaaaaatgtaggctctgggatgagatgagaatgataaactggctggaatggtaacctggagccagcctttgaaaggctctgtgtgccgtgcgagggagttgaggctgtcttggcatgttaggcagcattgtaaagcagctctccctccctgtttgcatcagcaaaggggtgggcagcattggcaccaataacagaagagtgaagacaatacatatgtcgaataagatctctagcacagagttctccaaaatggaaagggctgcaccctggaatcagatggaagggagaactttaccaagggggtgctatttccttctgctctgttgtgaatggagttggggttcagtggcctgttttagaagcctgtttgtgggcaagctgtgtgacaaagttgttgaaaaatgaggaatggctttcagagggcagtattaatccatttggatggaaatttaggagtggaacatgtgtttctaagctgtttttggctttttcctaagggctatatattcttaaattaaaggtgatttatcattcttagtttcctctaaaatataactttttgtagagggaggctttatcacaaaatttaagaaaaaataagtttgttattcttgctgtggttttatttttataagaaatttgggaatttgatccttcatagcagaaatttgttcagtttgggtctccaaacaagagacacagaaaatttgttcatcagagagccactgagatatatagagagttagaagatcagtcaggaaacattaatggaaccggaattatacaatagaggaagaaaactgcaaatatttctgttgtttcagcctaattttaacactcattaccatttgcagcccataagcgaattgttttgcatagagcctgcattgctaagccagtagaaggaactagtcttttaaaaacattttctaatttcattcccttttatttttgagacagggcctcactctgtcgtctaggccggagtgcagtggtgcgatctcagctcacagcagcctcaactatccaggctcaggcagtcttcccatctcagtctctcaaataactgggatttacagcatgagccaccatgcctggcaaatttttaaaaaatgttttgtagaaacaggggtctcactatgttgcccaggctggtctagaactcctaggctcaagtgatcctcctgcctcagcctcccgaagtgctgaatgaaccaccacaccaggtcttttatttcacgtttaaataaaaatgttagatagtagtatgttgacatagttcaaaagttaaaaaagaatacatgataaaaagtcttcctcctagtcccctgtccctttgctgaggaactcagtgttagtatcctgtgtatggttccagagatattttatggagatgtgagcaaatctataagtgatagcatctcatacacatggttctacagctgcttttttttttaacagaagttttactgtgatataattcacatactgtggaattcacccatttcagttgggattcagtggtttttcagtgtattcacagtgtgttgcagccgtcattacttatataatattagaacactttcatcaccccataaagaaaccttatatccattagggcttagtccctcttcccctagcaactactaatctactttctgtattagaaattttatatggatagaatcagataatatggggccttttctgtctggcatctttcacttagcataacattttcagttttcattcatgatgtagcatgtatcaatatttcatttctttttatagccataatattccattgtatgaatataccacattttgtttatctgttcataagatgagggacatgtttttctcttgtgtatatacttaggattgctattgctgagtcatcataactctgtgtttaaccatttgaggacctgccaaactgtttttcaaaaggctgtatcatttctattcccatcaacaatgtagagagttctaatttctctacatcctctccagctactggttagtgccatctttttgatatagccatcctagcgagtgtgaagtggtatctcattgtggttctaatatgcctttttgctaatgacttagtgatccttgagcaccattaagtgcttattggctatgtatgtctttggagaaatgatattcatgtacattacccatttttaaattgtttaatctttgcaatgttgatggtaagtgttctttatatatttgaatacaagtctcatatatgatttgcaaatattttctctcattctgtggatgtcttcttgctttcttggtagtttaaagcaaaaaattttaaattttgggtaagtccaatttacctattatttcttttgttactcatgcttttggtgtgttatctaagaaaccattgcctaatacaagatcacagagcttactcctatgtttttttctaagggttttatagttttagctcttacctttaagtctatgttttatttgagttaatttttgtatatgatgtgctttacattttgtacttttcatttaataatatcttgggagatcattctattccagcactaaagaacttcctcagtttttcttatgatactatagtattctcttatgttgatatatcatagctactttaaacagtctctcattgatggagatttacacaaacatttgggtttggaaattatctcaaaatgacattgtggcttgaaagttgtttcatatcacccttctcaaaaatacaatttcatccatttcacagatttggttgttccaggcaactcatgctattcagaagccctggaataaatcccagtcctttgggtagaatgaccccaaggaattcaagatatttcattccattaaatgtttacagtaagtcaggaagcaaaagtttctttcaattatctgaaaatatatggaaaaatacttttggagggacaaggtgctctaaaattttgttgtaccatctaagctacagtcagtttcagatgacttaatggcatgtgttcttttactcttttgttgaattgttgtctgtgtgtataaatcaaagtgagtagtaatctaaacttcaggcaatacaggcagccaactcagtaagatataaaatatccagagattatgaaacatataggtttctttgttaaagaggaggcttaggggaaaatcttgaaatacatcaacactttcctaatctgcagaggcatatttggccactggaaagtaaacaaaaaaaggctaataggaagctaagattagtatggcaaaacccattccttcaacttcttgatctttacctgtaacacagttcttcactaagagactattcttattttatacactgatcaagtcagtgtgatatcacaaaaaaagaacttcagaattgtttaaattctgtttctgttctctatgatctggataccttcaataagttactttccttttttgggctagagtattttcatctataaaatgaacgtgaactagatgagttttcaagcctatagtagaacaattaattagaggtgaaatagaggctactactggaggcaagctgcaatcagcagtggccacagctggcctgatctgcatggagtagacagtaagaatgttaaaagcatttacaaaagttcaaaaataatcatggctggagacatctggctaggagcaaatagtccgacatacctgagtggccccagagggcacactaagttacattatgttcctaatgtccacacaagttctgagctaccaaataaaggttaaatggaatactgtagttctttcttttgcagttttattttgatataatttctcatttacagaaagtttcagatagaacacaaagaataccatctatccttcacccaggtttttcttttcttttctttttccttttcttttcttttcttttcttttttgagacggagttttgctctcgttgcccaggctggagtgcaatgccgcgatctcagctcattgcaacctccgcctccagggttcaagcaattctcctgtctcagcctcccaagtagctgggattacaggtgcatgctaccaacgcccagctaatttttgtatttttagtagagacagggtttcatcatattggttaggctggtctctaactcctgacctcaggtaatccgcctgcctcagcctcccaaaatgctgggattaaaggcgtgagccaccgtgcctggcccacccaggtttttcagatgttaacattttattacatttgcttaaatctttctctccccttcctccccctcccaccttgtatatgtgtttctgtaccacatggaagcagtaaaaatgccgttcctttatttataaataatttaacatgtatttcctgaagactaaggacatcatgttatataaccacagtgtaattatcaaaattaggaaatgaatattgaaacagtaacagtactgttatctaatatatagagtttatttggatgatgcccgttgatccaataatgtccattagagcagaagaaaatccagaatcatgtgattcacttagccatcatgtctctttcatcacctttagtctgcagcatttcctgagtcattttctttaaagttttacattaatatttttaatgtatattatataagccagttacatagtagattgcccctcattcaagtgtgtctgatgatttaggctatccatatttggcaggaacaccacggaagtaatgttctgttcttctcagtacctgatctaaggagaaaggtgctgcttatttgttccactgctggtgatgttgactttgatccttggttaaggtgttgtctgccatgtttctccactctaaagtaactatttttttcccctttgtaattaataactatcttatgggtaattctttgaaactaggcaactatcatgtttctccttaaactttcactcaccatattatctttttatgaagacagaaggaaaataatacattttagtaagagtcccatcaaaatggttgtgatgtttaaaaaaataacttcaaggaacatggagtagtcatttgacagatataatcatgtagaattacttactatcagaaattaaatgtatgcgccgggcgcggtggctcacgtctgtaatcccagcactttgggaggctgaggtgggcggatcacttgaggtcaggagttcgagaccatcctggccaacatggtgaaaccccatctctactaaagatacaaaaaattagccgggcgtggtggctcgcgcctgtaatcccagctactcaggaggctgaggcaggagaatcgcttgaacctaggaggcagaggttgcagtgagccgagatggcaccattgcactccagcctgggcgacaggacgagactccatctcaaaaaaaaaaaaaaaagaaaagaaattaaatgtatgcaatacttagtttttaaaaatatccctcacatatctaaagtcaatttgcaggtttatacatgtaaaaataatttcatttgttagtagtattgtttttgaaagatttagagatgagtcactcatggaaatttttctatttttccagtattggaggcagaatgaaactaacaaaaatcctttggggaaaaaattattccaataaattttccagtaattattccaaatgtctcttcttttcctcccttttttgtgtatctttacaactcaaccaaaaagtccactgttactatatcaagcctgcttaagaatcctccgtgatgcccacttcctacaggatcaagttccagctcatctgaattcagactaccttttcatcttaaaacttttcctctattccagccaaattcatcttcataattcatctttaaacatcatctcatgtttttctgtctctgcaaaatgccctttcaatctattttgagtcttctcagtataccagataaaattcaagtgcatctttcataaaatattccctgacctcttcatttttcaaattttgactttaattagctacatatagtctatttgctacttcagggggatggtttagtaggaacttaccttagggaagataaggtggcataaataacaataagatacagaccaggcagtgctgactccctgcttggagggccattttcccatgccctgcactgtgccataccctgcacactgtaggacacaaagtttgttgtacacattcttgtgtatatttccatgtacagtatctaatgagactcatcccactcagaacttaggacttattatatattcaataaatgaattgttcagttgatactgtcttttaaaaattctgataaagccagcatctcaataggaagcaggggcagatgtttccattcctccctcatattttactttctgttcaagggtgagtgtttacactttgaactctttctggcagtgatgaatcagtgctgattaatcaatactcttttgccagatttttctaggagccagagagagcttgactggggtcaggcatccatttaagggcaggttggtttccttattttaggaaaaaaaatagtgcttatatgtttcattaatcataacttcactttacaggaatccaaaaaatttagtgttatctgttcactccttttgaagtgttctttgagagctctctgaccaccaggaagtgtagtaggtgctaggcacactgaagccaagtaaggtgtagttccatggctcaaggagttgtgagtctaacaggggagctgaagttaattgcaagggagattgtgcttttcactgaaaggtgtgtcttcggtagactacagccatagagtcgtgtgagaattactgaagagtgtggcagaagaaaaggtggtaagatcagggagggctttaccaaagtcacgttcaggtggagtcttgaaattctgtaagctttcagaggtgggccttgttccaagctgtgtgagtatagccctgaggtaagctggctgcgtggcatgttgaaggaagtgagagcaagctgataccagctcgccaccaacagcctttgccaaatgtaaagcaggaaaaggagggttactttgaaaagcctagtgtgccatgctgagaatgatggactttatgaagcaatggaggagcttttaaatgtgttttcaataagaaattgtcatggacaaatcagcattgaattcagatctcattaaaaacgtgtccaaaggataactcgacagtaaacatatctcgaaagtacccatggctgtaaaaaaggcgaagtatttctttctccatttaatttaccctcccctgggtgattggtttgtggttaggccgtttgtccagctgcagcagactggttttacaccctgaagtaaacttgaatttctttttttttttttgagacggagtctcgctctgtcacccaggctggatggagtgcagcggtgcgatctcggctcactgcaacctccgcctcccaggtttaagcgattctcctacctcagtctcccaggtagctgggattacaggtgcccgccatcacgccgggctaattttcgtatttttagtagagatgggatttcaccatgttggccaggttggtctcgaactcctgacctcaggtgatccacctgcctcagcttcccaaagtgttgggattacaggtgtgagccactgcgcctggcctttgaatttcttaaaaccaagcagaacagtgattttcaagctctcttcattagattctagcagctggagtttatttatttatttatttgagacagtctcactctgttgcccaggctggagtgcagtggcgtgatctccgttcgctgcaacctctgcctcctgggctcaagcaatcctccccgctcagcctcccaagtagctgagattacaggtgtgcgccatgaggctcagctaattttttttatttttggtagagatggggtttcaccatgttgcccaggctggtcttgaactcctgagctcaagcgatccacccacctcagcctcccaaagtgctgggattataggcgtgagccactgcacctggcacagctgcattttagagcttccaaatgcttagtgcgtatttcatttgtttccaaagtacattttaaaccattaaaatcacaataaaaaatagcacacacacttgtgggtggttatatgaataattcgtggactttggacaccaatgtcctgttaactcaggctgccagtgcagtcttcagaataaagtagatttttgtaatttctctgccgacatgtaaacttatacaagtgtgttattgattaagaagctgagtagagcactgccctggtattttgaaaagttcaggttcatgcatgtgcactaataatgtattttacaagtgaacatacctatacctacagtcaatcaaatgccaggcaaggtgtggctcgtctgcttcaggcatggtcttattgtataatagcatcgtaagtgaagtcccaacatctcatttgtatgctgggtagtaattacatgtttcaaatcacctgggggccttttaaaaatcctgatacccaggccataccccttaccaattaaatcagaattcctggaggtaggggtgggacccaggcattagtattcttttaagagttagactgtttagagcagttatggtttacagcaaaatagagcagaaggtacagatttcccatctgtctcctccatggcctctcctattattggtatcccccaccagagtgatacattgttacagttggtgaacctacagtaacacatcattatcacccaaagaccattatatttacgttagggttccttctttctgttgtacgttgtatgggtttcaacagatgtacaatgacatatatctattattataatatcatatagagtaatttagtatttttcagtagtttcagtaggcatcagtatttttaaatttttaaaaattttttgctgtattttggaggagaggaatatattcttattgccatcgaccgtaggcgtattctttccaatctcttgttctgtccttctagtaataattgtattggcttttctggtttcagttaaattttggttcacatatcttcaaacatactataaacctgataagatttgagagcccagaaagataagtttaaggtacagtggtctttttcctgaagagcaattttaatatgccatttcagcacctgggaagtgtaaaatatgtgagagtgttattttcttatctatcagatatgcctccagagctttcaacatgttctttatgttaagcattttagtcccctgtactctagcagaagtaaaatctgatttttcctaccaaaagttccttattttcatctgcttgctaagaaccaagaaatgtttggatgctttatgcagatgatacaattcaaactaactgcaactggggcatttgtgttgcctgcttcatgttttgagcctttagtatttaatggaagccctgcgctgtggaaagtctcctaatagcactttgtgcatcccaggggccagccacggtgcttctgcagccgcactgtagatgtttgtttatttgtctccactaggctgtccagtacatttagaggctgagtctcagtgtgtgtttgaaagaatgaatggttgattgaagaaaggagaccatttgcaggagagagagagagatgaacagtacatatatagaggagggcaagaagaaatcccagggctttagagtcaagtgattagttcagtgactggcctgattcaggaccctttgagcatttctcatttgagaaacagaaagatctttgttggtacaaaaaaggttaaggatagatatgtggccagctggacatcgatcatgagcggaaggaattgactccgagagggatttggtaatcttgtgtgttagtaaaagtacatggattttttttttttacagtctcactctgtcacacaggctggagtgtagtggcacaatcacagttcactgcagcctcaacctcccaggcccaggcagtcctcctatctcagccccctgagtagctgagatcacaggtttgagccactatgcccagctaatatttttttgtcaagacgagggctggtcttgaaactccagggctcaagccatcctcctgcctcagcctcccaaaatgctgggattacaggcatgagccaccttgtctggccagatttttttttttttttttttttttttggtaatcaaatatttcaaaaggtgagtctcctttggggtgattctctcacacagaaagatgattcttggaggaaacatatctaagcatcctccaaggtagtgtcagcattcaaagttgatcctgaattatctctgcagacactttttgtgttgggcattatgctgaagccatttgttgtagagcaagttgatttttatggctgagcttatctgaatttagtttgatatattgtattctttatttattcattcattgattcactgattcattcatttttcctgacattcaaacaaatgtttcttgaacacattgtgaaagggccaggcatttgtcaggtaatgagggtataatggtaaacaaggtagacacagccctttgccctcttgggggtgcagacagccggtcatttaagtggggtgtgaggagagcatttacaaggaaaggacaggatgtcggggagcacagggtggggagtgtggggcagacgctaggaggaagtcccttgagattaaggcctgaagcataactttagacaaagagtgcagaagagtgtgttcctgactaatgaaaagcttagtttattaatacttagggcttgttgaatggaggatacttttgcagccttcccctactttgtgccatccagccaagagaggtccacaatagcagccctgattcgcgggaggaaagagcccacttcagctgcagggtggccctgttcccaggagagatttgagtctgaccccacagtggcagcaaggcagctctgtgcctgtgttatctccaccagcacacgtcattgagtcagctttactttatccagcctgattgtagaagtcatagtagacactgtgagggaatcgtgtggaattttcactggagcattctgaaacttaaaaagtaaatcttttattgctttactaatgtcttcctgtgtctgtctttttaaaaatttttattgtaaaaagtaaaatatataccaaagagtgtatgtgtgtacagtttacactatcagtattaaaatgggcacccatgtactcatgaccagcctaggaaataaaacattaccaatagtgtgtacctttcacatcctgcctcctccaccctgtcccagttgtaactactaccctgaatttgtatttagtgttctcttttgttcctctcttctagtatgttttaaaaggtcatatttatgcttattaggagatattacagtatcagactcttgctgtgtaccaacaaagaacaagagataggtcagaacgctgtttaaataaattgcttgattgtactcttttaagcaggagtttatagtggtaacatcaaagtgcttaaaaaaattcaaaacaaaagcctttttcagtttcaaggaaaaccttaacaaggtgtgttaaaaagataaggtttttagaggttgggtgaggtggctcacacctttagtcccagcactttgggaggccaaggcaggtggatcacttgaggtcaggagttcaagaccagcctgaccaacatggtaaaaccctgtctctacttaaaaaaaatagaaaaattatctaggcatggtggcacgcccctgtggtcccagctattcaggaggctgaggccagagaatcacttgaacccagaaggtggaggttgcagtgagttgagatcgctccactgcactccagcctgggcaacagagcaagattcttgtctcaaaaaaaaaaaaaaaagataaggtttttacaaaccagtatgctataaatggacccagtagtaacatgacattgaattgcttcaaccagtaacagcttcaagatccctgcctatgttccctgctgtgaacgtgtttatttgttcctaataatactgccacagtgtatttcaaattattttatggtatgagagtttgaatttacttggagtaagatcatctcggcatgtagttgggagacattatttactctattgtttcagtaattcagaatattgaaataggtcagtcatgtcaggaaatagactcttaggtgaaccattcttgaatttgcctttttctttgtgattgtgatggatattgttttgttttctatctttgcttttttttttctttctgaaatgttctggttgtccatccaaattgtaagaatattacattttgaatatcctttgattattgtaaaaatgacccctagtcagatgattccacagactttttgattacttgtcaaatgactttgcgggcttttttcatttgaattgatttcctattttaagggtcagtgtcacttcattgctaaatgatacctttgagcaacatggtacattttagaaaccttattctccagagtactctaagagaagggttgtttggattttatttgtttatattcttgccctttaaactctagcataactcagcaggattcggtactccttatagaaccgttccccagagagaaagtaagctcagctctcatttccatgttgaagtttgtatgcaagtttacatggagctcagaatccaaagttggcaggatatgaaaatgtttgtatatcatttaatctattttatttcatttcatttctgtgtttttattcccaaagcaattggttttattcaggaatcaacagacttttttaaatccatctataagtttttgaaccaaagctttactacatttcacagccatttttgccactatgccataattataaatccttggcctcaaagaaacctatttaatatcttattcagattgagattctagtcttcagtgacatggaatgtagattagaacaatagtttctgtatatctcaatggtctttacatttgcatttttagccattttaactagcccctaaaaactctcttttatgactctgtggatgagctatctgaattcaacaataattttactatgtattcccataatactcctagtcatttaaaaaaaggcaggggaatggacaaagcaaatcattcccaattgtttaagaaaccagtgaactcatcccttgcttggactgcatagaatacagcctgagagggaaacctgtgatttagtttctctctttacccacacaggagaacacttctgacaagatgccattcgtgctcaccgtagttggtcagaaactgcggctctgtgcttggcaaaagttaatttggattttagatgctgtgtgcaaggaaaccatgtgcagttttaagcaaggatcttcactgaaatttctcgctgcaatcaactacgcagagtgcccagctctcagcatttgacacagttggccactcttcccttgtctctcatggcatcgtgatttcctgggatacctttggtctctttgtccatagcattctctatctggggtacactcacaataggcagaggaaaaacatggtaaccagggtggctgctgcaacatatttgagggggtcagggtaggcaatgaggtccgagaggtagccaggagttagctcatgtaggactttgtaggccacttgaggactggcctgatctggctgatgggaaacccatagaggattttgagtagaagagtgatatgatccaacctgaattttaatgagatctctttggcctctctgtggactagttgctgtgaagtggggaaggctgaaggaggcagacaccaattaggaagctatcaatacttaatccaggtgaaagatgacagtggcttggaccaagatggtgacaccaaatgaggcagagagagatcaatttctagataggtttcttttgttttgttttgttttgttttttgagacagagtctcgctctgtcaccccgcccagagtgtagtggtgtgatctcagctcactgcaagctccgcctcccgggttcacgccattctcctgcctcagccttccgattagctggtactacaggcgcccgccaccacaccagctaattcttttgtatttttagtagagacggggtttcaccatgttagccaggatggtcttgatctcctgacctcggtgttccgcccactttggcctcccaaagtgctgggattacaaacgtgagccaccgcacccggcccctctagataggtttctaagtagagatgacatgtgtagctgacagcttggaggaaagttgtgcaaaagagaggagtcacaaaacagtccagggttttggtctcagccactagaaaactggtgttaccatttactgatttggagaagaccatggaaaggaagtttggggggtgggaatcaggagtttaatttggacatattaaatttgagatgatgccaattacatccaagcaaagttgaataggctgtgtgtgtgtgtgtgtgtgtgtgtgtgtgtgtgtgtgtgtgtgtgtacaggtgtcatcagcatttgaaactgagtgaggtcaccaagagaaggaatgttaaatagatacgcagtcagagaaatgatctgggctcttaatcatatagaggtcaggagaaccagggaaggagcagtcaatgagataagagaatcaagagggagaggcattccaaaagccaaactgttaaaaaacaaaaaaaaaggttttagcagggagtaactttcaaaggttttagatagggcaataagacaagatttgagaattaaccatggaggtcattgcattccttaacaaaaacagtttctatggagtaacggagatgaaagcctaaattggatttatccaagagaacagaagaggagagaaattggacacagtgtgtacagacagttctttcaagattgataaaataaaggaggacaaaggggccagagctgcagggagatgcagggtcaaggttttttttctctaaacctgggatataaatataaatatgtatgtttatattgctgctggtggtaattcagtagtgagtgaaaaattcagaagagggagaattgctggatcaataaatgtccttaggtaggcaagagatgagatgcaatgtgcagtggagaggttcatcctggagagggatgcagacagacactttctacataggagtgcagggaaagcagaatgggcacagatgcagggaggtgggtagctatggtgtctggacatagggaggttctcttctcattgcttctgttttctcggtgaaataagcagctcagtcattagctgggagtgagaaaccagaggaagtggaaatttgaggttagagaggaaggtttaaactagtcctctagggaaatggaaagcagatggattagggcaatgtgggtggattgctagacagcattaagagtccctttaaggttagtgaccatacatttaaggcgaaaatagtcagtgggattgtgtgcttttgtccagctgtggtcagccaccctggtggagatgcatagtggatagagaattgaatttaaccaggatagaggttccaggtgaaggccctgaagggagaggcaagagagctgattgtgtatgcaagggggtgagtataatggtggcctatggggtttagtctgagtaaggcaaatgaagacatgctgggattttagtttctgatgcagcttagggatcagtgaactcagggttttggaggatattggaaagctaagaggtggtcaattagggagtagagaagcctgaaactacgattctggagtgggtgcaggtactgatgattgggtctagagctagtgattctcaactggggggatttcacctctgaggaggcatttgcaatgtctggagacatttttggttgtcacaactggaggcagaggagatactgctgtcatctagtagaggccaggggtgctgctcaacatcctacaaggtatagcacagtttcccacaacaaaggattgtctgtggcagttgtcagtagtgctgaggttgagaagccctggtttagggtataaaagaaaaacttcagctgaattaaatttaaaggagtttaactgaacaaagaatgaactgcgaattgggcagccttctgagccaaggtaggctcagagacgccagcgcagccacgtggcggaagaagatttatggacagaaaaaggaaagtgatgtacagaaaacgggagtgaggtacagaaacagctgcattgattatagctcagcatttgccttacttgaacacaatttgaacagttggctacatttgattggccaaaactcggtgcttggcccaaggtgattggctacggcctgtttacacctacacttgttatagttcacagtgtacagaaaaacccttaggctgaacttaaaatatgtaaggaggcagctttaggctaaacttgattgaacaggtatgaccatagaaatgagtggctggggtaggcctgatcttacccagattattggagaagataaacagactagggttttagaaggtttatcttacaactgatgaaatctccaaaaatgatgacaagagtagtattagagaaaagtgtagatagccagggatgggaggaagttaatttctcagtgtgtggcatcattttctttttcttgagctagctgatgggctagctttggatttcataatcctggctaagagctacacgttcagattagccaaagagtgttgtgtgttttttaaaaagccacctgtttattacctaactttggtataatgaaatctgtgtcttaaatagatgcctaaaagccatttgggaatttggttagtctttttgctcaaaattctgtgactgtaaacttggacacttggtctaattccatctttaaataatgtctcgggatgacaagtcttgcagctaggcctcgaggaagggatctggtttaagaaaatccttgaagaaggctgggtgcggtggctcacgcctgtaatcccagcactttgggggggccggggctggtgaatcacctgaggtcaggagttcgagaccagcctgggcaacatggtgaaaccccgtctctactaaaaatacaaaaattagctgggcgtcgtggtgggtgtctgtaatcccagctactcgggaggctgaggcaggagaattgcttgaacccaggaggcggaggttgcaacactgcactccagcctgagtgacaagattgagactcggtctcaaaaaaaaaaaaaagaaagaaagaaaagaaaatccttgagaaactttatttatagacttttagagactgtggctttccagtactcatcaccatggagaaaactagtcaaaatcacacagagtgaataagggttgcaagccagtgctgcttcctggaataagctggtccactagtctagtcttgtgctttgtccttcattttgaactcaagtgccctggggctgcttttctgcgtacccacaatagcaaggaactcttttgtttgcatctcctctgaaagaaatgcttgttttgaggtttggaccgcaaataataatctattgttccctgtaataataatccaccctctttcgcagaaaaaaaaatctgcttgatgcagtatggctatcagtttatttaaaagaatagccaaaagtgcccattatgtcctgagaataaacatttgcaagatggttgggaggaatgggggagtactcttgttctccttggctgagagtcagttaagtcttcaaggagaaaaaattctgaaaatgaccatcagtcctggctgacaatactcttccttattctgcccgtctgttacattctaagaattattgcaacactgcagatatttattccaaacgatttctttaaaaaatatggaagatgggtatttttaagttaccaattttgggccaaataagttttttttttctgactttcattttgtctgtgaaagcatttcttttatagcagtatgttcaaattagcaatctttaagaatttggcaaatacttttaacagcaatccttaacaattcctgcagttgcctactattgcagatcttgaaaaaagagccatttttatattctaagtggtagacacatttcaattactatttcctgggcttaggctaactgacaaaacttgatgggtgaaatgaaaatgtgatatacggtgtaatcagctgtttacttacctagcacagtgaaatcttatggtaggtatgattgcactaacaaaaccaaaacatgcatttttcttccttaagttctttataagaaaaggatcagttaaataataaatgtggctttaaaatgaagttatatcttaggatagttttaattgcattacatatggatgatgagaaaagttcagtgtgataacaattgcgtaacagataagcatgagaactacttaaagaaataaaaatatgcccatcacctcattaaaaatagaccatcagggaagccaccaagaagtccttcagtaggtgaatgaataaactgtggtacatccatacaatttgtatattattcagcaataaaaagaaatgagatattatgccacaaaaagacacggaagaaagttaagtgcatattactaagtgaaagaaggcaaccttaaaaggctacatgctgtataattttaactagataacattctagaaaaggcaaacctatagagacagtataaggtcagtgtttgccaggggtgtggggggaaggacggcaggaataaattggtgtagcacaggggatgcttagggagtgaaactattctgtatgatactgtaatggtggagacgtcactattcacctttgtcaaaatccataagatctacaacactaacacaaatcctaatgtaaactatggactgtggttaacaatgatgtaaccatattggctcatcaattaaaacaaacgtataacactaatgccagatgttaataataggagaaacaggttggccatgggagagtgagggaatatgagaattctaccttctattcaatgtttctgtaaacctgaaactgctctttaaaaagtctattagtttaaaaaaaaaattcaatataaccagactaataaaaatatcttaactaaaaagcaatacaaacctaaactgtcagcaattattctgtttatagtgctattctgattgaacttagctgtagaatattctgccagaaatatgtaatggcagtgaattactgtatatatctagtaactttgctgtatcttttcttgtctggcaaaaatgcacagtggtattcatgttaagtcctactttcaactacccttattcctttctcttcagtgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcggtaagaatgcttgacttctcttggctagtcctgcctcacaggtttctttactgctgtataattggtgatccatttttctgatggttcatttccaaaatgagtgtattttttatctgttatagacttcaaggcccttcttttgcttcaggataaaataagttcagcatctcttaaatgcgtctggtttccttgtctttgatcagttcctctccaccatcaaatcccattctgaaattgatcttaattgaccacactgactctaatcaggatttatcctgcatcttttcatcttttattgccccatatttattgatatttgttttatgtattatcaaattttatatatatatgtatgcatcttctgatttgattatctttttttaatttagcgtatagtccatctgatttagcaatattgatttgggagcttactatgtagtgggttatgtagggccttcaaaaatgtctaaaacagaatccttgctctcacctagagatgattaggaggaaggctgatatatagatgactttggagtaagataaaggatgtaacagaaatacagcaccagagcattgaaaaaaggttatttagtaactagtggagtgctggttattaaacatgaactgactatcttggttctggtctgtaaaatggagacgataaaacctcccacacaagggtgttaggaggataaagtaagattattcaagataagtgctcaggagagtgtctagctcttgagttactaaaatacaccatttgttgttactgttgctctcccagcatgtggaatgcccttcatatattggcacatattttagtactgttgcatgtttcaggttgtcagtgtttagcaaggacagtctgtcatctatctttaagaatgcccaattcttcttctgaatggtgagttacattgttgatcaccacctagatgttgggcccatcatatgcctatgccatttaatcttcacagctctatgaggaagacagggtggggaggatgggagacactgactcaagagttattcacctgtggccataccacacaggttagaattgtttaaacttcaatacggtatgatttcccttatgtattatttctctctcaggtagaaaaatctgctaataatatttacggcctcataggttttagggattacctaaggcagtgcttctcagtattttttaaaatttatttttaaaaggagccttttcacatttttcttaatctctgcccccttccatgaaattttaatattgtagatatcctctgcaactgttttacatataaaagagaaagattttctcaaagcttcccacccaagagccagtgtttgctcccttgggggagaatctcccctatggagaatgcatagtctagaggtctttataagagaggccttcccttacagtagccataagggtgagcacaggaatccatacagataccatggaaagacataaagaggcattctctgcttcacgtaaatatggcatcagcatagaacatacactaatgttcccatagaggcaagattaaacacataagtttactcaagagagtccaaagaactatttaaacatttaaagatttcccactgaagtcttctgcaagagtgggtgtgagagccacccagaggtaataactttcttttaaagagcggttccatttatgctggaaacagtcttgtcgtgtaggtccatgaaggtttacataactcaaaacttaatattaagaacatgctgtaattctgattaatatttttagctaatcaatttatacttacacacgagtctgattgcagttaatcccagcatgttcagttattgacataggatcctttaattccaaaatgtcgggacacatttaataagatgagtgggttgcttttttgtttttataggttttacaggaaaagtatattcaaacccagtatattcaaaagccatactgtggatggcttttttggcccatggccttgggatccacatgtctgaaactgaactcattttttctcccttctgtttcccttttctgctttttttttttttttttttttttaggttaattgtgttcatctgcagatgagttttgtaatcattttgttttgttttgttttgttttgttttgttttgttttgtgttttctgtcctttccttccctgtcccttaccacttcccttctgcccccaagaaataagaacctttgctggttcttcctactttgtttctggtgtctagctttttgtcagccttcctgtgtctctgctgtctattgagcaatgttaactgtgtgcctggtcttgtgcagtagccccttgttattcttctgcttctgtttttctcatctttcaatccaaccctcatatgccagcaggtgcatagtcttagaacagctctttcaccttgccactgcaggttatcaggaacctagattcccattgtggacaacatttgtctagaattaaaagctcattacaatttggcccagcctaccactttagcctcacttctgttctcttatggcatcacttccagtttagtaaaaatgctttgtgctttgttttcctacttctgaacacttgtcatttaagctgtaccccatttttaccctctgtctcctccataatgcctctttttttttttttaaccttttagcccttaaaactcactacccttatctgggccattcctataatacagatcccttaatatgacagttttcctcttcttcctgaatatgggtgttttaagaggacttgcctgtcttacatctttagtatacctcatagctttagcaccatggcttgtactttaaaaatattgattgataatgattctagtcttttctgtgaatttttcactgttttatttccatctctcactggtttgaccaagacgttattcctcagtttgattcagcaaactatgtagttcctgctgtgtccaaagtgctaaggagtacagagataaatacatcttatcctctgccttcaaatggcccccattcaatgagggagcctgactgagggagctgtctcagacccagtgctgagaaacagcatcatgtagctcatccccgctggttcagaaatgcaaggcagggaatatgtggagatgttgtgggaagggaaggcagagagcaggtgatggaaggattcatttgcaaagctgagagtttatggttcattttctagtgaagaagagagagtgaagaactttgaacagataagacatgatctcacctgagaggccttaaacattggaaatagcataagctttgaaatcagagctgagtttgaattccatctctaaaacctgtgactttgggaaagtcaccaaggtttcctgagcctcacattccctatttatgaaatatcaggtaggcgaatctcaccttgcagggtggttgtgagggctagagagttgttgggagacagttttctatgggtctttcacgtttttgcacaccttgctagcaaaggcactggctgcctttgttctggactttttttatacagtaactagctttggaaggcagagatgatgttaccctctggagcaaaggacaaatttgtgtattcttgagtatagtaaaggtagtgtctcctttcagggctgaagtcagacatgtcttctgccccttgtaagagaatagtgttccctgagcttggggttcctcggctgtgatgcaacgcctctgcctgcacaacatccatgtgagcccctccatgtcatggctatgggacttgcggggcaagagaaacaaacacatgctttctgctcataaggttctttgtttctgagtcttcttcatgggagtgaagatttcacaggagtccgtgtcttctgtcagcacctatgaacctgtggccaactaactttgttagcttgtaagtagggtaaaatctcagacccttcacggttcttaacaagcatttaggtcatatgaaatgcagggtaaatatttgataaatgttataataataaccattattctttatcagtgatcatttaggcattgtggaagatgatgagttagacataccagttaagaggccatagtccaagatgatgaaaacataaaaacagatattgtcagtgggaaccgaatagagagaagagagaactgagagaaactaatgagacattgacaatattgggggattaactggataggaagaaagagaatcaaggatgacttcaagatttatggttttggaaagaaacagtagccatcagtgaagacacgatacatgaagaggggaagatgaagtttgtaagagagggtgacaagcttgggggagaggggcagccaggtggtaaagtgagtaggcaaggagtctagagcttaggggacgctattgatggagagagaggtttgggagttaagaaaatctagatgatcattaaatcataggaatggatgagtctgcactggggttttcaccgtgctcaaagggttctgaaaatgttctgtttgaattgctaatagagctggtttctatccccagctccaccatcaccccgtccattaaccagaacaaagacatcaggcctccagcatagctgcttggattagagccaagtgtgaggatagatcccctcccactgggccttaaccctgcttccaggtgctgagtttgacaaggtttactttgagaagacagttcctttgctgaaagcaggactgaggagagactgaggagtggaaagagaaaggggctaaaggctgaactttcaaaagccggcaagagtatcttgtgttatctgggctttgttcctttcacacacccatgacttttccataggaaaccagaaggaagagggcgaaactcagattagctgatctgagatatttaggattcttctcctttgtgcttctgtgtatcttagtggtaagctaactcaacactaagctttctgaagccttgggaatcactgggctcaatcatggtgttactggaagaacattggctttgaagactcagatgggcctaaattttactctgggtccccaatttactatcattggtaccttgggaaaatggcttctcttaagtctccattttgtcttttataaaattatgggtggtaataattatatcaatgaaatattgagaggattagaggtgatatatgagtctgattcttccattgaaacctggcagggttgagtgccgtgatctctaaacttctgtctggcttagattccataacttgtgatttgtaatatgatgttgcatttctttttttttttttttttaattgatcattcttgggtgtttctcggagagggggatgtggcagggtcataggataatagtggagagaaggtcaacacgtgaacaaaggtctctggttttcctaggcagaggtccctgcggccttccgcagtgtttgtgtccctgggtacttgagattagggagtggtgatgactcttaacgagtatgctgccttcaagcatctgtttaacaaagcacatcttgcaccgcccttaatccatttcaccctgagttgacacagcacatgtttcagagagcatggggttgggggtaaggtttatagattaacagcatcccaaggcagaagaatttttcttagtacagaacaaaatggagtctcctatgtctacttctttctacacagacacagtaacaatctgatctctctttcttttccccacatttcccccttttctttttgacaaaaccgccatcgtcatcatggcccgttctcaatggtcgctgtctcttcggagctgttgggtacacgtgcagaaaggctgtcacttcacacttggaagattgcacagcggccaggcagaggcgctcctcacttcccagacggggtggtggccgggcagaggcgctcctcacttcccagacagggtggccgggcagaggggctcctcacatcccagaggatgggcggccaggcagagacgctcctcacttcctagatggggtggcagctgggcagaggctgtaatcttagtactttgggagaccaaggcaggtggctgggaggtggaggttgcagcgagccgagatcacaccactgcactccagcctgggcagcattgagcattgagtgagcaagactccatctgcaaacccagcaccttgggaggctgaggcaggcagaacactccaggtcaggagctggaggccagcccggtcaacacggcaaaacccctctccaccaaaaatacaaaaaccagtcaggcgtggccgcacgtgcctgcaatcccaggcagtcggcagcccgaggcaggagaatcacaggagcccgaggcagggaggttgcagcgagccaagatcacggcagtacagtccagcctcagcaacagagggagaccgaaaaaaggaggagagagagggggagagggagagggagagagatgttgcatttctttccgtatgaagtctttaaaagaacctttcatagcatgcacattacagagtttaggaattctgcctttgagaatagttcatgtgttccttttttctaattgcagtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaaggtacttccttgagtattttggcagtaataatgcagtctcctttatctcatgtttggttggaaaacatgagttgcatttcatggtgggtttggagggaggatttttgccatacagttgtgctccctgttgccacgaacctgtggctctaccaaacacacttggagctgggaaacttgttgctcattctgacccagagtggctgatttctccatttttattcctaccgtctggtgcctattggtctaatttcaggagtatgaatttttcagtgttaattagaagaaagaccaaattcattatgtttggatgtgatgggcagtgggaaagaaggagattcatactgttttatattctccaggagaaagctttcaacaacagcacagttatttcttccttttgattttgagaacaaacaggaaatgcaggttctggtgtctcatttttgagacaaagtctgttttgttggagagtagatccaggtaaattcacacctccggtttttctttagagcactgagagggattgtaggtgtagaaatgcttagttccatagttcattctttctcatctaatattcacatgtcatgaattacatagtaataggatagatagtaggatctcatagtttggataataaaagagggtacggtaactgctaaatgaagatacttgctcgttaatttaataaaattccatgttttctctctgtagcaatgtaccttaaaactattttgttctttctctctagagaatttgcctgtgtttccagtttgggtagtggtgggcatagttactgctgtggtcctaggtctcactctgctcatcagcatgattctggctgtcctctatagaaggaaaaactctaaacgggattacactgggtaagaaacactgtttttttagggcaggggtggagggagggaatcagggtttatagaaacttctgtatttaatgaaaaaaggattttaaagaattaactactattttctttcatgtcagaatcaggcagtctccttaggaggtgttctaacatgggcaagtggaaatcagtgggcctgctattaaatgtggaatatgattctaatctctgttccagtttccttcttaggtttggtgagatgagctgctcagcagtctgtgctctgtgtttcaataccatccactatgcaattagtattcttaagacatcacttacccaatttaagagtttaatttcaatttcttgctaataaactcacaaggtggttctttccagttaggaaatataaaaccctaattaagaagttgtgagctggaattagtggcatgtgcctgtaagtcccagctacttaggctgtggcaggaggattgcttgagccgaggcgtttgaatctagcctaggcaacatagcaagatcctgtctctttaaaaaaaaaaaaaaagaaagaaagaaagaagaagaaaaagcagtggttttaataaactacctcccccagcccagtgtgatgatggtgcagggcttttcctttttgtagttcccctaccccactccaagcttaagtagctttattgctttgatcattcttagctagattcacccaaaatgggataataagaattgatgacaaaatatatcagcaataaagaaaaatagactttctttttgtttatggcttctcagatggaacacgtttaagcatagggtgtgtatctaattaaaggaccttctcttttccccactccagctggaaagctaacccatataagctatgtagaactcatgtggtaagactgggagcagaggctggattcaagttgatatagcatgagcagtgttgcagatgcacagatctaactttagccatcctgaagggactctgatgtgaaaggattgcatgtcctgaactctcttgctggtggatggtgggaacctctatctatgggctctgctgatctagagtttttaggagtgctgtgttttaacaagtttgagtgttcaaattcagatattacttgcttggaatgcttctattctgctgactgtatctgccccccttgcatggtgagtgttttatgattaaatatagttggactattggtttcaacatgagactaatccagggtggtgacatgccggtctttgtagttcttgcttcggggttaatgaggggcaggaaagagttccttagactcctgcatggcatcatgaatgctgctgttcttcttaccttggtttttttcctcctcctctaccttttctaccttggtgtgctgggatcagatcctgcttatcttccacttcttaagaaaagctgacatagaagacacattgggactataacagggctgggtctcctcttccactcccactagacacatggtaactaatcacattgcccattactgttaatattcctgtgtatgtattcagcccctctcccttgttgatgactaaccagctagctctgagctaacccaacagctattatgatttgtccatgaatatgtcacatgtttgtattggaaacatgttgagcatactatctggatgaaattggattgtgaagttacatagagtttttatgcacatctgaatatttgtgctcttcatgtaaaatgccattgtgtatgtgtgtgtgtgcattagttttcttttttcatatatgtattatgttatcaatatttaagatcctgactgattatgtattagaataattaaaccattttggttcagagcatgtagcctcccatttcacagaaggaacagtttgcagaatgcatggtatgctttggtcttagtaatgacactttaaatgtgattctccccaaactcctaagttttaaaagtatatatcaaaaggctttaagctgtactgatgacacatctcattggaaaatccctacgctgtaccccagctttcttacttcctggcattcactttccctgattcatttatgagatagtgcttgttgttaaagactactgtcaccgtgaaaaggttcagcctgtgtgacctggcattccctaatttctcattcatgacttcctgagtttttggggggatttgattgtggtattggtagggaataaaaatatggagagaacaagataagccaagacttgcctggatatatatctgtaatttaaaacatacattcagaagaggtttgcctttgattataacaaaagtgaattgccattaagctaataaaaggtaccatagagcttgttcccttaaacctttatcccaaaggagggttgatggcagggggaaaagacaaacagcaaaaggataaatgtgtattgtaactagaattccaatatgatttttgtaaactgggttgaagaggttgtaccatatttgtttctgtgcctcccccagtgatgagttcattgacttagaagaatgagtgagtgtcaggtatagaaaatagtttaaaaacatgtgatcattttgacacccattgttatgttgtcttttgtttttatatatctgttgcttcatcttgccgtcagttgcatttctatatttttgtttctatttatttattattattattttttacatttgttcttcaaattgccaattcatcagctgcagtacatcagagagtttgtcaccagttaagcaggctcctcggaagtccccctccgacactgagggtcttgtaaagagtctgccttctggatctcaccaggtaatggctgattgcgattctgcccactgcactgttccctacagcttggtgctctgtcacttccttgggtgtggaaaagaatactgagctatgagagacagagacagagacagacagacagagacaaagagagagtgggagtgaggaattaaagggctggcctaggaagaccacaggaaaatatgtggtgaagaatctgcttgagtaaagatttccatgaaaccaccaataacataaattgtttactaaccatgtagcttccttgcctcaagcagaattaggaaatggctttgtcagtaaaagattctttaattgcccaaggaaatgaatctaatgaaggagattctttctgtattgaggtactctaagataagaaattagcaaggaaaagttggtattcttagtattgataataaaaccaaaattattttctgtggattctttagaaaaaatggaaagtaagcatttatctgaataattaataggcttgatgaacaaggaatggttttggtttctacttgtagaaagtacagaagagaaacaggttttatttggaagttagcatataatctagctttgtgtgttttggctgtagtattttaattataactgtggcttggcaaaaattccatagcttagttcagtttgatttttctggggtagaaagcatgctaaagaatttggccagttatagctttgtcctaaaaaggtgttagctggtgggaatggatttaagaggaaataaagagagtaacagtgttttgtgggaaaagtacccatagtcttattccatagttgttatatgtggtgaggaaactaaggcattgtgatgttaaattactaaaagcacacacccagttagtgacagaactggggctagaacccaggtgtctagatagcatgttctctaccacagcatcaggctcattacttgttcctgttctatctgtctgtctctctctcacattacataatatatgtcagatacctcagtctactaatttgggttgtgaacaggaatatggttgtaaatgaagacatgaaagttacatacacataggcatagcatctaaaaaagcattggaacatttttattccgcccttgaagcactatggaagttgcttttttgctgaaaacaaaccagaaaaaagaaaaagaaactgtggttttcaagacagtggaacacaaattatgcagcactgtcatccccaaaagaaaggaaacagacaatgtgagccgtgttattgccccagtgtactgccttgaagcagtttccacactgcagtgtaggtggggaaaatggaaactgggcccagctgtctcactcaattgagaaggcggaaatcagaatttggggaggtcaaggaggctaagatttatgaggctgagtaccaaagaaggaaccatagagagagcgtgctaggatgagcacgagcacttcagagatttggagcggggtccccttgagtctttgtctgattacagagttgtatacacataggagaacactctctgaaaccaggggaagaactacctgaaatgcagtaggttgcacaatgcctggtgctcacacaggtgagggactagtttgtgttcctaagagccagagtagagagacttataatacacagggtattggttggggttctcaaaatggtcatacctaaatgggttaaattagtaccagaataaaggatgctatggacccaccataacaaagcttaaaaggaagcctttaaagaatcaaactaatccaaaagtaatttagttgcattttacaacaaaatccaacacgctttatgctacaacaaaattcatcacccaacaatgtacaatttacaatgtctggcaccaatcaaaaactaccaggcatggcctggtgcggtggctcacgcctgtaatcccagcacttagggaggccaaggcgggtggatcacgaggtcaggagttcgagaccaacttgaccaacatggtgaaaccctatctctactaaaaatacaaaaattagccaggtgtggtggtgcacacctgtaatcccagctactcaggaggctgaggcaggagaatcacttgaacctgggaggcagaggttgcagtaagccgagatcacaccactggcactccagcctgggtgacagagtgagactccatctcaaaaaaaaaaaaacaactatcaggcataaaaagaaaccaaaaaataaaacacataagccagatatagtggtgtgtacctgtagtcccagctacttgaaagcctaagtgggaggattgcttgagcccaagagtgtaagaccagcctgggcaatatagtgagaccctatctcaaataaatagatgggtggaaagaaggaaggaaggatggatggatggatggatggatggatggatggatggatggatagatttaaaaaaataataatttaataattaattacaataaaaaatcaggagaaatcaatcagaaacaaattcagaatggatggaaatgatgggattcataaacaaagaccttaaaatgagtattatcaatcttattagtaaacttaaagatgtaaaggaaagcttgaacccaatgaggaaagaaatagatatctaaaacagaccaaaatggaacttctggaaataaaaaaaaattggatggtgttaacaacagattagatactgcaaaaaaaaaaggtcaatcaacttgaagacatagcaatagaaactatccaaaatgaagctcaaagagaaagacagatggcggggtgaaagtgaacagagcctaacacggtgaaaacccatctctactaaaaatacaaaaaattagttgggcatggtggcacgtgcctgtagtcccagttactcaggaggctgaggcaagaaaatcacttgaacctgggaggcagaggttgcagtgagctgagatcatgccactgtactccagcctgggcaacagagcgagactctgtctcaaaaaagaaaaaaagaaaaaaaagaaagtgaacagagcttcagtgagccaccggacaatatcaagcaatctaattagaatccgagaagaaaaagggagagaaaaaaatatgtaaagaaatagtgaaatttttagtaaatttaatgaaaaacataaacacacagaaagcaatagcgaaaattgctgggcgcagtgactcaacgcctgtaatcctagcactttgggaggctgaggtgggtggatcacctgaggtcaggagttcgaaaccagcctggccaacgtggcaaaaccccatctctcctaaaaatacaaagattagttgggcatggtggcaggcgcctgtaatcccagctacttgggaggccaagacaggagaattgcttaaaccacagaagcggacattgcagtgagccaagatcgcgccactgcactccagcctgggcaacagagtgagactccatctcaaaaaaaaaaaaattgactctttacagcaaaaataatgacagcattttatgaggctataacatgtggaagtaaaatgtatgacaacagtagtacaaaggatggggtggaaggatggaagaatactgttgtaaggtccttatattatccatgaaattataatttgaaggtagactgtggtaagttaaagatatatgctgcaaattctagagcaaacactgaaaaaaataaaagagatagatacagctaacaagctctatctccgaatggcaatactgataagaacaaaattctgacatatgctacaacatggaaaatggtaaatgcggatggtaataatatcaacgttggcatcagaacaagaaatagaaccagagatagagggactttttatgatgataaagcgatctacttacaaagaagacataatcctaaatgtttatacttgtaatagtagagcttgaaaataagtaaaactgagagaattggaaggaaaaattgacgtatttacaatcatagttggaggtttcaacaagaaactttaatgtaatcatttcaaaatactcagttaatccaaaagtgagcaggaaaggaggggaaaatgagcaaagggtagatggggcaaatagaacacaaataatgaagtggtagatttaaactcaaccagactgatgattgtattactataaatgggctgagtgtgccaataaaaggtggagatggacaaattggatagaaaagcaagaaccaatcatatgctgtctgcaataaaccactttaaataaaaagatccaggtaggttaaaaatattaatacaaggatgaaattgaaagcagagtcttgaagagatatttgtacatccatgttcatagcagtattattcacaagagccaaaatacagaagcaacccaagagtccatcagtatacaagtggataaatagaatgtggtatatatatacacaatggaatattattctgtctttaaaaggaaagaaattctgacacatgctacaacatggatgaatcttgaagatatgccaagtgaaataagccagccacagaaagacatactatgtgattctactaatatcccataccctacagtggtccagttcatagagacagaaagtagagtggtagttgttggggaaggaagaatagggagttgtttaattggtacagtttcagtttttgcaggatgaaaatatcgtagagattggttgcacaaggatgtaaatgcacttaacactactaagctgtacactttaaaatggtaaagatgctaatttttatgttatatatattttaccacattttttaaacagtaaaaggatggaaatgatatgctacattaacactaatcaagagaaatctgggtggtaataatatcagaataggcttcagaacaagaaatagaaccagggataaagacagactttttatgatgacaaagtgatctactcatgaagaagacataatcctaaatatttatacttctaataatagagcttgaaagtaagtgaagtaaaactaagagaattgaaaggagaaattgacatattcacaatcatagttggaggtttcaacactcctttctcagcagttggtagaacaggtttacagaaaatcaaaaaagatgcggaagacttaacagtgaaaccagtttgagctaatagacatttataaaacactccttccatcaagcgcagaattcttactctttttaagtacacatgaaaattaaccaaatatagaccatattctggttcataaaacaattctcattaaatttaaaagggttggaatcatatagagtacgttctctggccacaatggaattaaacagaaatcaacagaaagatacctggaaagtctcaaatatttcaaaattgaacaacccatgagtaaaacaagaagtcacaagaaaaattagaaaatattttgaactgagtgaaaataacatatcaaaatttgtgagatatagctaaagaagtgctttgaagatttgtagcattaactgtttatattagaaaaaaataaagctctaaaattgatgatctaggcttctgtctgaagaaactagaaaaagaagagcaaattaaacccaacataaacagatagaattaataaagagaagagctgtggaaaaatcagctgacattctcattgtttccctgtaggtaatctgtcgcttctctctggctgcttttcggatcttctttatgcctttggtgtttggcattttatatactatttaattatagattatcccttgttgcatctgcttgtaatttcattggacctcctgagtcttaaggttgatgtctttaataaattctaaaaaatttctagtcacaatctctttgaatttttcctttctgcattttatctatttatctttttatggaactctgattatatgtgtattatactttctctatgctctaagtctcttaacctctcttgcagatctttcattgtattgtctttctgccattttctgcataatttcttcatctgccttcattcactaattccttagctgtgactagtctactgtttagccccttttaaaagtttttaaacttcaatttcatattacaggtttattttctagaaattttatttggttcttttttaaatatacctggttaattttgatagttccttataacttcatattttcaactatcttatttaagcatgttaaatattcttattttatacctcaaaactgataattccagtgtctgtagtctttattgatctgactacggtttttgtttctatatttcttgctaatggtggctattttctcatctcatgggtgttttataatttgaagactgtacttacgttcttggcactttgtacaaattgattgagtcttcatttaaaatatatttactcatgagaagatttgtatttcttctgcctgtgtcttggatactaccaacccagtgagaagaaatgcacaggaggtaaaaaaattttgagaacttgaatggtagactataatggccccacaaagaggtccacattctaatctctggattctttaggatatgttaccttacgtatcaaaaaggacttggcagatgtgattaaattgccttgagatagggagattgtcttgggttatctgggtggctccattgtaaccataaaggtccttagaagagggaggcagaagggtaagcatcggggagagactggaagatgctatactgctgactttaaagatgaagaactcatagccaagaaatacaggcagcttccagaagctggaaaaagcaaggagacagattctctcctagaacctgtggaaggcacgcagtcctattgacaccttgatcttagcacagtgaaacacatttcagacttctgacctgtaaaactgtgagataattaatatgtttttaacacctttaaaattgtctttattctcctccctcaaacttgattgcgaatctggtggggtaggattcccagttggaaatcattttccttcagcattttgagtcattgctgattgttctggcttccagcattgtggcttagaagctgatgccattctgattcactcttagggcagaggaaggtagggtcatctacctgagcaaagggagagtaaagaccagaaccaaactggggctcttccagccaagtggagtgggaggctgggttgggaaggtgttagataggcactacctagagtttagagtgttaaggcactgtggaaaaaaataagaaaattttttttctttgtgaagcttagttttgaatgagattggtataaagtaatttttgtatatgtatttgaggagtagttggttttctagatccttttctggatatcgttgatgctctgtatgcaaaaggtaggtttttgggttatgttgttaaacagtgattgaatggaatatttatgtatttgtcaactatagtgcatagcatagacagggtaatgtttcaagaagtagttatgtgcgtttttcctttagtcctcacaacagtcctccagggtaagttcttctgttgtctctattttacacatgaagaaactgaggcttagttaggcaagtcacttgctcaaggtcagtagttagtggctgagccagatctgtctggttctaaggcacatgtatattttatcctgtccaatttttttcacctctgctttgataatcagtatttgtctcatttatctcaaagaaagtcataatacatagctgtgtttcatatttatattttacttaaaaaacagtggaataaatactaaaaaaaaaggtgttctgtcagtagtcaatgagcacatggtaaaaatagatgttctttcttagtgattcgtgctaggcttttggggatgactcctctaacacctgaaggactagaatcaaattaaatagggctacaggctacagagactgtgaaaggtgtactacaggacacaacataatgactcctgagcagttaatttgtagttagaagcaggtctctttgcttttctagaatcctttcttcctggaccttctcccccaaccttcaccagttatggtttttttattggaataaataattaattttggtacaagtaaacttcagaggtaattttatctctagttgtaactaaaataataggcctatattaagcaatgtgtttcttgaaacattttcaatagctaaggcctattcatgcagaaagtagctgaaaacatactcagaccaatttttcactttattgttgtaattctttgtgtaaaagcaaagataaataaataaatgaaatggagggtggggagggtgagtaccaagagatagagtaaaacagctaggttaatgtaggttttgttgttgttttccttctttattatacccaaaagtgaatgtcttaacaatggtaggttcatttcaaagttgatcgtggttctgtggatcctcttgaagtcctgagcagcctcatttgccctcaaaatcgaggtgctgaggcatgttccatagagactcagggctccttccacctctaaatagcactcagaatcaaacttcatagaggtgttctagattgagctagatctgtcagcagaccccaatctcaacctacatctgcagtttctctgcatcctttctttcatccatcccttcatccagcacctgtgttctgccaagttctaggaagttaacaaagtccctgacttaagaccttattatattctaagggggaagaggaatgaggataacatcaggcagtggtaaacagtttgaagaataccaagtccatcagcaggaagggatttcttcagtgttttcccatttactttcatgagatagttgtattcttttgacatgaaagacagtactgtctcacatgaaagacctcattgatattttaacatttacagactaaaagataattctgtgttctttttcctctttactttctctgttctcattcttttctactcacataatatatcaattatctactgctacgtaacaaaccccccaaaatatagtggcttaaaacacgcactatttatttggctccccattctgtggattggtcgagcagattctggtctggatgagctcagctgatctctgctggctcacttgtgcatctgcagttggctagaaggttgactggtagctggacagtctacagtggtctcacttacagtctaaccattggcaggctgttggccaggcagacagaggacagctgggccatgcatctctcatcagccatcaggctgactttggcttcttcacatggtagtggtggctgtgtgggtcccaagatcagtgagagtggaagtggcaaggtctgttgaggtctgggtgtggaaactgcacagcatcactgctgcctcattctgttagtcagagctgatcacaagatcagcccagattcaaggggtagagaaacagatttctactcttgattggaaggacctacagcattatgttgcaaagagtaagatgcagagaaggaaagagtttgtagccatttgtgcagtcagtcacacattgtaaaccccttctcccatgaacataccctaaaactcttagtgagtttttaggaattatgatatggggttttattatctaagaatttatataatttaatgttgggagttccgtcctattcttggaaatagctgttaccagggaacagttagtttaattctgttcctagtagaaaacagtcttttttttgtttttttgagacggagtctcgctttgtcacccgggctgaagtgcagtggcgctatcttggctcactgtaagctccgcctcctgggttcacaccattctcctgcctcagcctcctgagtagctgggactccaggcgcccaccaccatgcccggcgaatttttttgtatttttagtagagacggggtttcaccgtgttagcaaggatggtctcgatctcctgacctcatgatccgcccgcctcggcctcccaaagtgctgggattacaggcgtgagccaccacacccggccgaaaacagtctttttaacttccttttgttttttggtggggttagcatttaacttgtagctttctgagatgaatatagagggtctgtatgattattaaccatgtgatctgttaatatttcctatgacagccattatagactaaagataaacacacagagtttgactatttaatttacttgaccagttacctcagtgcattttaaagtatgtttgtgtaacaagacgttcataataataactaacatgtattaagtactgtctgtgagacactgcctaagttataggtatcatcttatttaattttcataacaacaaaaaacaaaaatgtagatattattagtagtaccattttagagatgaagaaacttgtgcttagaaatttacaaatgtgcccagggccacgtgaccagtgctcttctctaaggttcaacaaagacgatatcataattcagactgcagatctgccaacattcaaatggctctagtcctcgagtgttattttctaactccgcttttagatgcaccattgtatagcccttacaactgggcctgtcccttctgtagatgtgggagtagctgaactccacagaaccccaggttacacactaaggacacaggttgttagggctcctggatgagggtaagtgtgtttattttaaaccacgtgcttttggctattgagcttatgatttcaaaggtgaaagcttaagcacgttattagacttctcaaggagagttcccctagattgggagaaaagttgacattgggtaatattaaatctttcttttaaaaccagggctattttgttgttgtttacaattttaagagtctagactgaaagagtcatgaaatgcagccacctatctgacctcttcccccaacagttagggaattcgctctgcccccaggccacccaaccttcccttgctctcctgaatgggaccctgacaattccctggaattgtaacctcttccttactgctgaggctgagaagaggatcttttctactttactccatttagggtttttctttatatctgtgtagattgtggctttttgttttttctttttaattttattttaaaacaggaagaacagttatctgatattaaaaatcaaggaagcaatatttgtattggtcacaatacgctcagactaaaagaattatgctgtaagtagttgtattgaagaatatttgaagtgcttttaaactatttgtttaaaactatacctatttgtataacgtgaccagatcaaattgattgtatctttgggtggcaccaaatatgttggtttcttgcatggattgattattctgaagctcatgatttctgtgggtctcaggtgcgtggaagttcccatcttagtccttaagactcttaccccaattgtaagagctgaggaattctgtgatagctattaagataagagatattcctaagaaggaatatattattacagaaattttcaaacatcaaaaaggtttgaaagaataatgtaacaaagccccatgtacttgctttaactattgtcaacgtatgtccaatcttgtttcaaagtcagtcctggatgtatcatccataagaagtcttcctgaagacattcaagagggaagtctttgctttggaaccctgatgtgatcacgttaatcattgcttctatgcctgtagctgaaggaaccgccagcgttttcagtcctctaatccttctgcttcccttttccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacatctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctg

SEQ ID NO: 37370 - DNA, 145845 bp, Homo sapiens; identical to SEQ ID NO: 36113

SEQ ID NO: 37371 - DNA, 8868 bp, Homo sapiens
cacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggtgcgctgcgtgcagcacccggcgcactggcgccgaagggcctgggggttgctgggtgccgctgcgggagactccgcttttcttctcactggagataatatgtggggaaactgaaggcgctccgggaaaggtgaaggcggtcgccggagggaccctccccagccggccctctacttgctcgattctctaagtgcagagtacttgtaaattgcaaagcgctttcagtgaaaatgggttaaaggtttccggagctgaggggagcggtaccgatgtttagctgttggaaagatcctggacacaggagattctcctcgccccgcacgggggtgcacacggactgcaatcccagggatgcttggggatgggggggatataggcggatttggaccaaggaaggtgggcaggcacgttgtaggaaatagtacctctcttttaaaatactgactttgcacagccttttggtttgcaaagcaatgtctagtcccggtatgtccaaaaacaagtaaagtggattcgggttttgatatcttctgcggttggaaaacctgaagctgaaaaagaagtaacttcttaaggttacccagcggccacaacagagtgtaggtttgaactccgcgtgccactttcagtaccataccattcttacaactcgggccacccctgcacctgcgccgacctcaaacaaacttccaggtgcgtggtgggtgcgggcaatgtggactaagtcaatttcaatgacacggaagggaattggaatcagtcctagggctgtctcccttcttaatctgaaatgggggggggaatgagatgttgttaaggggagccccagaagaggaaaaatgcaaacatttggcagagttaccctcttggcttagccactatcagtatcaggcagacagcgactctggtaagggcatcacattgttcccttaaaaaaaggagcgggggttgtttaaatggatttggcagctgttctttcaagcattcttagccagcctcacctagttatatgagaaataaagttcctgccttgcacagctgaaggctgggagaattctccccatcctaattcccccaactccccaacgatcacgttggacagatgtcactgggcaggcccccatctagggctagcaggatgaacagtccctttataatttatgtagctgtagagttccacgcccgggtgaagttattttctggctcggcaaggctggctctgttcacccctgagaaatgctggattcatggaaaggcaagatgcctgaaacatacactggctctggtcagctgttaaagctgctggaggcatttgtctctcggggcaaagttatgtcatttgccaagtgtcgtacattattgtgcattttggggtattcaaaaagtgatcttagaaatactgatacacatcgtcattcttgggctttagcaatcatcatgattaccaccttagtagcactgtagtataggttgatgtgagttataagattataaaaagatctaagtgacttctagaatctatttgacaaaaaaaggtaaattttcgacagtcaaaagtcacaattatctgttgcttaaatagaactgttttgtcttcatgccctagtctgcagcccaggcattaagaagaaaccaaggaaatttaagaaattactcaaggttcttagaaaagaagtataaatacgtttatttacatgttcttagagtatttacattcttagtatctcttttatctcagtatttccttgaaaaagaaagcaagctaagattaaaagaaattgaaaccaaatcctcgcaggtagggacctcctctgtgaggctctgtgctggaccctgggaatgtgtgcttcccaaggtatgaaaccccttggggaactttacagcaggacctcagtgagctgtttggcaggtgaggaaactaagacccagagaggagagggactttcctaaggccctggtgagtgacctgccagtagccacttccaggggagagcagagcatctgcagccaaatcattgcagccccaggtagctttctagaatagactgtggaccagatgggccacctgagctccctgctagggttacacattatagccctgtttgttgtagtagagaaatttcatgactctcaattgtggacttaagccgatgcctccagaccttggcatggtccacaggccctgggagcatgggctctgaatgtagcctttgatccccatagcggtcttacagcccctccaagttcattctgaagaaggaatggagtgagaatcctggctgcagatccagtcttgaatttagtcatatacttaaaattccaattcaactgttaacattccagcatccattttaagcatcagactttcttcatttagcactttttattataaaagggagatctgctggagggggatttctcctaccccacccccacccagggaaggaaaagctctttggcacttagaagtctgagccgtgagtgggactttggcattgtctgcatccatgtgctgctgtgttcacccggggtgaaaaggactcacttaggcaggcaccagcaagatgcacagggtctgtgtagaccttgagttttagagatgtaacggggacctagaaaacaagccaccaacatgcttgcatgattctgagcccctgaggcaaaacgctttgcaggtaataattcagttttcccatctgagctggacaccaagctcttataagcgtgtttacctggtagcattgaggacggtactggtcaaccttggaattcccataagggcttgttacaactcagactgctgccgccactccagcgtttccggagtggagaatgtgcatttcttccaagtccccgggctgccgctgctcccgcgggtgggaggaccacacttggagttgactgcaaaatttctgagccggcgctgcagcagcctcccgtggctcaggtctgccccctgccggtggaagatgaagcatactgccttcacctactgaggggcactgaagcgtttgtctgccttctttagttgcagctacttaggaagagcacctgtcagattgactttcaaacagataacttcttgaggtagagcaaccaccatgtagtgagtagtatgatggaataatacttcatcgaggtattttaaaaaaaaaaactcacttggattgccaactaatattgtcatttacatgtgacctggttgcaacgttaagatttttaaaagactgtgatagatattgatgactctcatgtgtttgtctctcttgggcgttttaaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatgtgagagcttttcctcttgttaaaggaggagggcaagacctgccaagcctgggtactcagagcctcttgagggcaattcttactcaacaaaccccagcgcctggctgatgggtgggcaacccctagcccctctgtgccctacctctctcctctccttacataaagaatattgacccttttggagaatcttatgaggatcaagctgaaataacactcttaaaagcatatgggatgtcataaagacctctgcagataatgaaaaatattctcataaagatagttttatttacttcatcctctatgcttgttgacctgctattggttccataccagcttctgtgccttactctgggaagagcaaaaaggagacagggagtgatggttagcttattcgggggactttcgtgctacatcagacataaggtatctgaggagcaaattacaggtcccacttttggtagttgtgcagcatcgtaagatttttaaagcacacattctagagtaaaaactgtgactctgttgctctggtccttcctgatccccagggtccctgccgtagagaaatggaagacacactgaatcacctgaagttcctcaatgtgctgagtcccaggggtgtacacattcccaactgtgacaagaagggattttataagaaaaagcaggtgagtgaggtcctcagtgtgttttcttcctcttctgttgacacagaggagaaacccatctcaccagcccccaggctcttctggccatagctctaactctgagcctgtgcagcaccagtgcccaggacttggtgccagtctcaggaggtcagaccaagggctgctttgacttgttgctctgagtgctgctatattggccataatcctcaaccctagtgcctttccaccacccgcttcccactcctgtcctttcaatggttcacccacagggcggacaagatgctgcccagtggcaccctttataaactgcaagtggacatgttaacacatttgttaatgctgcgtcagggagtgacatttcaaacaactattatagtcagtttccaagaagtgtgacatgaggtcataccacaaaaagcttaccctgaaatcccacaatcgtcccctttcctactgatgccttcccgatagtgagcaggttgcaatattaagattttgaaaaggctgttgctagatgttggtgactcgtgtgtctctgtctcccttgggcttttcaaggaaatgctagtgagtggggggatgactgcagcatggccagcttggagagcccagccatccccagcacataccaggtgtctgtcttggcgtggaggggatggaacttgaaatcagacactcggtccatgctggggatggccagtctctccaaactggccatgtggtcttcctccgactcactggcatttccctagaaagtccaagtgagaagaaggcatgagagtcatcaacatcaaacaacagtcttttcaaaatctttatattgcaacatagtcccattcctggaaaaggaatggagtgagaatcctggctacacatcagccccaaatgtagtcatatgcctaaaatcccaattaacctgaaaatgatcaaacaaatttaagatatagtaatattaagctgtaataaatatgcttctataggctttgtgttatgtgatggcactatttcaattggctttctaattggacaattgatactatgctatctacagaattggcctttggagacctaagtgagccacagtggcctcagggtgaccatatactaggattcatagtagtggccacagtcagaaagcctaagctttcctccattgccattgctcgtttatacccacgttttctgtcaaagtcatattcattcaacaaagtcatactgagaaggtgtcatgtgaggctggatgtgggctccaaagtcatagctgtgacattcgcaggcagcggggatgttctcagtcccacatttggcagagaagtcagtcaagaggttctacaagggctggtgtccaccttatactcctagaaacacaaaactgcccccacccccgctttcttggagcaggaagttacacccacacgcatgcacaggcgcacactcagcgggcctaggcacgcatggctcttgtgttgccttagctgaaatttctgttgtgctttctcagcatagcagagtcacgctggcaaaccatcatgcgccctggccaccgacctgacaccagacccaggagcattcacttctctgtcttctgtttctctcccacagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagggtgagtactcaggaggggcagcctggggctccagggcctcactgtccttggaccagcctcaggggctgggcgtggccactggcccttccccaggcttacagacccaggagctgcagctcagggccagaaagagcaaagcaaataggacagagccctcagaagggtgcagggagagggagaccccatcaacccaaccaaacaagtgtggggaaggaggccggccagtgcacctcagggacactctgctttatctcagatacctcacagcacctaagctatcattcatccacacacaaagtgaagattttcaaagttaggctttacccgtgaggtctggaggtccatttatcttcacagagaaaccgttttaatccgcaagaacctgctaaagatacatgtttctaaattaaagatgtgaatgtgagacagctgaaatagctcagttgggagagcatcagtttgaagatgcagctttttttttctgtaaaatatataatgaatattctgttagtctgtggctaatataattttaataaagttaatttaaatctgatagaaaaatgaaattttaaacgataattttagagaatgctattatatccagtcttcttttttcttttaataaatgagggaactattgggggaaaggaataaatacattttctttcattttattaagacaaatttagtaagcagaagaaatttgcatgtttagttataagggtttcttttttccttacaagttggaaaaaataattctaatttaagggtaactctttgacaatgaacactgtgagcagcatctggtactcgttgctttgtttgaaaacatgagttgagaccccagccctgcacttgcaggcctagtgccattagcctgcaggctgtgctggatatctcagggcaagagtcgagcccttttgattttggggggattatttcaatatatttctttttctttttgttttagttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaat

SEQ ID NO: 37372 - DNA, 6380 bp, Homo sapiens
cagaggtcagacggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcaggttcggagcccgctgcccggcggggagaaccgccctttctcgtcccgcttgtccttccctttgctgacttatcacccttcctcccagggataaaacgctcctgaaggagaagaggaagcgacgcgaggagctgttcatcgaacagaaggttagaggctagggaggaggtgtcttattaaaacaactcggctcagggagaattcctatggtggatgtaatttgggttggcaggatattggagtggggaaacagtcaccaagattgcctctgacagtggtggaaagatgctcgggccgggcgcggcagtactttagttggacgaggtgggcggagcccgggatgtcgaggctgcctggagccgagatcacaccactgcgctccagcctgggcgacagagcgagaccctgtctcaaaaaaaaaaagttcgtctcctttagtgtccaccaactgaaaataagaggttgctgtgagaattaaatgaggtgatttgtaaactgtaagggctgtacagacttagtgtatggttgctttgctgtctgatactcgacacagagagctggctccaggcagacattacttaactgctttcaatttataacagtgacctgagggttagaataccgtgggcaccctttctagttttcatcaagtctttcagagaatgtggagttttgtggacccggtcttcccatagcttagaggtatgggggcagtttccagcctaattcatttctttgcctagatgtagggcattcttaaaagcggtaacttcagaagcaactccggacatactatgtacatgactttctattaattttaaacgttttcattccaaaagaaaagaaaactccttccagacactattttggagaagttaaccacagcttcacagactaagtaagtaatggatctttttatattacttgcttatatacacccatctttgaattatatactggtacatttatttgaatccatataactgaaggaattgtagaacccaaattcaaaagctaccttggtatatgaatttgatgggaaagacggaggtaacgttctacttcttattttaccatttatttttgttcattcccatagctagcttttgaattcctgatcccattgtgttcattcagtacattttgttgactgcctgtcattgtactagggcatagtgggtggtggtgaataaaaagtgttttgaatcatttagtggggtagcaggcacttatccacaggctctgaaaacttgatttgtcccatacttgccttacctgccaccaacctgtccttcctgttccccacttcatttagcatctttggtgttttatggtttaaagcgaaaagctatagtcgtctttgggaattgatcaaaccctactaaatttagccttctaaatttttttttttctatcctctttttctccccttaaggctttaaattcagaaattcagcccccttttgcttaggccagtgactctcaagttttcagtaaaaaaactttaccaaagagttactcagatcctgaatacattaaacgtaagagcaaatctatttggtggcaaattccctttcatcttttaaaaccaagctcaagtgtcacctttaccttctcatttgcccccccccacctcccatcacttccgcttttgtgtggcctttctcctgtgcaaatgcttctgtattgtattctgtccatttacatttctctctccattgggccacagcccccttgaggctgttccctgtctcctgtgcctaaactattaaattaatcctttgtgatttctccaaatgaaatgaggcagacctactcccattcacttcatatttcaaatactttataacttgttctgaacaagtgtttcacttgaactccattgcccacagcattttgctgctttgaaagcctgctaataggctctcagattttaactgtgaagatcttccaatgcttgagagttggtggcagtgtactagggagtgactattgctttccaaactgatgagagctcctgagtagaaattgagggtgttggtaatgaaagggggtgtcttacttgtaaaggcaaatgaaataatataacatgttttgagtaatctttactgccattgcagtcagtggttttgttttttttccttagcatcaagaaatcgccaggaaaggtgaaagaaggtatgactattctaatttaactaacttctcatgtaagtgtcaagtgcacttgcagatgtttccagtcaaatatgaatggcccttagaaagccagcatgggcctggccaaggttagctggggcctattccctgtatttcatacaaataaaaactgcatccacattggtgtgtagtggatgcttaaagtgaactccagtaaatttcctgatttatttttacgtgaatgctaattagaaaatgtaactctattttttagttaatttgcaaaagaaaaatgaagactgtgaaaaaggaaatgactccaagaaagttaaagtacaaaaagtacagtctgtcaggtaatgagtcttttgtttcatttgggatgtaaaggagacctttaagagagttaaagtattggctaacatgggaaaatattttattttattttattttatttttatttttttatttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgggaaaatattttaattagtagtaatttcagattgtcgtctctgtggaaaaaccaattttgggccgggcatgtttgcttacacttgtaatcccagcgttttgggaggctgaagcaggtggattgcttgagtccagaatttcaagaccagcctaggcaacatggtaaaacccagtctctacacaaaataaaaaaagtaagctgggcgtgctggtgtgcacctgtattcccagctactccagaggccaaggtgggaggatcacttgagcccaggaggtcgaggctgcagtgaggcgagattgtgccactgcactacagcctgagcgacagagtgagaccctgtctcaaaaaaaaaatcggttttcataaaaaaataaagatcagttgaacactttgtctttgcaggtcctgcaggttaagttcaaaaacttttttttagtggttttattattgagaaaatttcatttcacctctcccaatagatagatgtttatttcaagatacactgcagcctactgtcagcacttcaaacttgccagcctactcttattcaggcagtttaatttttctggctgctgaatgttcctccagtcaccagcccttatggtgcatggtgctgatgcaaagacagtcattccaatggaaaggttgttcaccactattgccagtcatggcaattcttcaaaaggagtcatttttcacaaaattcaacctttccctgacaatatggccttatcttctattcttatggtctacagaagtcacagagaaagtgcctattgctgttactggaattttggccgatactgtggacgatgtctgtagtatctgtcttgaagtccacaggcattcatttgagttgcattcagtacagcttggtggtccaaatcattacttgcaaatcggtgttttagccacaagatcaaatatagaaacaaatgtaaagcaaagtgcaagaccatgagaggaattcatcacagtatgttggacttttcatttggaaaaacttatttggcacaatcgatttggaaatcatgctgtcaattctcttttactacatgtatccgaacaatttcctgttaactaatgttttgacttttggttttagtatattttagtacaaaagtccaggaacaagttcttcagttggatctatctgagatgctgattgttcaactgatgaacaaaaccaccatgtgctctactaaaatatgagtgtctgtttcttgtagtccttgtaatttagttttatcctatctgtgcatatataaaattagtttcatttatcactatgagacaaatgataaaaatattttaaagtaagcatgtagcctgggcacggtggctcatgcctgtaatcccagcactttgggaggccgaggctggtggatcacaaggtcaggagttcgagaccagcctggccaacatggtgaaaccccgtctctactgaaaataaaaaaattagctgggcatggtggcaggcacctgtaatcccactattcaggaggctgaggcaggcaagttgcttgaacctgggaggcagaagttgcagtgagctgagatcgcgcagcctgggtgacagagcgagactctgtctcaggaagaaaaaaaaaagaaagtaagcatgtgtaattcttatttaaccttttatattgatcaacagccagaataaaagctacttggccgtaaggctaaaagaccaagatctgagagattcaaggcaacaagcagcacaagccttcatacataattcattatatgggccaggaaccaacaggactactggtaatttttttatggactatttttctcactttttactgcaaataaaactgtgaaatgataaatacctttcttttctagtaaataagttcctgtctcttgccaacaagaggttaccagtgaaaagagctgctgtccagtttttgaataatgcttggggtaagatccagctttattctcctgtctctaatagctttatatgttgaataatgttcttttgaaggagatagttcataattatacttttcccccttataatggcttatatattaagttacttgtgaaaaacaggtcaatgtagtatgtatatacatctaaagtataataagcccacccagttttagtaattacattcatatagagtaattaaaaaaattttgaattatgtttttctaatatacttactgcagaaaactttatattctaggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatcattttaaaggatcattataaaaatcataaacctatttgaggaagtgctcaaccacatttcattcttctggagtagaactgtgccttgcaatcctagaggaaaaagtggtttaagaaggaattgttttctttttaatatatttaactgaattcaagccatacccacatcagcaacagcacctcttctactctccccgggttagaggggtggcaaaaatggcacggactaaaaggagaaatggatattccagcaaagtctctaactgcagcctgtagacaatttgctattaaagattcagtgcacaaaatatagctaacagcttttaaatttttacttttaaccagtctggggatttgcttgcctggtgagtctcatatgccatattatgaatatgaaaataatgaagttaatttcctgttgcctttctgtgtcagccacaatatcaggtctaaccctaatccagggatgccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcaatatagtactcatttaagcacttaaaaatggaaggtgtacaaagattaaattaagacacggtaaattgactaaatatttggtttttatataaataaaggtcataaccacaccgttgacatgtaatactgttataatacaacagttaaacttgtg

SEQ ID NO: 37373 - DNA, 38802 bp, Homo sapiens; identical to SEQ ID NO: 37140

SEQ ID NO: 37374 - DNA, 212143 bp, Homo sapiens
gccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcaggtaagcaggcggcggggatgcgtcgcgggaggcctcggggatgctgcggagaagcccggccgccggcgcccccgcgcacgccgcccccgccgcagggcccggtgctgcggtcccttggccgccagggcgctccgcggggctgccggggagtcggtgcttggggtcttcccgcggttgcaccggaggacacccctgcggggtgcggccccgaggcagcgcggggatggggaccccatttcctcgcccgcaagcgggcgccgggtgaaaatgggaattggcttgggggcgaggctggcccagactccgcccccgccctccttttggggccccccgcggggactggggctgtgtgtgttgttttaatgtcagggatgatgtaatcacttaataattgatgccccgtgctgcttccctccccacccaacccctgccccactcctccacctctcggcctcctccctcggcggcggtcgccttctccaacccatcctcctgcctatttctggcacctcccttgcacttcccccatcctccccttcactcttcctgtgccaccacccacccacccttcccctttcccctgtgctggagccttccctcctcttcctctgtcccccacccctctgctccctccagctcttttctccttcctttccggctccctcgctggatttcctctctacttccctagatccatggctgtttttgtttgggctcctcccctctgttatctctgcggccacaggcggaggggactgggccagaaggaggccaccgagcttgggcccagcagagatgtgctgggactcactgggaagagggataataaaatcacccttcttgcccctccttcccccaataaatcacacagactcgccgggtgtgtgagtgtgagtgtgacacaaagagccctttcagtgcatagagaggagacacacaaagtaccctaggataggcacgatgcttcttgtctctcttccctggggcttccctttctttcccatgaagcagttgatctctctgagtctttcctgccacatttaccaaaaaataaaagaacccccggatgccgggtggcaggtgtcggcattttgctgtgttcagagaccggtagtgttgactggcagctgcagtgtttcttagatttaagggaacagttatcccagcagtcttaagagttgctttacttttaaggtagcctccccatcccctcgttctttcccctgtccttttgggaacaagtactaagagctggggtagagtagattggtgtgggggtcacaagaattttgtttctgaatcagaattaaattgttatttgataagagggaggcagcctgaatggcttcttctctcaagtctaagagggcactgtactgaagtcttttgaaatgaaatcctgtctgcccagtgatgttgttttacccttttattgaagtaaatacctggggacgtggataaaacggtctagagttagcatttggaagaccactgcagactgcctcttgcctgcttcaaggtagtcttgggacgcctacttcctttctcaccacccaagcaactgcaatactttccaccctatgtactgtcttcttccccagtccctgctccatgggtaccctgtattcagatgaagggactcacagacttttggaggaagtggtttaactatctgaggctttgaggccacttggctatgaactggggctgtagagaatcttgactgaagtctaaaccatttgatgttccctttaaggaagaaatgttaatgtaaatctgggggcttaatgttccgttttgtaagccagtgactattacatgcttaatcgatattgtcaaaacttaagttgaacctgttctttcctaaaagtatggctcctcgactatttttataagtaacagaactgtaggtttagtcttcagtaattttattagaaaagagttatgattcattaaatatttacttacacactttttaagaacattcatcgtggaactttttacgataaaaaaagcaatagggttaatgagtgtactgtaaaaacaaagggtcgtttgtttgatgccagacccaggaaggaaagccagagcacataaactcacactctgttgaccaagtttaagagacttaatgataaggttgaatgtgagcaaatgcacactctgctttctcctgggtctggaatctccaaccccatctgacttgctcgaagtcctttttaacctttggggcccagctcaaatgtcatctcctctgtgaagccgtttccatcttctcctttccaaacaaatcatcatgttttggtttcaaactttggcagcaggcattatgtttcgcatgagtctatttccaccattaattggtcagcacattgataaaaggaaccttatcttacttatcttgtttcctaccaagttttatcttagcgggtattctgtttcatttaacattaaacaaatgtgagttaggtctttggtatgtgctcaacacctgtatcaattaggctaatgttagcaggtgtaacaaataggcctgcaaatatataatggctcaaaagcaatagacgtttattcttgctcatttaatagtcaaaaattcatgtttctggtcggtaggtggctttcctccatgcagtgactctgggtcccacacccctatcttgtagctccaccatcccatagcttatcatcgtaacctgtttcagtttacagaaggggcaacagagagtagacggggcacacccacttttaaaataccttagcctggaagtgccaccatcacttcctctcacattctttacttgagggctagttatatggccacatttaattgcaagggagcctgggaaatgtagtttagccatgtgctcagaaaaaagatacagaataaatgtatttttattgaacagctttgtcaaacactgccacttatcaaggcacattcactgccctcaagaaacttataggctaatgggaattaaatagaaacctagagcggacacccgtcattgcttttcttttgattttataagtttagatcttttcatcctaagcatgtttcaaaaatcttactttttgtcatgtttcaaattttatgtttcaaatgttgccaattcctactcaataatcccatgtgatacaatcatctgatgcttcctgtgttgactttgatgtggttcttttactccaaaagcacctttcttggcttcatttttcatctggtcattctgtagactcccaaagttgctaggagagtccttagaaatcacactccttctggatgttgcagctcacgcctgtaatcccagcactttgggaggctgaggtgggtggatcactttagcccaagagtttgttatcagcctgggcaacatagtgagacctcgtctccacgaaaaatcttttaaaaactatccaggcatggtagcatgcatctgtggtcccagctactcaagaggctgaggtgggaggatcacttgagcctgggaggtagagactgcagtgagctgaggtcataccactgtactctagcctgggctccagagtgagaccctatctcaaaaagaaaaacagaaatcacagtcccactccctcttaattggaagaggaaattaattagcctgagaggtgaaactccttgccccaaggccttgcagcttcttaacggaagggcaggaggctcagccagccagctcttcaggcccacatgggtctcctctgtcactcagctgccctctttgtctgtgagtcttgcatattccacggaggttaagtgagcttccaaatctccatgagcagggttctagtgttctgggtagtccctgttctccacaggcttccaaattgttggagcaattccattcataccagccatcataattgttaatgcacttttttttgccatgaatacttcattatattcatctgttctgcagacattagcctagtatgttactttgtgcaaggcactggggagatgaggtcctggaaatgaatacttctgctgtccttgcttttcagaagttcacggtctactagaagagataaaaataattaataattgttaacatttgttgagcatttactatatgccaagcactgtttaagctccgatcttaacaataataatatgaagtggtttcacttataatctccgttttacagatgggaaattgaagcaaactttagtagcttgttaagtaactaattcaagatcatacagctactaagtggtagagtcaggattcaggtccaattagtttggttccaaagcctttgcccttagccactaggtaatattcaaaatactacatataatgatgatattaaaatacgttatgtgccataagggagggtgactgaaatgctttagaaactaagacttttggttgatgagaaatataattttatagccaaatagaaatacaatattcatccctaccctccttccattcagacacttatctactacttacctgggaaatacaaaattaaattaaacaatggtaaagcaaggcatgtcgatactggaaataattttactctgtgtgattatttaaagctgggtctttctgtggtacacaattaggtctgtataagtttatgaattgtctacatacttactcatttaacagcattcattcattgcgtattctatttgccagacaattaattcgatggttcaaggcaaaagagatgtgatcctgtcccgaaggaacttacttgctagttttgcagagctataaaggagtctctgaccaatgttagaaatgctgggattttaggggtccatgtaggatggcagagagtgtgcagaatggagcatgaacctggaaaagaggtgggcaagtgggatagccaagcagagaaggctggaagaggaggggtctgaaggcaagatgagtagagatggctaggtgagtgttgtgggaagctccctgtcccagaaagaacagcccagagggcgaatgcacagaccttttggggaactgcagttagttcagggctgtttggagtggtacagagatggacaaagggaaatgacagagctgaaggagaaactgagaaagattcttgtacgtactttatcctgagtgccatttaagagttgtaagtggagatgtggctttgatgtgattgtatttttataaagatctggccacagtatgggcctttgaccgagggcaggcagaactaatgcagggaaggtagttatggaaacttaaatgagtagtagatgagggtctaaatggaaggaaaggaggtgcagatggagcaaaaaagaattagagagcagtagacagggtgtaggggtaggtagaaaagaatttctctgggaaattaggtagagacaagcagtccaataaggaaagcagggggcaggtatctaagcgatgactttatcttaaacactttagacttccaggtgtagtagctcataggcaggtaaatagagaggtctggagtgagggaagaggactaggtcttttttttttttttttttttttttcccgagacggagtttcgctcttgttgcccaggctagagtgcaatggcgtgatctcagctcactgcaacctccacctcccaggttcaagcgattctcctgcctcagcctcccgagtagctgggattacaggcacccaacgccacacccggctaattattggggtttcgccacgttggccaggctggtctcgaacttctgattgcaggggatctacctacctcagcttcccaaagtgctgagataataggcatgagccactgctcccagccaggactaggtcttgaatataaattcgttagcaaacaaattacaaaaattgaagccatggatgtgggtgaggtcacccagggagaatgtgtggagtagaaagagcagaaagggcagagagcaagcccaggaacagaggaggagtcaggcccagaatgggagaggagcctgcggagtactagaccagcttcagagttgagcaacataaagaacaaaaaatgcagttggatttagcactgaagatatctgaacctgcccaaagcagcatcaggagaactagagggggagaagtctagaaatctgttgctccccagccagggtaaaaacacatatcaaagcctgtagaacatacaaccatgaaggactcttgcggtttttcatgggcacaggccatggaatcttagagatcatgtagtcaacatgttcattttactcgtgaggaaaaatgaagttaaatgaagaggttaagcaacttgtccaagatggcaaagtcaccaggtttcacacctctcagcccaggtgtgtggtgtggttaagagcatggggttggggccgggcacgggggctcacgcctgtaatcccagcactttgggaagccaaggcaggtggatcacctgaggtcaggagttcaagaccagcctggccaacacggcgaaaccttgtctctactaaaaatacaaaaattagcccggtgtggtggcacaggcctgtaatcccagctacttgggagcctgaggcaggcgaatcgcttgagcctgggaggcagaggttgcagtgagctgagattgtgccactgcattccatcctgggcgagagagtgaggctctgtctcaaaacaaaagaaaacaaaacaaaagcatgaggttggggtagggtccgggtttgaccctttccagctgtgtgggctgggccaagttacctggtctctctgtgactccttttcttcatctttaaatggagatagtagttcctgcctcagagggttgctgtgaggattcagtgagttaatacatgtcaaatattcagaacagtgtcctacacataggaaaagctatgtgtttgctgctgttgttaatccatatgtatgtgtgtatgtgtatatatacacatatgacatacatgctttagggaagggatgatgacaatatattgtgtgtatgtaaggaaactttgaatattttagaaagagatttgggtgattgtcggttctgaatcaaaaattgttagaaaagttgggaaatttacttacatggtatgattgaaaacagcatttttagtaagaaatgcagcaccttcattcttgagaacggaaaacatgaaagcattctgacgttaaccctgtaaaagggtttcttttagtcagataaccagaattttaacctatttacaatggaaatccctcgagtttgacttcagaatgtcattgtgacttttctaaaggtagaatgaactataaagtaagaaaaaactatgggttatgactttcacacatttggctcctatgaaaaaagagtgatttgtgttatttagaggactataataatttttttagtgtttctagttgagcaaatctaatttttagctactaaaacacatgagaagcctgaatggtattatccaaatggacttgggtgacatgcaatatagacaacttaggaataagtgacactgtggacttgattagaacgcagtaatcctggaagaatataaattgaattggatttatggtctaataaaaacgtgggaggaaaagataatgcttactgactcatgaaactttaacaatgtttgtaagactccgagttgttgtaatatttggttgagagcgctttcccatttgtctcagcctgcttccagaacagcctgctgtgcacctccgtctggaagtgaagcctgacttgggtctccttcttgggtatacttaggaagcagagatcatcacatactctgcccttgtaaacccatgacctcgagcagcacttggttggtttaggcaaatatgtattgagtacctattaactgtaagagtttgggggagaaaaaagtaccatgggaaagtcctagctcattgcttatttgcactcagaaagcttttttagaggactacttgtttctggccttgtattctcctttctgtgatactgcaaaaaagtagagagcataccacagctacctactcctccctgaatacaccatagaaataatagcacctgccattttattgaactcggaggcatgtgttaggtgcttacatacagtcatgtacttaatcatagcaactctaggaggcatgtattattatacccattagtcaaatggggagactgaagctcagagaggcaaatggctcatggtcacacagctaataactagtgaagccaggtctgtgtgactgctaaactctttcctgcttttgctccagagctgtggttcctcattccctgcctccttgcctttgctttgcagttacttctgtgtcctgtgttgcaggatgcagaggcacctttacccaccgtggaagtctcaccctttctgatgactcccctcaaaacctactgcctcttgagaagccctcccatctctcttacctctgggctcccagagcacctgattaccacctcatcatcatcctcatcatagcctgattcgtaaggctgagggaaccagctgggtaggacagtggggcaggcactggcctttcccaccgacttgtgagctctttggaagtcagggactctattttatgattgatttgtcaacataacacccagcacaattctaggaggtactaccattattatcccatttaaaagatggaaaaactgagtcacagaggctaagtgatttagtcagcgtcacagagtaagtgacagagctgggatctgaacacagcagtctggctccaacatctatgttcttcacactaaatttgcgccatctctttaatgagattgtaaactgtgagggtggaggtggtgcccagcagctcccagcctagtatctcacagactctgcacagtaaacatcagcccttttgttctcctgtccaccccagcagagtgacaaacagaatatattgaaccaggtcttatcgcataataagaaaagagcacaaatatgctgaagatctcatagaatgcatatccccaggcctcatttggattcagtgggtatgggccaggcagggctgaacgcttctcatcttttctgtatctgggaacaacagtgagaagggaagagtcagcaggcagctctggaagacaaggaaggaagcaaacatagggagtcccaactagagtagtgggagcaggcggagaagtggtagaaaccatcagtcagcaagagtcagagagtgccgaagcttgagaggggcccgggatcataaatccgcacagaaagacctcttaacttgtaatttaaaggtttctaagtacctgtgccttttgaatatgctggtgggattttatctgatgaagtcaaacactttcattttcttcagagcttccatctttgaggtatccaaaaatagtaggcttttcatggagttgtataaggattccatctgctttatattgaaaagtagggctttaatggaaaattaaaaatgagccagatctcctttcccacaacaaagcccagggcacttttcccaatcctttcttcttttaatccccagaaagttactgaatctgtatttctgtgaaatcctgcccaatttaaattctactgaaaaggcaaataaacaccaacaacttcatttccacacaaatgtcatgtctatttagaagcaataacaatttcaaatgttgtcacttgtgaaatttgatttttgttttaattttatttttttgttattctagagattgtgtgatgtattgcctgtacctaggcacatacatgcacataaggatattttaagaagcgctgatttctgttaatggtttctctagttgctgtctgagtttgaagggtatcaccttttattgtctagtttggcttcactctcatatttcctagattgagtgaggaggtattgatccatgtcactgtggatgtgccggctaatgtagatactggttcttggatcctgtccctttactaaacagcccagtgaatggaggcagaatgaccaggttccttagcctggccttcagtgccttctgtagtatctacgttcttccttagtcatcctggctcacctcatttagcagatgctaatgcttggttagccagaagcccattaccatctcgttaattggcaatatggctccggcctttgttttcctttcccggaatcccccgtccttccctttccttagaattctactcacctgtctaggcccagctggaatcccaactctcaaaagcttcccccaatctctttattctcttgcattgaacacttgtatctctcaattgcctcctaataagtgatgcctgacattgttagttaaattcaatatgagaaattcagggtttggaaggtttttacaacttgcccaagttggtacatccggttactactttagcttagactagaatccagttctcctagacatacttggccccacatatgccgctcccctttttgactgtccacctaaggcacgtagcacactgtcattcacagtgtggatactcagcaatgttcatttagacaggcccggggtaaggcactggaacatgcagctggctttctgggcatctgcgctatgaggctggcttctttttggacattgagcttctgtattttctggtggcacaagatttactccctactgacccacaacacagtttgggttcattaactgtcctagactgctttagaaaccaccatttcattttgagaatgatatgtgtttgaagattttttgtttgtaatcttgagctttttgttaaaaatttagggtgattggggaaatagttactcctttgccctctgccatcaggttttcatccataagattttcactaaaaaagaaaggaaatgacatccaagagcagagagaaaatgcagaattcttcaaaatctagaggaaattggaggaatacagtaataaatgatgggcgagagaacaatagccaaatggactgccagtattgttgggcctgaaagtattatgtacctacccacacctggacctcacaaagcaacatttaactgagtgcctctgccatgtatagcccaattttggctgtggaagtgccttcctctccatgcattgattttgtttactttgtagtagaatctccttagcataggaagagggttctgtcccagactaaggctctacgaagtaatgatttaactctacagctcagctatagcctttgtttgtatatccttcaaaagaatgattgaaaacaagctttataaaatgttttccatggtcatggggagggacccctggagtcatttctataacgaaactcaaaacagcacaacaggcagtgttggtctgcattcatgaagagccttctcagctgcctgtgagagctcgctgtgattcctcgttaatggcttcccctgcctagtcctctcctggatgccaggtttaatgtatctgggatagagagcaataagaacactttctgtggatgtaggccaactgctgcagctgaaagggggaggggaggtacctggtgctttactgttgtttgaaatgctattgtgatcttcgagaagcagtggtggattttttttccttgcttaaccatacgccgtctattatttaagtgctttttctgccacctccccgctaccacaactaccaccttaaatgtgggagatcacatggcactttgacaaaatgtactatcccctttgctggcatataatgttaccacttcatgtatttattcattctgctcatgtctaccctcttttgtacacatcagcgtcaatattgtccattttcagtagcaagtttctagaaggctgagagtgaaccttgtttaatttgccttgtgctgcgtgatactacactgtgcatttattaaatgctcattggttctgattctaagcttccaagttgggaggttttacatatgttttcagtacttctagaatgagatgcgtcttaagtaacttttcttcatgcaggtgatacattgggtcctctgcactgatggatccttggagtcatggtttagaatccagattttggttgcatgttttagattcccccttatgttctgcctccttgggtgaaaatgcaatagccctacttctaatcttgcctctccgttagggccaaagcatagataatgtgccatacctcacacttcttttcatgtaagtgtggttgaccatgtaattcccatagtcattattcaacagattcttgatttcagactgccaagtgttagaggttgttctcttggaggttgagaattactcagtgaagactagtgaggatgaggagtgtctgggaagaatctggaaggactgtggtagaatgaacagaaccagatgcctctatgggtgccagcagctcctgggaaagggacaggttctggttaatttatttgttaagtatgatccaagagggattggcacttaaaaaactgcaaccctaaacattatttgattgtaccccagtccaacatgccatgtggggaagagtccctaatctggggtgcccaaggcaagccctactgctttccctgatcctcacatctctagctgtgacagaggttctgtttccagggaatgaatcaccctggcccccatccccagaacagggcttccttccacacacttgagatccagaactgctgctgctggaagattcctgctctgtgctgcccaccaaaacacccatggggttttcagtctagcccatggttgagctagaacatgcaggaatgatccactgaagagggaggtgttggttaggcaggagcgagaaggaacgatggatggaagattggtgaagagttggtggagatgagatcttaattaagttagaccttttactggtttcccgggactgccataacaaattcccacaaactcggcttaacacaagagaacattttctgtcatagtcctggaggcccaaaatcagaaaccaggctctcagcagggtttatttcttatggagtccctgaaggagattctgtcccaggcttctctgtggctgccggcaaaccttggctttccttggctttgtaggcatgtcactacaatctctgcctccatcttcacagggtattttcctctgcatgtcattgcatggccttctcctctcttacaaggaaacttgtcgctgaatttagggccagccctaatatgggatattcttatcttgatattcttaacttaattacatctacaaagacccctttttccaaataggccatattcacagattccagatgggcatggtgtgttttttgtttttgttttttgtggttggggggttggcaccattgaacccactataaccctcaaagtaatagaaagtagcagtcactcagagggaaagagaacagacaagaacaaaacaagatcgcatgcctgctaaatggcaggtatcgtggtgctatgtactttacctgtttgattttaactattactgcaagataaataaagatacagtgaaatttgcatgtaagaagaaagaagttcaaaggaatggagtgtcctggaacttttctatgaactggaggctgaactgtcatctcatgttgagagatttgaagaagggagagtgggcttggagaatctagaaaaaattcagccagccactaaactgtagcacagtgtgtaaatagatggataaaaaatatggagtgaggccccattggaatttgcacgtatgtttatagttccctttagcccaattttgtgactctgcctggtaatacttgtcactttggaatgaaaaatctggccttgcggtgacttagagttgggcattggtttgaataataggttgctctaagagactagagaaaacatcatatgaatcagctgaaactagtattcaggctggaaggggcgtgagcttggattggaggtgataggtaaggaagggtctgaggcctcagggatgtgatgagtgggcacagcaggtacggaagaggagtgacaaaggtaagggggccctcagttgaggaaatccagggaagtggagagttccaaaatgatgctgatgcaggggtggttttggacctccactcaatggtagaacagagattgaggatattgggtaggaagaactcaagaaacggaaagccataggctccccttgcccttggttcaaatataaatatataatgatataaatggtatcttctaggagaatggcctgtcaatgtgttgcacttttttttttttttttttaaatcctaggtaagtgttctgggacctctgagaccttgcattatgagcagctagtttagtgggaataatattttgaactggtattcaatttactttcccttcctcctaattgctgttgccctgggagtctcccccattgaagctagggattccatcacttcaaggggaggacagaacatggtcaacgacaaagaagacattgttcagcttttgacttccaaaacaggcccttaaagcctgtttcagagaacagagttagcccaagccttcatttaaaagagacaggctttgttagaagaaaaatggtttgtggtttccaagcagccaaatctcagaaggcctggcatatattgtacattaagccacggaggagggaggctacaggatcacttccgttagcccaagaaggagaaaattgcttcctgggttggaaggaggagcttgcagagattcagaggattccagggttaagaaatggatgggtcactgagatctagcacccagttgtcctgggcttctgcttacggggttattgagatgatagaaggcccaggtaggtgagcgaccccctgtaagcagagagcactggtgccctgcctcctctctgggactctggaaggaaaccaccttgtagtttgccctgcagtggggtgtgtttaggtagaaacgggccctgaggtggtgttccttcccagttccccaaaacctgtacatggcgtggggaaatcccgacagtcctgcttatgcccttgggtggatgtaaaggtactgagatatctagggtcagaatagagagggcacagaagggaagtgtgccaatctccctgctggaggctggctgggatcgtggccacagatactactgagccccagtgaggtattgaccagctacatcagccaaaccaggccagcacccaatgacaaaggaacaagacatcccacagaggccagaggccagcacctagactcaatcctctccccatcactgtgatggtctgtaatctccctggggagaagaaggagaacgaaagggacacagcccggcagcttgaagtgaatttaatttgactgattgccctgaagcaactaaagttttaactctgaagccactaggttacctgtaatgagtaagattgtttttttttctgccataagtagaaatgcaatgatcataatcaagttgaattcaatcatgcacaaataaagtaacatctttttatattgttaggtagtaagtgtatatttcaaacctgccactctgcatttgggctatattttaactgcttaaacttttttatttgtgacaaatttacctatactcttatagtataccatttttcctttgataaatcgtggcttagtatacctgtcctaggttcatttggggcaagaagtgtgagattatgtccttaagcggcagagttttccacctgatgtttcaagatagtgtggggtttctggcttccccttgtttagctagtggcagtttttccctgagaaggacctcagttgccttcgggcctcaggtcagtggaaagtattagaatttcaagcctttctctaatgaatttactgtgatgctggagattagaggagaatttttactgtgtgtgatccttcagtttcatattgtaaaggtaacagggtgaatagtagaaatgtctctaaatacaaggggaaatgctcttcatttttattcagttctcatgtgctaaataaagtatcagtttatgaaaggattcatttccaagtataatttgtaagtagttaccagaacactcaaatgagagagggggagaaaaaaacagttagctctttttaattgcatttcatctctctttgacattcatatgaggatgatgctgcatttaagatgatgtattttaaaacctgctgtttctgaaatacctagtaattttggaagggaaatcatcaggcttgctttaaaagtgtgcctttattgggggtgttctggggtgaggtgcggagttgcctgtttggatactgcttatgtattttctcaccagaaaattattgtgacactcttagcaaattttctcaaaacataaatgcatctcatatttttaccttgtgtgtcgggggggagccaagagagttagagatggagaaccacataatttaaattgaaaagagtcagcaaataattaaatggatagaatttaaaaagtattgatttattaactgacattttaaaaatatgttagacctataaaatagttctcttcagaatcttttcagaaataaaatttttaaaacttaaaaacatatgtccatatagattaaatttaaaaaatcttatattatctgagttttataaaataataacataagtaattatttttcactcccattagtcaactttttagcaatgtctctaactaacctatgccagtgatactccatatgaagaatgaattgtttttaattttcttaataaagttgcctccaatctcttcaaagttgtgtttatagttagtatttgaaattaatatctttgattggcttctatgtgtacatcacaatatttctcattcagaaaatagctcttagatgcaaagtccctggtgagctctgaacaaattctgctcagtggaagctcttcttagacaagtttttaaaatgttgaaatgtgtaactgttttcacccaaatatgttcacagatctttttctctcattcagaattcttcaacaaatatttttataagacaaaacttatgaaattaagtttctctgtggtcctttcaaatgttttgtcaaatttagatggcacaaaattgcagaccttctcagtttcactccattctggtacggaatataaatgtatccagttaaaactaggcattccatcaaaagattgccacaagtcaagatattacaaaacatcagaacagaatttcagaattaaatcttgaacactgagttctcatcatgcaatgtgttcagttcctcctttgcttttgttgggataaatttgagcatcttctgtttacaagccttattttcaataactgcagttggctacaggcttcaaaagctgaactgttttggtgcttcattcactgctttgatcaaagacttccaactagtttggaacagaatacacccaaactttttaaaggacttgtctatgataccgttatggcacgcccaggttgacagagagagtcatttctcaagcattaacaaaacccagttgatgatgacggggacaaaagagaaggaatatactgctatgttgaagtgttttttgtatttagtattggctttgtcacaaaaagtttgggatatttctaattgggtatatataactattagttaatttctacctctacagtttttacattcgataggatatagccacttgtttgaatgcagttatgaattatgcatgtgacataacacattctaagtaacattctgcaccataggtttcttgatttagttaagaaccttatttttagcatcacaaaatttgtattattcctgcaaaatcaaatcatttcatctcctatgttgagctttttacaatttacagtagcatttacaataatatgagacgttttacctgtgacaaaataaacttccacaagctttattttgatcccatgagataaatgaaaaaaaatattatttgaattaattgattttctgtttaaaacacctggtaatactaacataaaactggaataatttaactcttggtgaagtttttttcttctgctaatgaagctaatacattaaagtcatcgtttcacttttcatatatgcacaaaaaaacctgagttcaaaaataagcaaaatcaatttggaacaacagacatttcatccaaaagaaatgtctcctagagtgctatgttagtaaaccttctgcagctgcgtatgttaaatcatcttccttaacatagtcttgcatcattattaacatttgaagtagttgctgttgcctctttagcagatttgtgacttgtggtttatgtagtcagtgatatcactaaggctcccatgatggatagtaagtatcaacaagcattttgtgtgaatttatgttcatcatctgctttcttgaaaagcagaaatttggtacttaattttttattaaacttgcattttctttttctttttagctcatcactgccaaaaggtatattgcaaaataaaatagtataacgattcaataaatgacaaaaacactgaaatgagagcattcagacaattctttaaaagatctgtagcagatctgtttcctgcgaatatttcatgtatgcctaacctataactttctgtgttttccattaacccttctgactgctgttccgtgcatctcaggctgcaacacaggtcacagtgcaatggtcagcacatctagtgtctggtgaggcagtggcctggaatacttttcctactgccaatcaagaccggaaggagttagctgcccttagctgctcatgtccaagtactctttgttttatggtgagcatactgcgtgttgtccttgaaagggaggtgttgcttacaccacgattggaaagggacaggaaaagaaatggattgtcattggtcatctttcagctttaatcacatgttaacatgaacgttcccttcactgtatagtcgtctcacacaccggtagacaaggtatgggagaagctgcaagtgcaaactggaggttacaaaacccatcctggtgtattttaatataaccagtaataacacttggtttatgaagtgaaacatctgaacaagtgcttaacctgactgtctgctgcgacaacaggcataaaccagcacttttgcagacaaagggaaggacactgtcaacctgggtagaaaatcacatttctccatctgctttccaccctcctttgtctggactctgcccttctctagtcttgatctttccaaccccacttcccacaatggctgaatgagcttttaaaaatctatatgacaaagcaggaggatcacttcaaggcagaaattcgtgaccagcctgggcaacacagtgaaactccatctgtacaaaaaatttgaaaattagcctgtcatgatgaagcacttctgtagtcctagctacccaggaggctgaggtaggaggatcgcttcagcctaagaggtcaaagctgcagtgaactatgatcttaccactgctctccagcctgggtgacacagtgagaccctgtctctaaagttaaaaattcatatatttaaaagaatctctatgagatcatgttgctctcctgatgtcatcctgtcgcaattaggataaaatccagctctttgccacagcccaagcaagaggccgtttgtgctcttgcctgattgtccccaactagattttaagcttccagggaacatacacctggctatgtgccttctttgtcagaaggggacatgagagttgcacaatgtattttcttgatgtgatgatttggtttactttgaattgatgaaaaaaaaaaaaaggagtgtcttggtaatccatgccagtaagcaaattcaagtccaaatctctatgttccaaatatgatttgtatctctgataacaaagttggtcagcagaatgtatgacaggactggatcctctccattagtggaagtcttacaatgcataaaaccattctgattccgtggtcttccagcccctccccacctcttggaagtatgaattctagggaatctattgtcttcatcaacattagatgaagactttttaagtacatttggaaaggtgctgctctgggtgatttggggaaaactgacatgcaaaagctcaggcaattctcagagacctatgatgttggtggtagaggaatactctgaagtcacagttgtgaaaccttgttgtgttcttgcacaactggttctgttgcttctctttgtggaacgtgctactgttcaattttatcatgaatgcctttccaaggacagtaaatggttttacacactatgacatcgtttccatggcaactaatgtattttagcaaagagagactgtgatagaagtaggctaaaaaggacaaatacagaaatggcacagtgtaaaatgtagggcagtgtgtgttgtagtaaggactttttttttcctggcttcttgtttaggaaaacctatataactagattttggattttttttttaactcttactaataaaatttttactgcacccaacacagtctcgtatttttctgacacagttccttcagttggtacttgggctttttgtttgcttgccttaaaatgagataatttccataacatataaacatttgtaagtttatctatcttaaaggatgtactcttcttaatccccattctcctttggccaacaccccacttctctaccaccctttatttcagttcttcttgagagggttgtcaatactacctgtctccacacggtgtttgttaaaaatcagagccattccagtctggctttcattccaccatttgatacagtatcaccagctggtcacaccctcatcctctaagtctactgcagctctcttcttttgtttatttagaagctaactgcatgagtgtacatttcgaataattccacaccacatcaagccccatttatgtcaaccatggttaagaaatataagggaacgtgttaccctgctttgtatatctgaatacatttggattattttgttatatgataatggaaccccctctgtgctcttaaataaatccccagtggtgagcagatagtcaatttcctatttaacagaaggagaaacggaggcatgtacctttttattacttctaaagatagcaaaccactctatgggctggatcatacataccgtcatttatgttttgttgggccacatggtgcgtttcaaaaatgtaaactaacacttttaaataggacagtattacataaaagctgagatttccagcttctcttgaaaaaaaaaaaaagggaagatttggcaaaactgaacctgccttctctaatgatagcagcctgcccaagcagtgttgtggctgtcttctttggagggagcagggctcttcagctcacccagcttcatcttacctgctttattcatttatgttgcttacctggcccctggggtttttaaatatgtgacccttgccacaccctctcccacccaatcgcagagcagataaatagcagagctagggatggaacttggtttccaagccagcctcttcctccctgcctgtggaccacaattctgtattgtagagagtaattcacaggtcagggatgaagggcatcatcaggtggtcatcatgatactaactgaaacagaccgtgcagttagtgcttctaggtacactgttcttatagggtcccttccccttttggttgcctctgtcagaagttgtgtgctctcaattgtgatgtgcaaggcggaggtgctggggtagaatgtggaaatttgtatgttcatacaaaaactggcccaaaaggaaaagcttcagtatcataacaggggtttcatattttccaaatcttcaatgagcgtgtattacctttttaatgagctaaaataaatatttacgtaagataaacaagaacaaaatagtaatacaaagtacacatagcactggctgatacctgtgccatcctcccaatgtgggggacaccagggccttccccagccacctctgctgtcctctactagactagagtcttcccctagatgcccctggggtagtaccaatgtctagtaccatgttcatcacgtgcccctcattttgaacgtgcacatatcactgtaccttgattaggactgaataagacaggagaagaagttgcagttgctgccatctctaaccttgggagaaggtttgtgtgtggagcaagacacaggagaatgagctagtttggggccagaatgaatggttggaggaaaatacatttttcctggggaaacgtggcaatgaggaatgctccacaacagagggccttgtctgagctgggtcctgtctcaggcgcctaacccagctgttgggcacacaggagactgtggagaccctgagcgtggatggtcccacacactgcatgtctgtctgcagctgcacaggcctcagggagccctgtgagagtgggcctgttcctgggctgcaggcagagagccaggggctgccccgttgccagagagcattgaggagcttctgtgtgtgctgtgtatatgtctcagccttctttggaattatggcagagtctgtccctgcctggtcatttttgtgcctttgatcctaagttaagaataagtgaaggagcacttgtccctgtggacacgctcgatatggaagttgcatcaaacggctattttatcctcagtcaccactgacatcactccacgtacggttctgaggttctcactttagttgtggttgaatagagctatgatcattggtgcagaaagaagccattccgatgtgaatctgtgaagatgtgtctagcaatgtacagatgttttttggcaggtcagtgaatattttaaatcttttgcaagtagtaaaaagagttgaatttgaaatagagaagacaccatggcaagggaaaattataccttgtttttctctcaatcttccatttttaagataatcagacaaaatcctgaaccattatttaaatcttggattcatcatggctcttaaatgtccttcatcctgtatgatacatggttatgaccctaatgtattgaatctctttcaatagcaagaattgctgggtagtagtaaacataatagcagaatctccagtttggatctccattgatttaattctctctgtcacctcccctcttcacccttcctccagccatcaccagagatggcacacgcccctgtatcttgcaggtaccatgcttggtgtagtcccagtcaccaagaagctgacagtctagcggggaaacaacgaaacaggctctgcacaaagtgccgtgggaacacagagaagaggaaatctagtcctgcatgggggtgtgggcaaaggaaaacaagagtgaaaaagtgattttaatctggaccctgcaggctgattaggagaaagttgctacccagcagggttggtgagattggaatgacaaggcatagcccagcaccaggaattattgggggctgcctttctttttcggccctttcctgggatagaggcaggttgaaaacacagtggtacagtgctacttctggctgccttcttagctactgtacaccgtctctcacagtctggcctctgccttacttcccacctttctccctccagcctgccaccatcctcctagccactcctctgttgtgcagcactgtcaggcctctaagcgtgcagcccatgctcctttgactgtgtactggttgctttgcctgcactgccctgtcgtgaggttcatagggagatgtctgtgggcattcggaaacagtgcaggggggtgacggggagctggagggatggctgtatcaagagagagctcagagttgaggattgctcagttttatttattgtctgtgtgttcacccaatgttggaggattggtctgatctaggcagttggaagtagttcatttttggtcagggtcttgtcctttggcttccattcctgcagttgaccacacatttgcaacattaatggatcagccttttccactgggctatctgggtcacttcagttatgtttctcaaacgaaacatcagcactgcttcagcaagaagaataaaagcatggaaaatgccctaatgcccaaagcccacaattgaatgcatagacaactgtttaaaatgtctgtgtaactacatatgcatatcaatataatatatctgtacgcacatgcacacacacacgggggtgggcgtgggagaagcctatcttcccttagtcttggaaacctaaaacttgcatcttcaaaaaatcagatttagaataaagataaattaggaagataattggtcaatttttaaaaaatgatttttaagaaaatatgaatctttgaaataaaaagtatctctatttcacttaaacatttgtgaataaacatttactttttctcaacttttcagaaagacagccttaagaaagatatacgtggttttaaaagcaaatgccactctttattctagatagcaattctattttgcgtccatccttatcatcttggaaacagtggagccgctctctaaaaatatttcagtatcttgcttagagtcctcagagttaaagctgtggtgtcctccttttggtttatggctgcagaatgatgggtgtatatattgtttttgttagttaactccatctgtttcgtaagcctgaaaaagaaattggatgatgccgtatatatgtatggatggataacactccttatgcagtagtgagtcagcagcttcaaatgggttttccgttttcctattggtactggttgctaaagtgctgtagcgtgaaggctcattctttcagaatcttgtgaattgggcatcctatgttgttggaattacacagtatgcttgaaagaagggtattaaagtttcttccctactttggaaatggtaatgattctccaagtgctctttctaaggctgatgaaaaagtcttccaccttgtaaatagaaatctccttattgtgacctgtgaatcagagcaacaacttttctgagcctctgcagaagtgttcaagaatagaaggcaaagttccactctatacatgttcccttttgtgaagagttctcatagtattgatttattctcttctgattatagggaagcaagttaaaatttctggacaaataattctcattttttacagcttagcagtgtctagatccctagtgggttagccaaaagaaaaggcatctattgcctggcggtttctccgtaggacaggacagcatgtctcagaacccaggaagaggtgagatgatatgggttgctaaggcatgagctgcaatggcatgcttattagcacattctctctcacctccatggtggttctcttgctcatctccagtgagttcatgatttgaatgcccatctgcagagaacaatatatgagtttcaaattctcttcctcatggtcattttttctttccttcattccgagtcatctttgattaaacaaaacaaagatgttactgttaattatacatctttccaaacagtgcaaaaattcttgtgtgtgtgtgtggtgggggatggttttgatgggaataataacttatcatgggggtgttttaaatcgtggatcaggaagaaagatactaagagtcacattgaaaagcttaagagtctctacaagataggaaaaattgttcctgccttttttcatatttcttaactcaaagctctctgccctaacatattgttgtaaacataattccattcaactatttttattgttctctttagacactttattaaaactgcagctttattcaaacagctaaaattgcagataataaatgaagtaccataatattggccagttgtaggcacagcgtgtgagcaaactggaaagctgccatcctgctcctggcactttaaagattaatgtgaagcatgcatgggtgtcatcagaaccagcactcagcctcgccaggggcttggcacaaggttctaaggtagtcccggggctggagttccatggacaagatgatgcaggctgctgggttggcaaacctcctgcagaggggaaccccagctgctgggaaccaggggccatccccaaaatgctttttttgacagcggggcccacccacagtcagataggaagtggggaaggtatgggctgggtgctgggggtgttttaatccaagaggtaaattgagtaagaccttggaagactcagttttaattgtgccccaaccattgatgacttgtagagactctgaaaaagggaagtgtgtttgtgtttgtgtttgtgtgtgtgtgtgtatgtgtgtgtgtacacacaaggcctctatccttatctttcctgattccagaaagttaaaatctcatgctggcttcctttggtggtacaaggccaggtctttgcagtttcagacaggtgtttgtggcaactgtgacttagcaacaattgtgtgaatgataaaaaatttgtgggcaaattgattgtctgcaacaaatggaaattctatggtggtgctttgtgggtggtttgtaggcagagagtacttggttctcttttgatgtctcacttttttttttcttcttctacagtttttttgaagaagcaggatgctgatctaaacgtggaaaaagtaagttggcaagttttgcactgagagcaagtgccttgtgaattataaagggcttcctgttggaacctaggatgaagtccacttttaatttgggattgtaattctgagtccatagatttctaagagagaggtcgagttggagaaggaactggtttgtgaaatagaaagaaaaccttacctcctttggtggacccactattttctcccttcccttagttgtaacactcaattctggtaatttatgggaacatatgttttgactataagttatggctcccaccccagaaatagaatggaacagctgtcccatggctgaggagccttcaggctggggaggaatggggagcgcctatcctcaggctggtcaaggaggtcgttttcagtccattcattgttgtttttcctccactctcagatggctgctgctcacctctgcctgagccgtatctttgaattgcagccactgtgtagcaggtcattctttcattaatgtaacatttttttggttcctactgggtgttagacatcatgctggactctcttgagacaaaagtgaatgtgactgacaagtactcaggtaatgatggtacaatctgagagctgtgcagaaggggcttggaagctctgactgagggctgagctatccagaaaaactccatgatggagtgggtgtgaggagctgtgaatgcattctttctctgaatgtttgctgagccttctctgcctgtacgtctctctgcctccccaggtgccttgagttcccccactgaaaggctggacgtcgcagctctcgctagccacccaggcgtccttttcggcccccactactctgcccaaccacattgccttgggtgtaacttttcagctgttctgagttatgttcctcaattccctggccacttgggggctgccccttcatcatctgagaatgacttggggttatttctcatcttgatttgagtgcaagagaggcttttctttctgaactagagccattctgaatgcagctcgtttgtctctaagttagggaagtatactatctgaaacattgttccagaacaattgtgagtaactcctgacctttgaccccatgcaggcacctagcttctgcaggatggcctgtgatctactgctagtcacgggcttttcagctcatacaaaccagggcaacttggggaaataacacagctctagttaggacaaggcagaaggagcctttttagaatccgcatgcactcaggttttggctgtggaagccagggattggcaaagactgtcgcctatgggaggtcagtatactgtgacccttctggactaggccaggtccacagcaggcaagagcctatgggtgccaggagccccctcagggcagtattgtgccttggagcccaaagaaatgcctggcatttgccccagactgcaggacttgccctcccctgtccaactcaggcagtgaatcctgcagccacaggagggggaagtccattcatctgggttcccagtcctggccccatgccgggcaaacagcagggctcagttagtggggtgtggggggcactgaatggaatgtgttcaattttgcttcacttctgctgttaacttcctgttagaccttagaaaaatcatttctcctccccaagtttcatttttcttatcagtaaagtggtccctttcacaggaccaagtaaaattactcgcttttaaattgaaaaacacaaaccaaatacattttgtttttgtttttgttttctgacttgggtcttgaattaaaatggaaaaagggctgttggccaccagtctaaagaatgccaggtaagaccagttatggattgggactgaaggagcaatgagtgtctaacaaaagagtgaacacgggtgactgacccgtggtgtggatgtctgtaagtgcacagggaatccagattaagagaagctaaacgggtagaaatgctgcttggatggagtgagtctgaggcacctctgaaaggctctgcctgcaccctctcctcagtcaagtagttgatgacctgaaaaacaatcattgccttaggggagtttgctgttttaaaagctctattctagaagttccactttcagaacctttttctgttgctggtagaacactgttgaacacggatctatcaacttttctttttgtctgtgtttacctatccagaagaatctaatataggatgtgcatctgttgtataagtaaatgatacctgttggccaactccagtggagaaaaattgccaaagttacagtgtttgttcttcatgtggatttttaagtttcctcttttagttgaacgtttttgtaaagacagaagtggaaaattagctttattttgacatgctaaagctcaaagacaagttagcataaattctgtattaattaatatctatggtttattgaacttctgctatgcagagtgctttatatcatctatgttacacttcactgtgacagcagtcctgtgagggagctatgagaggctcaaggtgctgtagttatagtaaggattctactcagatctgtctgggctcagagctttccccttcccataccccaccttactttggagtttatataatatttgagacaatatgtttgtgtgccttatttttttttaagtttcgtaagttctaagaaagcggcatttgttactttttagagagctcttccttgacactcccctaaaggcccaggctggatggggttgccctatcgccacggccgcttcaaagctgtcattgtggttgcatagttatctgtgcagtgactgtctgacagcagtgttcactgtggaactgcaggctttatcagctcagaatccttatctgtgccaagcctagtgcctaactcatagtaggccctcttaaaaaattgagcaggcatgaatgagtggaaaccatgcttgttaatagcattatgtggcgataagaccatcattccttgacttgctccccaaaagtacaaagtttcaagcagacaaatgaacagatcattcttaaaattgaactaatctgggcaagcaaagagagttcaaagataaaagagggggacgcagtagtgcacaagggaaacattaaagcaaatattttcttttccacagaatcttttagaattcttgagggttacagttccagatatcattgctttaagtgtataaagtgtatttttaaaaagtgaaacccatacccatttaaaaattgaaaaatatgtaatcaagttgtatcagaacaaaaatgtgctttttgtgtaaaaagctaattaaatggagtcatcctatttagtgatttaaaaggatttgattaaaataatatccacttcaactactctcaaagggctgaggagagaggtttggtttccgtgcatcctggatggcctttgtctggtgtgattaaaggtatttcagtgcctgccatgagagaggcccctgccatttctgcagtttcagtgagaccgagaattcctgcagtgtcattccaactgtttgcagggtttagacagctgcgttcaggccacaaatatggccacaaacactactgcctatttgatagacacagaggccttccgaaacaaaaattgtcattcaaaaagaaaagtaaaaagaaaaattacctcctgccttagaattgtttacttttcctctgagtgagtgagttctttgaaatgtgttggtctgttaatgtagaatgtacatggaagttgctccatttttcagtgtttctttggttttaataagtcccaagagaaatgataaaaaacctcctagattcttagtgtggggataattgtcttgtggggggaaaatctaattctaagtaatcgagggttagaaatttgaggccgcatcaggaatccagctttaaagccatgtccgcatgatttctatgcagctggttaagaggtgggaaaattaattcatacaagttttttcttttgtgggaagaataagatttccggggtcagaggccagcagtgtttacatggggtatccaaaggcctcacagtgctggttgctggggtgacatgaggatgtgtctccagtgtgaatagggggacattggctttggggtgtaccgcgcaaatgcgtgtactggttgcttaagggaggtgagggagagagtgaagaagaggaagggaagaatagcataagcacaactccctgccatttgtgggagccattgcttcctgagtgggcatgggcgggttgcaggggcaggactcaggtgcttctggtgcctctgaacccatggacactggacagggcagttcctatgtgcagacgggaattgttcctcaggccctccctgatacatgtactacaggctgccagcctcagaaactataggaggccaaagtggcctacattcttcatttacctttctcaacctcacacacagattgacccattctgctggtgatcaggcaacggagtgacccagcctcagtgtataactgagtaagggtcacgtttcacacaacccacttttctggcgactggggaccaggaaaaggaagtggctttgacttgcgggcagggagagaaagagcaagaatgcatgcatgggtgtgtgtgtgtgtgtgtgtgtgtttaggaggaagggacatgcttagaattctgttttagactcaaaggcaatcattgttagtcttggcccaaaaatagttgttatgtatcatgcgtaataactgaccagctttcttttatgtaaatccctggattgtaaaactaagcggtgctgtctaagaagaaaaatatacctaccctctgccaatttgaatttccaaaaaaaaaaaaaaatccctcttcctagacattctaaatttaggaggatattgataactgatctagaacaactgcagataacaatattttcagcgtgattcaaggaaagagttgaaaaattgagggttccttgtttagtcctggatatagaacagttcattcattctttacacattaacgaacactggtaggccaaccactgttttaggccacatgttatcttattcggttgccccacgttgtatgtgaggaaaataaagctcagccaaaggggaatgaattgcccaaggactaacatctaggaagcagcaagatccaaaactatatctcagacttgaagcacccttctctttctcctccactgtggatgctctcttgtcctgaagccatcattatcagcctcatgtaatttaactggtatttttttacacatctttcattttctcttcactgaatttaaaaggtctttctcccttatttgtggttttaaaagtagtaatgatgtttttatcaaggaacaattggaaaccttgaaaagagaatcacctctttaacctgacctggccctgcaaggtggtcgccctgtgaaagcgtgaaaatgacttccaggggtggcatctgcaggcagtgggagtgggggaagcccatgagacactcattttctttccactgctggttcccagacttggggatcatttcgtatattcttcatctgagtagcattcatcattccctatgacaaaagctggatgttgccaggagagagtggggagaaatgctgcccacgttacaatggagagacaagacgagctctcacctacatactttgtaccatttgtttttacaccgaggctttctcctgtagccatgagatactgcataatttgtttcactgcagccaggcctgctgtgtagaagttggaatcatttggttgtctgccttgcatagacttattatctgctgaaattgcatgtgaaggaaagattattaataaaatatatgtgaagaatggctgaaaagatgcttttgtcagtgcccctaaatacttttaagagcagagctgcagttttctaagagtggtgttgtataggccataaaaatacataaaaatttaagcttttcctttaaaaggttattactgcccacttttagcccacaacaaaattttatttgagcagaaaaccttctttgttagcttgctgtgcctgccgtcacaaattaccacaaacttgatggctaaaaacaacagagatttattcccccacagttttaagaggtcagaagtccaatagcaaggtgtcagcagggccacgataccttcagagatggagagaatctgtttcctgtctttccagcttctagtggctgcaagtgttcttgacttgtggccacatcactccagtctctgcctctgccctcacattgccttctcatctgtgtgtcttcctctgcagccctcttataaggatacctgggatggcttttagagcctgctgcataatccagaataagctcttcctctcaaatccttaactttatcacatctttgccatataaggtaaagggattaggaagtgaataccttttggggggcattttctgcctaacatacctcaatttgggaatttctgtaattttcatttatcgaaacataaagcttgcaaccccttgtttcactcattacttcagtcagtttaattttcttagaaggggccacttggaagatctaagaactagtctcttctccagtccccagagcgggcaaggccacgcctgtcttctttctcagattgaggtttatgtaaagaagaggaattatgggctctgaaagctgggaagaggccttggaaatcataccctctcagtctttgggggaaactggggctagagatgtagggtcacccgagtctggagcagagatgggacaagcacttattacactagcccacaccttccgctttgttcctgcagacccccaagctgtctctggtgatacaagcctctaggtcatcttccatttgagagcccttcagtacctgaaaacccaacccctgaaaaatccttttttcctagtccaagagccctagttcttataactttcttgcattagctggtgtcaggaatcccgtcattctggtcacttcctcctggatacattgcctttatatcactgtctttttgaaaacatggctcttggacatgaacacggtacttacaagatggtttgaccagtgtagagtaagaggttactatcaggtctccttaggtgcacattttctgcatcagtataggctatactgatgcagaccaatattacatctctcatcgagtcactttatcatatcttcagcttgcattgagcttatgtgtgataaaaatccttaggacttcttaagtatgaattgctttaaactcatctcctttccccatgctacataggagatctggatttctgtcagtagctggatggtatagcttgggatccagaatatagaccagatagggatctagagaacaaacagatccatgagctggggcatgctcatgggaatggtaccagcagcagagtaaacagaaggcagtttggataatctggtaagacatagtacagaggaaactcttctataggtggctgtctagatggacagaagtttggcagcagaaatgtatggctgggcatgtcgtagagccagatgagaggcatgcagatgtgcagggacttcagttcagaagctaatgcaaagagctgagtccaaaagaatgagttatagagtcaactactgaaatgaggtaggccccaagacagatacttgagcccagagtaaaaggaagccccggtctgaagtcagaatcgtaaaattgatatgattctgaatgtctgtggctgaaagccatacccacccagagtctggagacaggatcactggcagaacttgtaaacaggatgagttgtttccattcagtaaacaactgaacgtgaggcaagtgataacaccatcctatccacacataccatagattatttacaattgaaagcaagattttatctgttaatttggagaggaagatggtgttcttttggtcagttgtggctgtcattctaacctatttaagtcttttaaaatctctattctgtcgtccaattaattaactatctcctttcaactgtgaattatttgtgactgctataagcacatcttgatgaaaacattgaccagggacaaatgtgcaaagccctgttccaaggacctctctccaggtcagtgttgttcttctgtgatgttagtgtctttgggtatggccattcagtcactgaggccactaaagtgaattatcacttggaccagggtttcccatcttgcttggatatgtttttgagtgactatcaggtgctttgctgacatcaaggtattctgcatttgtgatctgtcataatagtcttgtgaaactgccctgagatggagcagtaccatgggaagggaaagttggtagggtgcttagtcagtcactactgtgagtggagaggtccctggatgtcctcattgatgttagtaggtttaaatcttgagtcccacttcctgtaacatacccaaatattagcccatgggtgatttttttaaaggagggactggaatcttgcattcagatgaggagtactaatcttactagggtaatgagggttaagtgttcacctctactaaagactgatcctcctttgtgggtatgtgtggtctgtggagagcagctcccactgttgggtgagcatgatggcttttcggaagatctaggggcgttcattaagttgtgaaatgtgtcactactgaatacagtcagagtgtaaagtgaaagaaagtgagatgctgcgtggatcagtgatgataacagaagggataaaacagcaatttgtgcatttgcatagtccctccagataaggctgccatgagaaagtgagatggtttcagggtggaacatgaggcagcgtcgtgtggtggaaagtatgtgagccttgggggcttgaggaagtcctgaccgtctcaccaaagagctaggccacgggagaagctgacagtcatcaagagtaaggtgcaactgtgaagagtgtctgaagtggaggcacaaagtgccgtgaaatccccaacaggagttagatgaagagatgccagtgaggggagaaaatcatcatcatttaccaacttctacttgttgtaccccctttctttggtcagtactggccatggatggactaactcccaactttgacgtcgagtggattcatacacagggtagaagaatggcaagagggaaggcacctgtccgtattgttttttctgttgctgtgtgtcaacatagataatgctacggtaattgaagacaaaacctttgtgtcgggggaggattttgtccatctttagaatattctaaagagtaggagtaggggaaatgtaatttaaaaaaaaagcaaaactgaagtacctgccactttccccattctactgttaccagatgagggaaaaaacatttttttcttttacaagagagtttgatgtacatcaaagtgccgcttaccgcaaaaaagtaaatttgataatgagaaaaagtttaaacagcccttaggtattgaaaataaagtaacttataaaacccactcgtaaagtttagaagtcgttatggtgaccgcagtgaggtgctaggtgtgggaaggcctcactggtaaagtgtcaggagtgttttttttatatatggcccatgaactggtaggacaaaaaacttttgacagttatcataatatttattctgttttcttatatttggtattaataaatattggctaactagccaatcatatatctttacagtattccatttttacagtggccaagaaaatataattaggcttttgtgttttctagatgatactgtttaataacaacaacaaatactatataatgttcttggctcatttcagaaccaacagagcaaaatgtgtccgttcagaaaaaagcatttgttgtttttctttgtttcttttttgagacacaatctcactttgtcaaccaggctggagtgcagtgacacagtcacggttcactgcagcctcaacctcctgggcgatcctcccacctcagcctccctagcagctgggactacaggtgcctgctacagcgcctggctaatattttttattatttttgtagaaacagtgtctccctatgttgcccaggctggtcttgaactcctgggctcaattcatcctcccaccttgaccttcgaaagatctgagattacagacatgaaccaccgcgcacagcctagcatttgttttgttgttgttgttgttgttgttggaaatataatttaaaaatttttcttttgggggctaaagcccaaatcagttaatatctgaggcctatttgcatgtaaatattaggcaaccatcattcactggatgtttaacccatgagtatcactccatatctcagctgagattcgagatagtgaatgacaggttttcatattttccgtcatatcgccatctcctatgatcattgagagcgttcttcacccacattggaggaattggccacctcagatgcctttctctgaaggcctactgtgttttctctttcctcacaaccaggtccctgagaccagttcttgtcacctttcactttggaatcaccttcactcacctggcatttcagagttgtctttcagtttctctgtttcttgctgaactcagaatcctgcatggagggtatccattcagcctggccctttaactgtaccagtgtcttgctcctcgtggagccaaagtttgctttacagtatgccaccacctgcagaaacctgtccttacttttcttgtttttgtttttcacattcatcctgtgggatatgatgaggtttctcttccaataatctgatcaatcttttgttctttaattcatagaacccctccccccacacacttttctcctttttctccttttttcctttttgcctttgttagatgcccaggcacgccacagtaccaggcgttatcagtaccagctcacattcctttccttatttggaaagaggactaactttctagctcattacagacaccccttccccttcccctccactttcttttacgtgcccaccttatctaaaaaaaaatcaaatgtttagccaactgggattagtttagattgtatgaaccgaccctggccaatggggaaagggtacaggggcaggacttgcttcaggaataaaggctctcatgaccctttgttcaggtgtgttctcatggcgactggccaaggaggcacccctctgcgcagaagtaaaattgctttgctaagaattctttgttcgagtgttcaatttccttaggattttgagcattattcctaacaatccttcactttagtatcactttagtatttcagtgatcaaatgaaaatagggtcattaaagtgaaaatggagatttgctattttgttttcatgttacaatgcagatggtgtgaaacattttttaagaaaaaccaaattacctagattcagatctttaggacagtagttacagtttctctggttgttataggtaatctactaaatagttgagaaaaattgaaatgaaaaaacagctgaattcacttgcctttgaattaacttaccaattttaatttttgagtaggaaataagaaaagcttttagaataaacattcctgaaatagaataaatccaataaaaattcctattttgtctaaattcaggccatggtaccaagaccaggaactcctaactgtgggtgaagcagaaaaataaactctgagtttactcttaaaatggggataggggaaggtggagaattatgccaagttgagagtctgggtgtctgagagatgggtaggtctgggattattctataggaatgaggaaggaagaaggggtggtttggggaagtcagtagtagtgaggtaccactcagtagtaattggggcagcagtaatacaactgataaacttttgtgaacaggaggcaaccctggggttggcttgtgggtgggagacctaggccagcactgccgcctgcagctcctgagtacaactcagcaaaaggtgtctgcactctgggcagacagattagaaatgggcactccttgcacgttcccttgcagcaaggttggcaccaccttctgtacatccctgctgggtttcaccttcccatcagcagtagcctggataaacgcaggtgagtccttgtagagaacagaggtcatcaatgttgagtcttctgtttgattggagctgggaggcagaaggagcaagtgctccaactaagacgagtccaagcccaaggccctacagagggtcagagtactgggaaggaggcactgaggaaggtgggcccagggctcagggtaacataagaattttttttaatatgaggcatacaaaggaataggtgtgtgtatgtgtatccacactcactcacacatctacattgtgtgtgtgtgagagagaaataaacaatcctcttactcatcctgcagcttggaagcccctgtgagttcactctccacacccttctccttcaatggaaccagtattctaaatttcatgtttatcatttccttgcttttctctgtaagtttgtttccctaaacaatttattgctaacttttatttaccttgggactatatataaatggtcttcttctaccatttgcttatttccatcaacatttgttaagattcattcaacatttttaagattcattcctactgatgcatgaagcatcatgcatcaaatttatttatcttcactgctgtctggtccactcattgtatgagtggaagaccactttatcccttctctcaagaacagttgggacatttccagttttgctatttaaatagtgtgctatgaacattcttgaatgtgcatcctgctgcagtttttctagaatgggtgcctaagggaagaatttctgggtcttagagtgtgtgcaccatccactttgctgaataatagcaaattgttttccaaagtggttgtaccacttgacattcgcacgaaaaaacattaacttttaaggcaagggcaagtacaaaggaaagaaaggaaatgtggagagctggggaaatgaagagaaggatgtagattttaaacagccattatggaaagcatgaaaggttagcttgtgtggactgtgggtcacattgtcatcagggagtagattccatcttggtatctacgggtatggaaacacccgtttctctctgttttcactcagttttccctgatcagcaataatctccagggctctgagtagtaaatgctgccaagcatgtaaatgtgccgtttctacatcaaactgatggtggcatggatcctaataaagcttttaaaacagatatctacgcagaggcacacagatattttggagattactttccccaaaacacaagtgatttttctgacagccatgctttgtgtcttataaattcagtaaacttacactggatttgatgttactgtctcttttactttgtaggtttctttgatgagaacacagagctttcctgtggttgctcattcacttgacctgagaaaaatgggtccatattttaaatagcagattaagtgtgaaataggaatagtccctggtgagcatattggcttcatttgtaagttctaaccactctgatatgtaaaactggtgggatttgttttgtttttaaacatttccattctttcatatctagattttagtaagcctaacttattttgttagcattcctatgaaactgaaagtagagcattaaaccattaaaagcacatgttctctggagtctcagaagtgcagctttttttaacttgttatttctgggtcacccttcattaatagcattcatcagatttacttgatcccaggccagaaagattagtgatggtggcattttcaaaatatttctgtcagagtttttaattatatattgactagtattgtctatttgaaactttgatggtgacagtacatatttgagaaggcagcatggtattctggaaataatttggaaatgttgtttttggccaaaaaaaatggaaaaaacctcaatgttccccatttgagatttaattatgtaaactgtgatacatctattaaattgaatattatatattaattaaaatgatgatcaaaattgctaaataagttggacaaatgtttaaggttgttaaatagaaaaaaaagcagtataccaaatcacatgcggaatgtgaagattggataggaagaagtaaagctgtctctattcacaggcaatatgacagtttatgtagaggaatcctaaggaacgtataaagcaaatactagaaggtactaaaaagtaaatttaataaagtcacaggatagaaggtcaatagacaaatcaattgcatttctgtatattagcagctaatagctggaaaatcaagtgaaggaaacaattctgtttgcagtagtaacagaaaaatatgaaatatctaggaatgaatttaacacaatccagtccttcggcgctatccctggaagcacttgtgtaatggatgctaacagtcccagaaaactccccagggactatactttggttttgtatcccttatcagttttccaagggaaaaagttatatcaacttgcataattgttgtttaccatcattaatgtatggattataatgtcaattgatattcaacaagcagcacttcataatttacctgataatttaccaagcatgttttcctcaaactttgggtgtagcgtgtagtcctgagtgacggatgggggccagattcaatctcaggtataagatattcactcagacagttgtattattctttattctttcttcctccctctctctagggtgtgatgaggcatttaatctatcagacaccaggaggatgtatgtaatgaatttctacatgccccaatcattttaatgtaatcatccttcttttaaaaggcttcattaagtctattgttaggattgtaaaactacctaagagagacaggagggctttcctcattttcagaattcagacagttttgttaattgcgtagctttaggtgaacagtaattaaatgggttgtgagaaagtgcaacatttatttatagtaacataagcatgtcacatatttatagtcattactgcacagtctacttgataacatccttttgagagggagggtcacgactgttagaagtagcttcaacaactgtttttggcaaggtccttgaatattacagatttgtgaatattgcagagccaggtacccttgtgctaaagaaatcctatacatattaaactttttgtgaggaacctatacttgcaaggttttaaaatatgcttttaacattttacatgtaaaatatttgagttaagtatgtttgccaatgtcagtcggagtctttggattattataccaaattttgtaccttaattttaacaagatgatagaatagtaacagttattctttggttcttaaatttgttaatgaatacagatttagtgcattattcttaaagtgctctaacatggcacatctatcaagcagataggagagaaactttccatcaagtgttgaggattttaatgccaacaaaatcactatttgggggccttttgaggatcagatgaaagctagaaatcttcccccacagaaacctgtacatgtatacgcacactgatacagaatgatatttcaggaggtcttgattgagacccctgcgtgcctattcaaggacccaaagatatgtgtggattacacaaatagccccccttctgttttgcacttccacccccttgcctagtctctcccatgcccatgtctacagtgtctacaatgtctacaaatccatctttatatataccttctctgcataggacatttttactcaatatcttcattttaccaatcagtctaaatgtgacagaaacagagatccctttttcactaccattgatttccagctcatccccttatatcctcagttactaatattataggttgtcataaacttctccctctgccctatctcccagagaatttatagacagttcccttggaacaagcatgctttcttaactccatgcatctagtatattgataactttttattctgtgttctttcagcagagctaccacttttgtcccttctgttatttgtccacaccaccacagtgcaagccttaaaacatctgtcctttaaactctcccagtcatcttgcccctggactctctcccagcactgtgctaccacactttctaactcagtcttcccttgtatgtggtctgccacacgcaggcacacactttaccttgctctcacctccttggccaccttcagtggttctctatcactggacacagcaaattttaaattgccaatttattcactgtgggagctggctctcctactcccatttctgccagaaactatttttccaggttccttgcatatctgtctcaaaccactgttatcccatcttcctgtactgctgacactctgcccctgtaagatcattagtctgtcaacaagccatcgttgggcatctcacattttctgtgtattaagtcactgggctctgcaggaagatgggtccccacgacttggcagccttatttctgtggaggcttgcacttctcttcacctagcaacttttccataccatctgtctggctccattgagtcagtagttcaataaagatactttagaaacactttttaaaaaaattatgggggtggaggaccaggagaatactacaaaggaaatgagtccctgacatccccatgtgagcagcctcatcttctgaggccagctggtctggaggccagaggctcctgctttattcaacaaggagcatggagacagtgatctgttcttctccacatcctagcaccaagccaggcacagggtaggcccttaagcatctgatgaaggaatcatgcatgtatccgtggcatgtctattgcagtatttcatagacttaatggagctggaagtgacctttgaggttatctcttccaactacatcatccgacagctgaacaagccgcaagtcagggaagctaaataacttgtctaaggtcagacagcagtaaaatcagcttctcaacctatgttttctgacttccattctcccagtctccctgtttttgctctactggaagtgctcagtctatggttcttttcctttctttcatttctgtgcttattggtgtctgttctgtgcttaacaatctgagctcctgatgtgagagacctgggctctcttccttgtctgctgcaccttaataagcattagtacatacttactaattatcctacgttttgaatagcccttggtacttttcaggttcttttacaaatgtttctaattagattttactacagaccggtgagataggttgagcaggtatttttcccacacatcaggtgagaaatcagaggcccggggagagtactacttgttcaagaccaccctgctgatgagtgacacagttgaggatagaatctgattctcctctatgagaggatgatggtgagttaagactgttttgaaaatctgacttcaggctctggaatctcgcctgcctctatgtaaatgtaaaaaataggatttcatgttttctaacagttttccatttagtagctcatttcgtaaagcatgttctgaagcacattggtcccaggagatgtgtggaaaatggattctgtggccagataagctgggaagagctgcttgttatatccccctcttggggattccctgtgcacattaacatttaaaggctctgagaagtcctactgcaaagactgtttaatgtgttgtttttttaattgtggtaaaacacatgccactaaaatttaccatattaaccattttaaagtgtacaattcagttgtgttaagtgtattcacattgctgtgcaaccagtcatgactacatcttggaaaacttaaaatccatacctcttaaacaacaactccggattctgccattcccctagcccctggcaaccaccgttctactttttgtctgtataaattcgactcctctaggtacctcatgtaagtggatcatatagaatgtgtcctacaactggctgatttcatttagcataatgtcctccaggttaatctatgttgtagcgtgtgtcaaaatttccttcctttttaaggctgaataatattccattgtatgtatagaccatattttgtttgcattcatccatcagtggacacttgggttgcttctgccttttggctattgtgaatagtgttgctatgaacatggacgtacaaatatcttttggagaccccgttttcaatttttcaactagatacccagaagtagaattgctggatcctatggtaattttatttttaattttttaaggaactactgttgtttaacatatttttatactcagttcataaacttgtttgatcacaaagttctttttccacatcacacctttgggtatcccacagagcatgggtttttcagaaaacactttggggaatcctgagctcagtaagcaatttctgcttgctccaaggggccagaaacctcaggatgctggctggggaatttggccattaagtttccagcccaaggacaaggtcagcagtgcagtcccaggagctgcagaagaggaggaagttctcagggtacacagtcaactgtaaccagggttcctccgctactctagaacaacactgtcaacttgacacggagtgaagcggccattgtggtgctgaggttgttttggactgcactggttggacagcatctttactggccaagagagtaaggagggcaagcctgcctgcctctgtgcagttaggggcctggggaaagctttatgatgagaagtgtcagatttcagaatccaccgtttcccccatctcccccaagaagaaagagtacccttagtcaaaatctaaatgggctcctcagcagggcttgttgtgttgactcaatctaattggtctttaatgtggttcttaaatagctgaggaataattgtgaacactgtaattgtgtgggtgggtaaaactttcaaccaagttgatggaaagggtatgtgggggcatgggcagtaaactgaggaaagaaaaataattctttttacccccaaaaagctgtcgtatacccccagtgtcactgtggtcagcttttctccaggaccagctcaggaagcctgagccgctggtgacccaaaagggggcattacatgattgaacacctcaaatccccagtgttgttcctctacacactggcttaaagatgggcatgagccggaatggttttagggacatctagaagaaagtaaactgggaggttcctgtagctgttgcagcttggtgttaaggatgagaaaaactatggagaggacatagagccccaaagagtctttgaaccagcctgcaataagaccatagaacactcagcttcttaatttacttgactgagaacagataatgatacctcacattgtgggatgagaatttcataagctctctgagatccttagatgaaagctgctactgatccatagactattattattatgagactttacttttctgtaaataaatgttacagcttcttctctctgactctcttgctctaaatgaggtgagattcagcctctctcgttggccgactcttgccctgtctccaggaccacagttctgcgtggaagcactgagatgagctggaaagagctctgataagggctcaggaaattctgtgcaaaatttcagacaagcagcttcccctcacagcgcctcaattttctcatctctaaaggtccctttctaaggtcccttccagctctgtaggtttgtgattttatcaaagaaacagaacaaaaagtcagcttctaattacaaatgtttattgggtccctggtatgagctaggcactgttttcggtacatggcctaaatcggtgaacaaggtcacttattttagctgggagaaaagagatgagacagtaagcagtaaatattaatacatgagtaaattctgtcattgttagaaggggatatgtcctatgcaaaactaaaataatgtggtaaggagaattggaaatgcaagcaagagtgcaattttaaaaatgtaacaaagaggaacttttccattatgagttactagaagatcaagtatgtcattaagggagtgggggctataaatctctcctttggagattttttaggaagcgaaattagtcatgtttttggattcaggcatattcttgtttgaatgtagaagggataaacagattacccttttgaaggctttctttttaaatgatttaatggtatgtgcaggggtagctccagaattcatgtgtgtgcataaatacacatacatacacatatacacatatatagaagtgcacacacgcgtacttcttaaggaacagtaaaagccagagttgggaggcccagatgctaacatacctccacaccagctctgaaaaggccaactagtgtgccataatgctgtagctctcccaccctgccatttcacaagggaaaaaactgaaacaccgaaatgctagcaactcacagaaatcccagtgaatcagggatgggtaatggaacctgacagtcctctggcgtcttcactcctccctgtattcctttttcaatgagattggcagctcagttgttttcccttcgccttttctcttgcttgtctactgcttctactcccatggttgtatacttaaatagtaatgaaattatagaatactcgccctaactcttaatgtatccagacccacccaatccagtgtcagaatgatatgagtcaaagaaatacaatctagtgacagtaatttcagaatagcacatcttgacttgtctttctcaataccatagagggatatagaattacagcaatatttctttaagtccctctttttccctccagctttcctcacacgttacagcccttacaaatgagcccccaagcctttcctaactgtggcccacctgctctcccacctttcctcctgattctgcatcacagaactcccccaaacaggtcagggcaaagggaagaaccaggaaggcaaagccagagtgcacatgagcagctgggaagagtaagcctgggaatatgtgttactaacttccattccctcacacgaccatgtgtgtctgcactgcactaggcattcttctatcttaccttatataatttaatgctcacagaaatcctgtgtggtaggtattgagatcttcattttactgatgagaaaaccacagtcagagaagcttagtaacttgcctggtatcctgtgatagagaaaatgctaggatttgagcccaggtctgtatagttatcaaaactgtgctctgtctcctatgttgctaccctctatagagtataaatcccagaagctctatgttatttcagttgccaaattaataaaactcgctgtctggtgtttatattaaggcaattaaattggttttcagctaagatcttgaaagtacagtagctacatggaaaagagggtgcctcccacaaagggcttgtgcactggaatgtttgtcttgttcgggaccatggagagctgtccaggcctccctgcccgcagtccaaaaagatcccagcaaggcctgtggaccaccattcctacgcatcagaggcaatggctttctgactctgtcagtcttctagcaggttttacaaccagtggagtgctcatgttaggcctgaccatctgaggcaatgcctgcaatgctcagagatgggagctcagaggagttttcagaagtaatgaaaactttaaacaattccttaatcaccagaataaaataaagattctttttgacaaatgcattggttcagtttatgaatttgtgaacttgattcagataaccttaggagtaaaagtgtgcaagacctcattttgtggctacctggtaacactttggctgaaagctagtgttcatttgaatagtgagtagtggaggggacagggtctgaaaatgaaagaaggcataagagacctgagaagaaaaatagctaaacccaaacctaagcaaataaaaagtgaaattcagagtaatgactgggggagagtaaagcaaaatagatgagacagagtgagcacagaaagataagttagaggagaactatatgtgacctgaaaacgaagaatgcaagagagaaaaatgtactatagatagacaaaggtacagagtcatgggcaacaacatcatctgatgttaacaagatgcagtgtagatttctctcatccatgatggtgtcaaggctttctcctaaatttcaggagaaagttaagtctagtatacagggagcttttgcatgagttctttttccacatgcctgagaatgtattagttaccttgggaggaaaatcatttcaaagtagaggcactaatatttaccatcatccacgttgccccttaatagactatgaagagaccagagcagagtgaaatgagcttaggatagattctgtggcagtggcccacccagtgatgttatcacaagtgagtcattaccaaatgcattcttcacatcttgcaaaagatgtttttcaactttccaaagtttgcagtggggattttttaaagaccatgtgctcacagaagagcagttgaaacttttcctttgtagagttgctatgctttttaagctatttgcccagtttgaaatgttatttgacttctgagtattctatatccacagctgatgactttatgtactccttgctttcagttcctgaggcataatgtatgccgaactgattaaaaatagcattctaatgaaatggttgggtgtgttgttacaatatacgtcagctacaaatgggaacttctttcctcaggaaatttgataaactgaaagtcaatgtgagtgtttatatatattctgtgagaatgttttgtccttcctcatggcttccttttcaaaatgaccagttaatttgggcttcccacccagacacatattttaacacttgtaatagttagctgagatctgttatgttagcatgatacaagagcttggattaaatgtttattagcagagcctgcgagtgtgtagaatcttaaaggaaagcagagagagtcctttttagttcaaatattggatattttaaaagtaagaggggatgatttttatcccttagatcttggccctcagcaacatgtgaaaagcttccattctttataaaagggggaaaaaagtataaaattttttgcctgacattttctcctcaatgccaagcttacagaaagccgtaacgcttgaggtggcccccatattttgtctagtccagtgttttctaaaaatttgagccggtgtttagaagtcaggatatttcacatttttttaaatgcagatttatggcttttctttaaaaataggatgatctagcagcacaaggccaacatggcctctcagcagccacggctggggctggagctgtgtagtgaccacctctgtaggtggtttctgggtcctccgttcggttccctgtgggtccccacacctgtagcctatggccacaagtgttggttgccattcataatcactgttagtcactgcaaatgcactgtagatttttgtaaaattgacaagaatttttctgtacccatctggtaacgtgaaagacacagagggacataatctcacttgctcccagctcacctcacttgtgtgttagccgccctgtggcatgtgatgtgcacctactgctcatccccttacaccccgtttttaccctgctgcagttgtatttccactgctgctgttccactgtagcagccatgtggaaattagagctttctcttgtgtgacaagccctttcttgggtcctcatgctcctctgcctctttgacagtcaatgatggtgtggttgacatgcattccctctcaacattgtcctcccctcgcctctctgactctactctctcttgcatttccttctacttctcactcatctctctcagtctgctttgcagcctctacctctactgtttatttctttctttttttattttttaaatttattatttattttttagattattgtctctgtctttattttttaaattttatatatatatataatactttaagttctagggtacatgtgcacaacgtgcaggtttgttacatatgtatacatgtgccatgttggtttgctgcacccattaactcatcatttacattaggtatatctcctaatgctttccctccccgctccccccaccccacaacaggcccaggtgtgtgatgttccctgccctgtgtccaagtgttctcattgttcaattcccacctataagtgagaacatgcggtgtttggttttttgtccttgtgatagtttgctgagaatgatggtttccagcttcatccatgtccctacaaaggacatgaactcatccttttttatggctgcatagtattccatggtgtatatgtgccacattttcttcatccaatctatcattgatggacatttgggttggttccaactctttactattgtgaatagtgccacaataaacatacatgtgcatgtgtctttatagcagcatgatttataatcctttgagtatatacccagtaatgggatggctgggtcaaatggtatttctagttctagatccttgaggaatcaccacagtgtcttccacaatggttaaactagtttacagtcccaccaacagtgtaaaagtgttcctatttctccacattctctccagcacctgttctttcctgattttttaatgatcaccattctgactggtgtgagatggtatctcattgtggttttgatttgcatttctctgatggccagtgatgatgatcattttttcatgtgtctgttggctgcagaaatgtcttcttttgagaagtgtctgttcatatccttcgcccacttgttgatggggtttttttttcttgtaaatttgtttgagttctttgtagattctggatattagccctttttcagatgagtagattgcaaaaattttctcccattctgtaggttgcccgttcactctgatggtagtttcttttgctgtgcagaagctctttagtttaattagatcccatttgtcaattttggcttttgttgccatggcttttggtgttttagacatgaagtcattacccatgcctgtatcctgaatggtattgcctaggttttcttctagggtttttatggttttaggtctaacatgtaagtctttaatccatcttgaattaatttttgtataaggtgtaaggaaaggatccagtttcagctctctacatatggctagccagttttcccagcaccatttattaaatagggaatcctttcccaatttcttgtttttgtcaggtttgtcaaagatcagatggttgtagatgtgtggtattatttctgagggctctgttgtgttccattggtctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagataactatgatccctttatcaagtattacatgaactttcaggttatgtttttaaaattcagacagtacagaggtatgtaaagtcttttttaaaaaaaattatcctccttcccactctgcttctcagagttaattagtcatggttaacccctggatagttgtcttttcctgacccttttccatgtaacctagttgtttgttgttgtttaacataaataggatcgttttatagctactgctactgaccctggtctgcataaatagatgtctaccttacctgttttatgatctaccagctacttaaatgttggtatttcccagcatagcattttgaataattccagtgcttatatcatttttttttataattatgcatctgtttttcctaagactctgagctggtaataatagtgtcttttcatgttcccttgtctatacgtacctgtaaattcagtgagtgaatgaatgaatgttggcatttttgcacattcagttagatcatcctaatttatattatgcagagaatactaaattatatcataatttaaattcaaacgtaaatatcctaagcgctgtagtaaacatattagtataatttttataaggtacagttaatctatttctcaggttatttcctaatagtaatatattaattttgcttttgtcattaagatcaccatactattcaaaagagaattctgcacaccatttattttggttaggagaaatattggctagttgtttctgttttgtatattttgaatgggtgtgtattttggcatctcactaagacagtattttgtatgcaattcattcttcataaaaatatcatttatctttaaagggaatataaatgcataatggttatataaagagaattgccttaacacagcatctcttcattaggaaaatagttgaggtttatgaagtgagccttgtcagatacaatttgagctgtcttgctaagggttcccattcagtatcatggactgttcacagccctgatttaaggagaaaccaatgaaaacatctatcatctgatagccataggatgtcatccaaacttgtgtcatggtcctgtaatgttcccgggtttgtggagtgaagaaaataacacttgggtatttggaatttattcttaagctgtttttgtcagggatggatgagtttctcattcttgagttgaaatgaaacttttaaatattcttaataactgtcttatcgccagaccctctgcatgagacaccaagggtgagtgtttgagaataatattttttaaatttatttgggtattttttttaaagtgggggagatgagactaatttatgaacagtaatgagctgaagtcagttggtcactaacagtccatatcaagccatgatccctgcctgcacaaatttgaaaaacatgtaaacaaacacaaagtaagtagtaaagaaacaggaaagtagaaactacacaaagacctttacagtctatgcgtctgtaaaactaattaaaaatctgcctaaggggttaatggagtggctgaaactcaatttaatatgggtcatggtctcggggaaggcagttcaagtactatgttttaaagacaggttcagagaggaaagaatattctatttcagggactgtcgtaaaacaataatccaagatttagttggagacttaaagtgagttcatattatggaaggatttaaatgttggaataagaatttgaatgacttcagcaaggaacagaaaaggaataaaatgattctgcccgtactgataccttgtatttgtagatgtactgtagtttacagactccttttgggaatgttgttttattttatctgcactaaatcttaatgaaaatcacaaggctttttgaagactgaatctccaggattgctgatggcaagctgcatctggatgtaggggattaaggggagagaagagaaggagacaactcactctgggtttctgtgcacccaaccaaaatagggaatggaaagaggcagtttgggtgagaaaagatgatcaaacctagccaagactagtgaggagagctgctgacagtgttaaatgtcaggtcctgggggatgagaacagtgaagtttagaggttgctggtgaactttgcaagaacacgttttgcagcttggtgagcttgagagccaccaagtctgaatggggtgaagcatagccggatggtccaagagacacatagttaggcaatggaggaagctgatggactcaagaggagaagtaaccaaaagagaaatgtgagggtcaaatgatgcttgtaaatcaaggagctgctacgatgttacaatttagagaagcagcagcatgacagcatgagatcatgttctgtgttgtttatttgcagtttgttgaattttacatccctcaggaaatagctgtggctcaaaggcagacagctttgggtagaagcacatgacagcagcatcggagaaagctagtcagcagtggcagcagcaaggcaacagaccaggtactcattaccatggagggagctgggcccctgggatgggctgtgggcgttgaacagcacagtccaccaggctggccaagcatcttgcaaattagtggtaccaacatcaaacacgtgtgatcattaccactgaaaacataactcagagctcatgcccatagggttgtcttcatatatatgcctttttttaaaaagagtatttacattaagtccataatcagcttgatcagatcaagccagccaccctcatacctgaggtatttataaatgctttgtgtgttgggtgtgtgctgctgctgtgctcagcgcccacctggattgatattgcacccaggaattgcatgaagggaagtggtagatgtgtatgttttctcccagtggtccctcttcgtttctctcagcctttcaccttgccatttctgtgcaggattatttgggggtaaatactgcaagaccaaaatatatagcttattcttagcgtggtgaacccttgcattggcatggcatgagataactgtcagcagatttctggaattcacataaatggcatccaaaggaagaggctgtcagtcatcaggtcatctgtgtgctctttgccattctcacagttggctgattcttcagggcacatgtgcatagatggagcatttgttggccctgactcttgctttcagaggctgaccagaatcacagccaggcactgttgtaaccagacagtgccccagtggaggaatcacgctgctcttgttggaatccaaagagagacactttgtcatttgtttattagggatacttatattttatcctggattgaaaacaataattaccagaaaccatttgttattgacacaagctgtctacttttaaactcaatccagcatttaaggaaagcaatgtatcttcgccaaataacttgaggtctttgtgtgaggagccgacagatggagtccattgatgatgaatgcacttggatgcacacagagtccaggagagcatccttgggccatgagggtttgccagaaagttaacaaggctgggttcagaagggctgtggacagagaaagtcaaaccagtgaaatagcatgcatggagattcttttttcagtgggatagctacgagggcatttattgcacctgctttaaaacggatacaccatgtattcgtttagttttggccatattataggagtaacttacagaaaagaggacttttagtacgatagtacttgagaaatcaaggggaaagaaattgtcttaaattttaccctgtgaatgttatctgttacttaataatacttctatagcttgagtggttgggataaaaatttaaagaataggacttccctcaaccaaatagaaaatatgtggttgctatgtttttttaaaaaaacaaaaatacagaaaaatatatagaaaaaggtgaaaattatccaaatcccacctgtatacacaggtagaaatatatgatttcatgtaattgggattgtactctataagctaatctataatctataatctattttaatcactcctttctatgttgttgaatataattttacatcaaaattttaatgcctgcataaaattcagttatacatgtatatcctgttaatttattcatggtgacattcattcatcaaatatttattttcagtcttactatgtagcagacactgtgctaaattctggggatgcagcagcaaactcctctctcagtggatatttaggttattgctgatttttctgttagaagcaacactgcattgaacatccaatactgcaacatgtctttgaatactttattttctccttagaataagttcctaagagaattgtctggtcaaggagttggcacattttgaagtttgatctgtatttattgcctaaacattctttactggaagtgtcagatgatgccagttactccatattctcatgataatagtttttattggtcatcatctttgcaaacttgatacgtgaaaaatgatactctgcaattttaacttatatttctttgattttttagtgtgcttggaatgggagttttaactactaagaaattgtgacctccttatgatctatggagtacacttttctttgagtcttaattttatttctcttaaaaaggaagatctttttttattttcttcttcagggtcaggttagaatcagtgagaggttgtctatttcagggaactgaatcctcactgaaaggatattgtataaatattactactgacttaaatctagttggttttagcatcgtgtaactattatcagagcttttgctctagttgttagtatgtcataaggaagacttatttaattcaaagatatatttaactcaaagataaccctttgagttaaatatgtttaaatttgtatgacttgattaattgccttttgttttcaatagatgccatatttttgaaaacatgaaagaacaaagaggcatttaaggagtacttaaaaaaaatcataaaggtaaatgcctaaaaatatatggtctccatttagcttatcacctagctatgtagcatttaaatttttaaaaaatactgtttattttctggccacaagtgaaattcagcagtagctgaacaagacagatatgccaggcatggtggctcacacttgttatcccagcactttgggaggctgaggcaggtggattgcttgagcttaggagttcaagaccaagctgggcagcatggcaaaaccccgtctctacaaaaactacaaaaattagcacatacctgtagtctcagctgtgaggctgaggtgggaggattgtttgaaacccaggttgaggctgcaatgagcgatgatcacaccactgcagtccagcctgggcaacagagagagactctgtctcaaaaaaaagaaaaaaaaaaaaaaagaagtactcagagaacaggatagaactcctttactgaagttccgctactcaaagatgaccaatgtctctggcctttggaatattttattctagtatttttttcctctagttatatattttacaaaaatggaaccatactaagactgtacagcattttgaatctcagcaaatgtgtatacttagttattaacaaagagagggagtagttacctagattttttttatgctggtttaatgggggattttgtttgtgttgctatttatttgtaataaatttttattggaatgaaaattaagtataattgaaagacattttagacaattaaaactacaaacatttcagttcctcctaattcattgttcaaatctcctgcttgttatgcaatcagaaataatatgaccattttctctgttatttgggaagatgtttaaacagtttacaggctgcaggaggctgcagctgtagccatttcctgctgcttctactcctggagaacatggaggtgttgctgggctgaccgaatatgaactgcctgaataggtgtctgctctgaacctttctcagctctccagctctcatccagtgtgattgagctggatttcatgagctagttctgttattgaatactgtcaaaattaaattttcctatattaaatttgttttgagggaagccagctcttcaaagaagtctattaggaaatctttttaaagcacacctgtgtacatacacacatgcagaactgtgaattcaccagcttacctgccttgcctatttgagattatccaggaattacattttacaatttttttaaaagttgagaacatacctgttcgctgcactcatgcatacgtgttcaacagtcaaatccttgcttgcatttctgccccatatagagtagaacttccatgtgaattcattttaatggaaaattaattatttttattttattgccatctcccactttttgttatagaacaagtatggagttgttttgaaggctcagaccaaatagatatttttaaaatatgtattgtgtttggcattgatccttgaaaatatctttgccactgggtgaaattcataatttaggtttatataatattttcttaattctaacagtatatattattctatactatgtatataaaattttttgcagaatttttttccatttcagattcttcattatttccaacttttcattagcatagatcaaattttacctgtatttaatttagaactttaattatttctttattcttctaggaaattccagaagcttgcagtgaaaaaaaatctttttatgtttcagattttgctttgttttgttttgggtgagaatatgggacctcatcaatgaaaatggctttatcgtttggctttattgttttcctccccacttttgtctttagaattataacaactcataaaaccagagccaattctgaaagtttccccaaatgttaggttttgttttctccccatcattttgacctatttctaaaatgttgaataggaatactgtttgaagtcgattgttggcatgggatttttccctgtagcttttcaactcctccagagcaaatgtgctttctctttacagagtgaacataagtcaagacagcagtgaggcactctggcgctgggacacagtgagaaattaagatttgctagtgctggttccagggcggcctgaactcttgtacttcagctcatgtcatgctgggacagatctgaaggaagatccatctccctcgggtttcttgatacttctgtgccttctgtctggcaagggcgtcagagccacgggaacttagaggtagcaagggctccccacccgtcctcaacccacttgcaagtttcaactcacatctctttgaggacactctggcatccacgcacatcctcttaccacatagtgaacatctccattaatagctaacattcctctagcactgctaagaccttcagtattcactgctgctttttggagatcctgtgaaataggggtcattattatctccattttgtagatagcaaaactgaggcctagagaggtaaagtagctgatttaagtctgcaacttctcattatggtgtggagtctgttagagtcctgcatgctagctcttaaccacagcactcaatacctctttcttccaagcaaattccaataaagtgaaagttgaaggccataaaaagtatttgagaaacactgggatttcatttattgggatttgacctacattctttctgggaatattgtcaagatgagatatagtttgtaaatgaggctagtgcagtatgattattctctcaagtttgcatttcatgagtcatttactcatgctgtgttttgtagagtcttcctgaaggtgttgggttctctggtggtgagtatatctttcttaaattgctgctgtggtaggccttggtaaagttcaactgggttggatggggaagttctttgaactctttcaaaaatcaccaaactacagataatcgcaaatctagcagagggaaaatatcagttatttaactttgaaaacaaatccaactttgtattttagaaattacttgcaagacagtaagtccatgattttacaacacaattgcacttgtaggtttaaaattagaagtaaatagcatagtaaatgctcattcaatagttgtttaatgaattaagtaattatattgtttgtataattttgaggaactagaaagatgagtgaggcgatttcaatgtgtacatgagggcaacaatcgtgtataatatctacttggcacttcacagagggcatgactctttccataaaaatatttagtatgttcatgatgtcttttatctaaagaatttcatgctttagatattagtcaattctcaaaacactactctgaggaaggtgagtgacacacccctttatagacgaagaatttgcagttgaggctggttaaatgtgactaactcaagattaacactggtggtaggagacttgtctctggcctcattctgtgcccatgacctgctctttgaccttcaggaagctttatagcctcctcctgtccaacctccctcccttaaaaaaaaaaaaaaaaaaaaaaaaaaaggaaaatttctgatttaattacctccataaaggaagagtgataatttagctgtgtaagcatatttggtttctaagtatacaactaaagtatttctagccatttctccccaaactttttttcttcacacagttccacaaagtgcacaccaagcagatggtacagacaagaacatgggttatttacagccagtagagtagacgaaggcatatgcgctaagccctcttaaacccactccctgggagccattaacacatccatttagatgaaagagtcccgaggttttgccatgggcatttctgctacactcccctgaagcatcgccatctgccctgcctcctcccagaggccttgtcacccccactcctgcccagccacagccctgttcttccgagtgccctcattcacttagatgcagagctgatagcagttgctctctgtttttcacttaagccagtttagctctatgtctgtctgacttccttctacctccaaggatgtacaaggctctttacaaggctacccttgggccaaattcagttccctacagttccatgtaagtgttttgagcactgtctacactttaaactgggtcctggggtgcagagggtcctaggacgtggtcccttggagccagtacatttgtttcttcctttgtgctgcagtttcaaggctatacctgtgatgcctggagagtcccgttcttccagatctgtagaccagctccctctgcttgtccttggcccacaataggcgctgcagtgcccacgtctaatctatataatctgacagtttagcaacccacagctgactagcaataccttcttcattttcgaactccaaattcctggcagaacgatctaattagtttaacttatctttttaaaccaggctacaacttgtaggttcctagccagtatagggatgagcctcccttgcatcagttgttcacccctgccccatcatatgtaaggtcacccctaccctcatcatatgtaaggtcaagtaaggttggaacagattcccagagaaggggataagggtggggcagtcacccaaaaatgtgcagatgtgctttgagagatcatgaaatataaaactacattctgccctttgtcttcaaacaagtctatttgtgaaactggattcagttagaataaggaacacagaagccatttgacccacattgtccagtgtttgcagtacttacatttacagctccaatccttatactgtacacataccccaagccctacagcctgctactacccattatggcatctttaaaacgtttccttttgaaagtttcctctaaacttgatggcttctgtaaaattaaagtctgtttgtttcctgtaattctagcaacttagtaaatctaaagaaattcataaatgaaatcatacagcattaaaaactttctgtatcttgtgtacctaaaactgagctcctagagttaacagctcctgactacttgtatattcagcaaaggcacaggcagaagacagccatgtttgccacatatatcagctggtgccgggcaaggttggctcctgtgccaagcagctccaattattctttagtaaaacacacttttattcattgaggagcagttgcttgccaatgtattatacaattatatagtgaatggagaacaacggatgcattgtagaaatatttttaaaacaagtaaacaacagtggataggaaaaggaccctaactccaaagtgaagactgctgacatatgggatttagcaaagcgcgagtgtaaggaagagttcagaaggacagaatgctttgtttcaaacacctcttcctggaagggccccaggcagcattcatttctgctccacccacagggtgggttttcggggaggcacagggagcaggggtgtgtaggcatgtgtggaagtgggtgtgagtgcacccaggcactgggcttcacactcgtatttgtaagaagaaaaaagacagcatacattggttgatttagtgcttcctgaggtcttaacttgaaaggaacatgaacataaatgtaaatttttcaaggggttagagtttgcgggtttgggtgacttgggatgaaacagggccgaactaaaacatctaagagatttacagttcacacaggaggtaaccattgaaagtgtttgcactttcaataccgcagaatattcagtatttttaccagaccgacatcaagtggattcacatcccatgactgattgcacttgtaatttaattctgcctggatggccctgggatactctcagtgaaggccttccatgaatcagaggtttttctcttcccattccagtgacagccaaaggcccccttgttagacctgatgccaacagacaaggagaccacctttaccttaccctcatgatgtatattcccatattttcatcctaatagtgatataaatctttaaaccttaatccttaatcatttatcataggcatctctgtcatattatgaacaagacaggattcagattacaaagcagttttactaaatttttattaccctctttgagctacagccatctgaccagagagctactaccttcactgaaaggattgctttttataaagtaaggaaatcagtcattaatccctatttgagggcagttagaactaaaacctaagtttttctgattcatgaggtgtacttagtattacatcagtgtttccacactttagtcatttgtatactaccttaatgatttttgctatatctatgtgccacctttttaagggaaaatatatattttcccttgaatttattttttctactaaatttttaaaagaaatttatatgaccatctcaagtagaaaaccgatattctttgatagaaatgataaccattaaaatcaataagtgaaaataagagaggcccatgcctgaaggctccgagcctaaggccacacctccccagtgaagagggggattggcaggtgttggagggtgtcactgacatggcaacatctggctgagactttggtgcctgaaaaatattggaaaataaataaggttcatgttctgtggtttgatgttagtgccacctaacatctgccatgtgtttgtgaaataacctggtgtatccctaggagctcacatcattccccatgccacgaagcaccatgactaatccagaggactcaagagactcgtgcttattcttcacttatgctgatgaaaagtgcacatggatacagggaaatgtaaatgtctctcattggttacccactgaaggtaaccatagagtagagaatggcaatcaatcgcgatgcctcctgagaactttttcaggttagtggaactgacgttagttgtgtggatcttgaaagatgggataaagctattcttcaacccatttattttagactacctgaaagcacatcatatgtttgtttgccaagatggaggtaaaacctaactggaaaatcatatattttatttttaaaaggccacttttgctataggccatgagtatgggcagttaaagcttagtatctttccattttaaaaatctgagatattttccttttctgtagtgtatttatttttgtttcttttaggaaaaaagcaatgggggcttcataaaaccagataaacacttaccgagtttaacataaaacacattgaaaccttcactacatggctaaagtaagatatcatttcttgcatggaataggtgctccataaatatttgataagaacatttgtgaatttattgttgaacgacttctctggacgaagttgtgtcatttcaaaagttactggtagaactctgcagttacctatagcatcaggtgcttccatgagtgggtgtggcacagcctttagctgctgtcctgtgtgatgatggtggtgagggtttgacactccctggtatgcttgcttttgaagttttgcacctggcgtcttcgtcatactcctctgtatccaaatactctccactctgctctgtgccccagaaaattgacttctatgtacaacgtcagtgagttcctttccctttggtttctagttgagtttagcaagaagaatgtccagagactggagggagggagaagagggaggtcagaatatctacccacagtggggtccctcctgattcgctacagccctgaaatggggtcactatccctgtcaggcagcccttccgtgagcgtttctgtccaggttctggtgtctgcttcctcaccttgccccttcagcctttaggtataacagagccaccctacctgtttccccctcaatactagcccagggggctgcactaggccttgtgccctgctcacttcttggcaaatacccctttgtgataatttgagggtgccacctgtctcctgctggtaccctgattgatagagagtgtgtttgcagatttgctgcttcagtgcctttgtaacacagcaaagctgagtggttccagagggactgacctctgatctcaggttttttttgttttttgttttttgttttttttgaggctgagtgttgctctatcgcccaggctggagtacaatggtgcagcctcagcgcactgcaacctccgccttccaggttcaagcaattctcctacctcagcctctcgagtagctgggactacaggtgcatgccaccacacctggctaatttttgtatttttagtagagatggggtttcactatgttgaccaagctggtcttgaactcctgaccttgtgatttgcccacctcggcctcccaaagtgctgggattacaggcatgagccaccacatccggccctgacctcacctttaatagcagggtgttctataccagtgtggtccccaaacctgggggtgcttcagaaccccctggggaagttatgaaaatgcaggttccaggcctcacctcccaacctattcatttggagacacttaggatgcctctaaggctcttgcaatgattaaccttttgtagttgactggatgcagaacctgataacatagcacccaagcctgggcagccctctgaacaggtgactagataaagggcactcgatccctgctttttgtgccatgtgttagtcttacctgggggtaagtgagtgagtaatcaagagaaactcctgctggctgtaaagaagaactatcctttaaaaatacagtataatacaaagtcaagaaatcaaactaatttgagagagagtggaagaattgctcttttaactccttgttaacaacagtgaactgatccattagcaggagtgaccagacttccctggctcactgcacaagattctgaagaggccattttccattatccaggagtaaagcccagtgtctattttgccctggagttcctcaccatcgtctgctgagaaacaaattcttgtgtgctacaaaagtacaactcaagatatgaaatgtaactaaatacaagacactgttttcctacaaaaaatattataaataagtcctctgttaaaataaatccctcagtagatcccttgttataagcccatgaaatgagtagtctgtccctgtcacacacagcgcagccagaaaaggcatcaacattccattcttccaagggaaacgtgaaatcagagctcagcactctgaatgaaacaaatagcgtgtggaggacaatcagcgctggggtccggaagacatgaattcaaatcctgcgtggacccaggggtccatttctccttcctaggctgttgggaggattgaataagaatgtgaagctcttggggcatgtaggattctcagcctcccactcccactcctaccatctaaaacatttcccaccctagtctcggcatagttaggaagatatgaagataatgggaaggtgcattccactgagtcagcatgcccaggtgccagcagctctctgcagtgggtattgcaaaattataagacagaatttcttggtccccagttggtaataatttacctcaccttcaatagtgggccgggacattcagcagctccatctcctgcaaaggtcctatgagggtcactctgctgaggctaattgcctgagaaggatagtacactatctgttttgccacattttgtgatttactttgtttcaagccttttccttttggtggtttggtgaaatgctgttagctgatgggttgtgggcatgaaggtgaagggtcatcttggaccgaataacctagggacagggatccttccaggagggcagagctgggccgaaggggtgtcctcctgacccagtcaggggtgcttgagtaatactgatgcaagtgtgtcccaccccctcctcctctggttagccttcagagccatctagactgatgtgctctggaaagagagagatggttctttatggcccctggggttatatttgaccaacgtccaggttccaggagttacaagctcgtgcaattgtatttcatctccgaacacaagctggttaaaaaggagaaagttcagtcaggctttgtgttttctacaatctaaattagatgctagtgctggggcaccctaggaactgcgtgggaagaatgtggtgaccagtctacacgtaaaccccagcttcctactgcacccatcccacttccccgttccttttttcccttatctacagggtcttcaactgcctcaagagctgttgtgggctcagaagaaaaggaaaagactaggaaaagcagaaacacgctggaggaactactgtgagagccagctcctaagtggtcccagcttcccccacccctctgcctacttttttttccacttcaacttttacacggcctgtaattcagtcattttaatttgaggttgtaaatgacctttaaagaaaaagcagtggtttcagagggggctgatgactcattaaatgatcagtgatgcatgtgtatgagttaattcagccagcttgttcaaccaagggaagggggagggggctgtgcttggaagggtggtcagtagacaattcaggtgcctcaggaagaagggagccaggtgggatgtgtaatgctgtgaagccgataggaggagcagaaagggggccagtgtaggagggcagaaggaacctgaaccacatggacccttgttttattctgcgtaaagactggtttggtgaggcagcctggtacctaagaccaacaacagcagcgtctcacatgtgtagagttgccagatttggcaaacagcaaaatataggacacccagttaaatttgtatctcagataaacgatgtataatttttaatgtaagtatgtcccaaattgtgtatctgaaattcacgcttatccagacatcatgaattgtatctggcagtgttcacaatggcttagaacctgatatttgacagctccgtgagaaagatgtctgtcccactttagtgatgggaatgccaaggctaagaggggttgtggttgccagcctcttcgctggtagaaaagaagccttcaaagatagtgttcctgctccttggccatacatgtaaaacgccttgtaggactaaacagttgtctggcaaacacacttcgagtcatgtggtgtttatctcggggtagcagaaagggcactagattaaggggaggcctgttagaaaggctgaagcaggctgaaaaggactcctggaggttaacccctgggttaggtttaaggcagagaggcctggaagaaacataagaatcacctggtgtactttgataaagaagctgaggactaaggaagtgatgtggtgactcaaatcacaggagaaatgaccagcgaagcctagagcagcatcagggtttctgaagtcctcactgagttctttctattatattacatggtgctgacgtagcagattcttattaaagcctccaagtttccacacaacgccacagtacccactggtgggaaggaccacatactgcttatgagtcacagccctcgttttcttttctgttggtgtaagtactgcctaagtatccccttgttaccaagaggctgattatgtgttataccccagtgaacaaagactagggaccaaaaattcaggttgtgccatttattgcattggacgtaatttagggcatggtgtgtttgtttccaaaatccagctactcaatagaatgaaagagaaacttaaagttttacctccttctggattttttaaaaaattcattggttttgcgatgtagcatcctattcctgtgtggaacagggatgctggaaagccgcagtcccagtagtctgcttatgagctactggggacctctacagcatccacctgggaagaaaggaatgcccagaacagagggtgccgcttctaaagctgaggtctctgttccccagttccccccagttcccccataaaatctgagggttttatgatcacaggggatgtgggtgttcttcaagcctgactttggcctgtttttctgaatccttaagcatggccctcgtatattttcagaacgatgatgtctcttcctgcctttaaatacacaggaatgaaatgttccattttggtttatttggtttactttagcagcttttgatgtaaactgtgggtttcagcataagaagacttaagtgaaactagtagctgtatccacactgtctcatccccgcagtcaattagcacgtgggaaaccattttgaggggaggaggtcatttctgggagagaagaagcttttcctgttctcttctcatgtggtttgctccattcctaacactatggatatttttttggtgtttccttggaaagcaaaatatcccatattaacataccatggctgctttgggaagctgtgcatttccgcagattattccttcaggaaactctacatttgcgctgttggctgcaagaatgaaattatccttggcaagttgtttcattttaatctcaggagcaatggtgttaaatgttagccagtcaaagccataagcaaagactgttattcaagtttctgtgttaaccctttatctctgtggtctttccccacctaccccacacccccatgccccaggagtcactggttcaaaacactatgaagtggattacttccttccatgatactaacagtatttatacttgactcttcacagattggagaatatgaaacagaatgtgaaactaaacagctgaggatatatgatgaatgaaactggctgggatctgatcagttttataatttgcagtcctcaattcagagtagtttaggaataagaaaacctcttggacatttattaatgttaccggttgacttaaaaaaaaaagattgtggggtaaaaccttacttccacagtcaagccataaaagtggcatgatttgggagagaaaaaaaggttataatgaagcccaaatatttgaagtgattgaattaatactttcagaggagtgcccctgaagggcagagtgatttggaatatccagaatattaatactaccagttagccaaaagcagtgctcaagggatgaagcaggagcttggccttggaactccaaatggcctttgagggttagtgggaagcagatgttttgaggcagttggaggatcttgtgaacagtcttcaaagcaggtggaggctttttaataaagaaaagtgggtaaacagctaggctgctggatttccatttttctcccttagaagaactagattctggtcatcttctggtcccagattatacgatttcctagccaagaaaatcatgtatgattgagaaatctaggactttttcccagtttatttaagaaacccactctacatctatgttggtaaatagtggttaagtggactgtggctctactacgttcctgtcccacaaaggaataagatgctgcattgtaaatccaatgaatttttttttttttttcagccagaaagagtgttctcacactgctatgaaaaattacctgattgggaccaggcacggtggctcatgcctgtaatcccagcactttgggaggctgaggcaggcggatcacttgaggtcaggagttcgagaccagcctggccaacatggtgaaacctgtctctaccaaaaatacaaattagctgggtgtgatagcaggcacctgtagtcccagctatcgggaggctgaagcaggagaatcacttgaacccaggaggtggaggttgcagtgagccaaggtcacaccactgctctccagcctgggcaatagagcgagactctgtctcaaagaaaaaaaaaagggattacctgattgggttatttataaagaaaagaggtttaattggctcagagttccacaggctgtacaagaaccatgatgttggcatctgctcagcttctgtggaggcctcaggacatttacaatcatggcagaaggcatgggggaaccaggacttcacatggccagagcaagaggaagaggagagggggaagtgggagaggagagggggaggtgccacatgctttgaaatgaccagatctcatgagaactcactatcatgagggcagcaccaagtgggacatctgcccccatgatccagtcacctcccaccaggccccacctccaacatctgggattataattcaacatgagatttgggctgggacacagatccaaaccatatcagtattgcattgttagttaatgtgggatatgtatattgcttatctgccaagtaggctacaaacattttgaatgctgagatggtgtctggtgcttctctattcccttcattgtcatctatccagtgtcttgcaccttgtttagtcattcattacacagagatcttcccctggtgcctaacagatttaagccaggagttgtggggagctgagatggaggcaaagccattttctcaaagaatgctcacatatggtttgtccacagaacacccatatatatgtatgtctaataccaatggaagtgagaggaaggagtaagacaaaaacagtgcacaacccaggcactgttttcatttgtcacagtctcagatacacttgctacttttataagtggcttatgtttttctagtaggatctggactactggagagactccccagtttactgagaattgagagtgaacgacgtattcactgatgtgtctaagtggctggtacggaagttctgttgaattttggtattccagcattatccaaccaatcatttccctagccaacaaatgtctatatatatttgttcaattaaactacatgtcgtaagaattggcatttattctgcttcctggcaactaggcaggtgataaaagaaaaatggggagctcctttgaaaagccacctaattctaaataaaatgtacacggtgtatggagctctgccttgatgatgatggccatggtttaccttggaatatgtaaattcagtacccccttaaacctgaagtgctctaaaatctgctgtgtgggaagtgaccactgagccagaagatcaagatactaccctgttgttgccagtggtttgagcgttgcttggccacctgcagcatcgccagcggtgcacacagtgtttccagatctctcaggtatgaaactagactctcagtggctaaatgtacacatccccattcttctcccactgtgcatctaatccttaatgttgtggacttgtaatttgttggcagaggtccttctactgtctgtgaagcatcaggatgaaatgtaaggaagtgtaaggtgactaagtatgaacgagcaaatagtgattagacttttagattcaaattttgctctattcttttcttaaatcatggaagttagtcatttgccatttatacttgtctgtctgctgcagcccccatgggttgctatcctctggggatatcagtaatctggcatttgatttcccatgagaagagttgaggagagaactggagatgtgggcaggagagggttaaatctaaagctgggcttccagacatttgaggcagagctctgtgtcactgcaaaataacctgttcattaggaattctgtggcatcatccttggaacttaaattcccattttcatcttagtgggtatttttgtaagccagtgaatagtattaacttaagctcagaaaaaaatgggatgagcctgtgacagatttaggaagcgcggttgcagtcgttcccgttttagatcatagtaaattccttctgcatcaagctcactttttgtacgttttcttttcctcccttcctcatattcaatatcccttcggcaagttgtgtccatccctcctgctccactcccgtgagtggctgtgaggactcgtcccacagagcctcccacaagctgtagagccttgtttctcccatcccccggatccttcctaccctgtgctgagacctgtgcctcattttcagctcttctggggtaccgtgttattacttgaaagaaaatttgaaagcattttacgttgcttattacagatcattaatggaagctccactaaaccctgggaatttattctctcattgatgtgtatataactcctattaacattaataaagttgtttagaatcaaagagccagcagaaacccgtaatagagaatccattttgatcctgcttcacaaagtgactcatacccacagggcatcaacaagcattttaaagataatttttacaactccctttttaaaagtacagcaactactgaatatatcatggcacactcgtgtccttcggaataaaccctgccggttaccatttgtacaggactgccctacctgggtgggaagctgcgaggtttgtccatatttaaccagtgctggaaatgtcacccgtggctgccttccctgcacgtttccacaggggagctggcgtgtgcgggactcccacataacaagggtggacaaggcatgggtgcagtaagaagggaattgcacaagtgacagcctcacagacagggggcagtggagatgtccattcacctgaaccacttgtgccctgccctgcctcagtggctctggacaggcagcatcatgaaacggagaactgaggggtagggggattttagtccagatattgtgaagctgtctgaacctattaataccatttaccaatccttacttgatgaaaggaccacaaggagacggaagatgtcagaaattagtagtatgtatctgggaaaatatccttaatctttcacataaaatgcgaacaccagggggttagagttgcactttctctgtcagtgtattggtacacttgttattaagtcatgtcaatagccagtaaagggaaacatctcaactaggcacatcccattttaatgtctctgtatttttccctctccccacctctatttccacctcatcttctaatttttacaaatgttcccaatgtttgggaagtgagttcagtttgggagagagacaggatatatctgcacatttacttctgatttggacatatggttggcatccttcctgtgcccttgagtcttttcttagaaatgttaaatttttaaaaacttgtttatttttgaacgttgcttttttagaatcacccttcctaaaagggagagaggaaaaactgtaagtgaatcttattagatttttgaagtgctcatcataattgaactatttccctaatgactggtagcatctcacctagatttgtccttggaatggttcctgaacgtttcaagatcttccagttccactttacttttggctgtggttggaaacatgggtgttcatttctgtaattgttaatctggatattctgaggaagaaaaatatggaatatccctttaatcactgaactttatttctgaccctttatgtttcctaaagagtaaatatacaattttcaaaggaaggaaacaacagtagctattaacatgtagaatccatctggcactgtatagataaaaacaagcccagaacgctttttgtttattcttcaccacagtgccacgaactgggtcaggattatccttgttttacaaatgaggcagccagagccagagaggtgaagccagcctttctcagagccacacatccaggaagggtcagagcccagatgaggtgggagaattgagaacaggtctgcccagttactacccagcccagacttccaccgcatcttgcaaggatcagggtatgtaggacaaatgtcagcccaatgggtcatttgttcccggggacccagtttgaccccctggtacctaacggagtgccaggagcatgacaggcactcagtaaatatttgttaaatgaatgtattgtcaaagtcaaagaattcactaaaatgtgtcatctcatcctggggactgcccttggccactgctgaatctgttttgaaacctctttgcaggcgagtttaggaatatatgaatatatttatttaaaataacattaccagaatttgcgacatgtgccagtgtggttgaggcctctggtggctaaggtcttcagcaaattagagatgcacagtagaggtgctatgtgtatactttctctttgatttaaacttatttaaataacttttttttcctgactttaaaattttacttgtagaaaatttggtaagctataaagaagaaaatgaaaatatctcttaatcacaccatattgagatagcaatgttaagatgtatttaaactagggtcgggcacggtgactcaacacctgtaatcccagcactttgggaggccgaggcgggcggatcacctgaggtcaggagtttgagaccagcctggccaacatgatgaaacgccgtctctactaaaaatacaaaaattagctggacatggtggcacatgcctgtagtcccagctactcaggagactgaggcaggagaatcacttgcacctgggaggcggaggttgcagtgagccaagatcgtgccactgcactccagcctcgccaacagagtgagactccatctcaaaaaaagaaaaaagatgtatttattttgtcgtttttgggaggggtgtgtcatgtgtgtgtgtgtgtgtatatatatatatatatatatatatatatatatatatatatatatatgaaactttgattttgagcttgttgcttctttcatttaatattaagttgtgattgttttctaatgtaattgaataataactgaagttttccattgtgtgagcagactaatttatttaaccattcactatcctattactatgcagttaaatattctcatatttgagattataaataatgctgtactaaacattctggagtgaaaatatttgctcacttctctggttatttcttcatgaaaggattactaggtttggtgaaaatataaaaattctatacataaaaattctaaattaaaagcaaaaaaaccttaggaaaaatttatttgccacaaatacattaaaaatcttaatattccgtatcctgttttcctttcactcagcctaattttttgtcctcacatttttgttaccaggcactcattctgattgcttagccatcgtactagtttcccatttgatttaactaaaactgtttcagttaaacatttatttctttgctcatgaccctgataacatgcagcatgatctatcctccactactgagactttccaaggattgtctgactcttgtcattacatctgaaaatccctgagtaacttctgtacatctttcttggaaacaacattattaaaaaaatagtaaattcaaactactatgcactatgccaagcactgaggtgggtgttttaaagtatgatatagcccctgccattgaaaaacctccagataagacatgaccacatgacaggtgaacctggatacaataaatattaaataaaattactaaaaatttctgtttagtaatcctgactcatcatctcattttctacaatttctgcaatttcattggcctgtgccttcaacccacctgaatcttacctgccactccccttacccacgaggggatttcaatcagcatggtgtggttacatcattaaggtttcttacccatagcatcaccatgatggcaggatccccagctctcagaacagggcctggcacataatatgtgctcagttagtgtttattggatgtatgataaaaagtatgcattttttttcttcaattggagaccaccagcagatagttatgtacagtcacgcgttgcttcaggacagggatacattctgagaaaagcatcattaggtgattttgtcattgtgtaaacatcatagagtacacttacacaaacctagatggtataacctactacacacctagtctctatggtatagcccactgcttctggttacaaacctgaacagcatgttattgtactaaatactgtaggtaattataacacaatggtaaatatttgtgtatctaaacatagaaaaagcacagtaaaaaatatcagcattgtaatcttaggggaccattgtcatatatgtggtctgtcactgactgaaatttcattatgtggcacatggctgtacttagattggcaataaatacaattaaaagagaacatttgtggtgggcaagagctctagctcaaacgtcagactaatgaaggttcaaatcctgggtcttcaacttaccagctttgtcatcttggccaagttaaatgatttcttctacattcagattcttcaactgaaaaaaatagtgatagagtctaagccattgggttattaataaggataaagtgaggtttatgttaagcctagcccagaacctggcacacagtaagtatttagtaaatgttagctattattatttataaatcgtttcccttatttattgcctaactacaatctcaacctactctcaggaatatagaaatagaaattgattcatcatgagaaataatacataagctttggagtcagatctggctctgccacctcagtaggttacttctcaatgctttagtttctttatcaggtgaagacctattgcgtagggttactgtgaggactaaaatgagataatatatgcaaagtgcctaatatgttcagtactcttttctctttctgtgtcttggttcaattagaacacccttctgtttctgattttgctaccaaacatgtatttttctccctctggtagagtgttcttccatttattttggtgtgacacaaataatttaatacatgtttatatcacaagtccacatgtgtgagtgaaacaaaaactccacaaaataatgctctgtgtgattcctgtactaatttgctatggctgccataacaaagtatcatagactggatggctcaaacaacagaaattcattccctcacagctctggaagttaaaagtccgagatcaaagtgtcagcaggtttggtttctcctgaggcctctctctttggcttgtagatggctgtcttttctctttgtccttacatggcctttcctttgtgtgtatctgtgtcctaatctcctcctcttatagggatactagtcatattgagttgtggtctgcccatatgacctcattttaactctgttacctctttaaaggcctgtctgcaaatatagtcacattctgatgtgtgctagggtttagggtttcaatcatgaattttggagggatacaattcagtcaataacagttcccttgatatttttatctgtatttcattaaagaaaatgctgggcagaatcaaccaagttaaattttgtgacccattgaattgactcgggaccacaggttaaaagagtgtgctttagcgggttgtgttggcttacccggttagtgtgaaattgaaaccagcattaggacttgcctgtgacttagtgtggagacaggcccagaggcacaaaacagtaagaatcagagtggacatccttctgcaaacacagacatcaccttagcccagggttggcaaacattttctgtaaagggccagatagtaaatattttcatctttgcgggccatacagtctctatcaagacaattctgctgttgtgtgtgaaagcagccatagacaatatggaaacgagtgggtatggctgtgttccaataaagctttacttacgggcactgagattttaattttgtataatctccatgtgtgatgaaataatcttttgattttttgtgaccatttaaaaatgtaaaaaccattctcagttcatggactgtacaaaagcaggcagcaggccagatctgatccgcaggctgggggttgctgaccgctgcccaccactgcccttgctggtagagcctcagtcttctggctgcagactctcgaggaattgacctaggtgattttcctctgtccatgtacattttgaactgattatcttatttgacccttgtgattcctctgtgttttcagtaggaaaatctctgtggcattcatgatcaaaagttatttaaaaagcatatgttatcttcttaccagagaactctaattagggatgggggaccttcttaaaggacccacacaattttttgtcagatggtgaagttaggaatagagttgacaccgaaaagtctatgcaaaaacaacagagcttgaatttaaggagggctctcctttgggaagctaatatccagggaaacagagtgaccaaagaaaggcccgggtgtcctcatggcggatggaggagagcagctcagtggcaggggccctgccccgggatcttctcccaggtaggggcaggctggagggtgagtgaggtctccacagtccccacatggtttctttcgcaacccagaatgcaagccgaggtgtgtgtggctgcctctcacttcctgtgggggctgcctgcagtctcaggatgtccatctcggtgcctgcgtagatctcctcccctcccagagggtccaagagaacaaaagtgtctgagaaagccagagtgtgaccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggtgggaatggttattttcactatttcagactgacagaaattatgcatttatccagagtgacagtgcaaaggcaggctgagctgttgttgcttccattggcaggaatgagccgatcttatggactgactctggaagagcaatgttgagtgcctactttgtgccacagagggaaaacccgtttatcccaagggctttctcatctggggatgcgcagactgtaaaccaaggccccaggaaacggtttttaactaatgtggaaaaaaaaaaatgggcttgaatatccgaaacttcactttaaaaaatcagtaagataaaatttaaatgatgtgtattattttattttgagactatttgcttcatgccatcctaacatatagtaataaaatagctttggcctgacattcatcttaaagtgaattaaaaaacgtaatttaatgaaatggcacttctaagcttttagtgcagcaaattttcaaattatcttgcttaaattaaattgctgtgcttttttgctttcgatacttataagagctctgttttgtttctggtttcatcgtgttcgccctgagatgatttttttttaattgaaatgtagcattcatgcagaaaagtgcacaaattcttaagtgcactgataatgaatgttcacaaagtgaactctcctttgtaaccagcggccaggtggaaaaagaatgtcacttaaacactaggagtcccctcaggtccccatccagtcccaatacaccccagtttccatcaagggtaactgatagcatgacttctaacaagaaagattggttttatctattatgaactttatataaataaaattgaccagaagcaggagaggacctagcagatggcagaggtcaagctgccgcaagactaggggacagcctggatgtcccccagtttgcactgtcttgtgtcaatagaataacattatatttaggagattcatccatgttgttataagtagtagtttgttcattttcattgctgtgtaatactgtttaacatatcaagatgtatttagcccctctcttgtaagtggccttttgagttatttcgagtttggggctgttagagatagtactggtaggatcattcttgtgcatatcagtgggtaagcatatgtagcatttctgtaggataggctctggatggcaggatctgggatcacaggatgtgtgtgttcaatggaaactgccagttatcagtggacactcccactagcaatgtatgagagtttcagttgctctgtatccttaccagcacttcatggttttagtctttatcattttagccagtcctgtaggtgtattggtaatgcgttgtggttttaatttgcttttatttgatggctgaattagagcatctttttatatgtttattggccatttggattttctgttttgtcctctcgagtatttgtctatttctttattggattgtctgccttttccttattgatttttagagttatttgttgtatatatgtattgcaattatgttctccactctgtggcttccctttgattctgttgatgtcatttgatgaagacatttttaattttagtatagtccaaattatattttccttcgtggttaacactttttgtgttctcttttaagaaacatctttacctattacaaggtatgaaggtgttctctatgttttcttctaagagctttattattttgcctttcacatttagttctattcttcatccagaattaatttttgcatggtatacggtggaagttaagattcatttctttcatacggatacccattgtattcatttcctaggctattataacaatgtgccacaaaatgggtggcttaaaacagcagaaatttattctctcatgattctggaggctaggagtccaaaatcgaggtgtgagcagggtcatggtctctctgatgaaggctctagggaagagtccttccttgcctattcccagcttctggtggtggccaggaatccttggcattcctttcttggcagctgcattgctctgacctctgtctctgtggccacatggccgtcttccccacatgtctctgtgtagatttttttctttctttaaggacagtcactggattcagagtccatactaattcactataactcatcttaactaatcatatctgcaacaaccctatttccaaataagtcagatgctgaggtacttgggggttagaacttcatatctttttgggggacacggttcaatctatactacccagtgaacccagcatttattacttttatttttatacatttatattttatttttatacatttatgcatacttttatacatttattacttcattgtcacctttgcataagttaggtgactgtgtagctctatttttggacattctattttattctcttggtctgtttggccttgcacaaatgtcacacttttactattactctatagtgaatctttgtatctggtagaataagtcttccagccctgttcctcttgttcaggattaacttggcttttggccctttgcatttgcttataaactttagaatctgcttgtcaatttccatcagaaaaaaaagacctagtttaaaaacaaaaaaaattggtggttcagttaagatgcaattgcgaggagaattgacatataaaaatattggacttccagcccatgtacatggcccaaccctctatataggtcttctgtaatttctctcaataacgttttgtcattttcagcataaagtcttacatatcttttgttggacttattcctaggtattaggtattcttttgatggagatttgtgttgatgaaataaaaagccaagagagagaaggaaggcttctaccaggcttactacttcacattattgaggaatttttccaagtttaccaagcttagcagaactgagattcagatcaagatctccctgactccaaatcagagctgggaaaataaatcaattattactttaaaatgcaatgttagtgagataattcaaaatgtgggaggcgcaggtggataaaacaggtccttggtagggaacccctggtagatgcccttggtctccagtgttgcaacattgagaacgtgcacgtgggctggaagagatgtgagagaagactcagatactggttaggggtgggagactcgatctgagattttcagtgttcttaggactttagagttacccagaagtaccaggtaggccaggaggatggccatggaggtaggagtttgagtcctttccctcttgaaccagagctgttctgttgcacttttatctaatattttggagttgagcccttcagaatgtgtgtgtgtgtgtgtgtgtgtgtgtgtgtgtgtgtgtgtgtgtgtgtgtatctaaggttcagaactaccaataacaagaaaagaatttttttttgaaataaaatggttcccattataatggattctccaggtatgtggtgtgctagctggatatcttttggcataattgttacacatttggcatggacacacacacacacacacagttctgatactaaagaatagcttaaaaactatcagactagttattctttaacattccgttcagccccaaggttctgggattctgatattgtagccaacctaaactcaaggggctctgcacacatcattattaactttgatcttggcagcattgtgatactgtgtgtatttcatgggccttccccagagccactccagaatgtctacttggagggacttgggagtagtaatccggttggaagagagctagacgtgtccagcagctgcgcttgcatcatagcaaagcagtgtttctgttcagactgtggattgcagatcttaggaacagcttaatttaaaagggcaagtcggaagaattcaagtacactacagaacagagtttttgttttattttctttttttcctgatacatgtgatgtgatcacctgacagggactcattaccagtaagaaaagaaagacatgattattataactgtatgcttcattctcatgagtctcatagaagcagaattgttgttttttcctccagatagtcaactgattattccaatggcatttgtttcttttatttattccccaaataaactgggtactcatggccttaacgttgaaatatagtaataataatatgaaatgatatcagtactactgctgctactactactattgcctgggggttgatggggattggagatggggagctaaagccctacccccacccatccagtcatccatttgcatgactctgcccacccatgtgtgccaatgagccccaaatctttatctctccagtccagcttcagagccatggatgctgggacccctacacctggcctctagggcagctgagcatgagcttatattggtgccttgctcaacagtgagcctctgatcccctctagacctggcaatagccaatgagaagggagcagccagcttgtgaccttcctgccccctcattctgtggtcattaattcctttctgctggctgagcaccttccatgcttatctctttttctattcatctctcctcctcctcctcctcttctctctctgctgtttactcccactcaagcaaataataaaacaacaaccacaaccttgcttgagtctgccctcctgttggagtgtagccagaaggactctagcccctgcaggcaggggaagcagatgggtcagtgttgccttctcagagcacccctcccacctccctcccacccactatatccagtgaaagggaaggccacagtcagtcaaaagtaagctcagtttcctaggaaaccctgtattttctagttcccatcctcctccctggcaattgggctttgtttgtatgcttccttgtttaatggtttatttcaccatttggaactctaatttttcagacaatcaagtttgggcttgcagagaatattgtagcatggcaggttgtaggactatactatattttaaattgacagttatttttgtgcacaagcttcccagcttgtacctcatgttgcacaggatagccatgggcacagagagctttggaggggagtggaattcatgctccctgtctcccctcacccccattctttgctttcgaaaatgagactcaacaaagactcacacagcagttccttagcaagtgggccctgcaagtgtgtgttagctgtatcatcagtctatacatgctagaggaagaattggaatctcagctacaaaatgtatgtaatttggtcacagaggtgaacgaaaaaggatgaagccctttgaatgcaacagaatgactagaactgtctcctctgtgcaaggcattgggtcagacaaggtgccaatggttcgaagatacatttagcctgcattcttgccctcaaggacctggccattttccttgcagcagatagcgtgaaaagttgtacagtagaggtatatagagagtaagactaattctagtgggggaactgggcaagaacttcagggagggatttatacgagagctggcttgagggacaggttggttctgtattcttgcaggtggagatgagggcacaataagagaggaaataggacaggtgaaggctccgaggagggacaagtgagaacagcaagtgctctgagaaggcaaggcatgagggaggaggaaaaaatgaaagatacggctgatgtggtgggtttggaatgatggtggatggctttgagtgcaaagctgaaaagtttgtggaagtcattggtctttctagcagtgtcaccaagccctgagtttcctgggagctggcttaggcactgcaggggaagaagtctggtgtgccagctgctcccccagttatagaggagagagtagctcctctcatcttcattttatatacaaggatattgtctgtcttttgaggagtgttccactttgagaaaaactaaaacccattggcatatgcgtgagacccattaatttattcagtcagtcactcaacagatattaaatgcctactgcataccaggccctgtacaaggttgtactgaaagaccgttgaagatttttgaactggtcagttgcctggtagcaggggtgctgggtcttgagttaaaatcctgtctttgcctggaggcatcacgctacctgacttcaaactatactacaaggctaagtaaccaaaacagcatggtactggtaccaaaacagagatatagaccaatggaacacaacagagccctcagaaataatacgacacatctacaaccatctgatctttgaaaaacctgacagaaacaagaaatggggaaaggattccctatttaataaatggtgctgggaaaactggctagccatacgtagaaagctgaaactggatcccttcctaacaccttacagaaaaattaattcaagatgaattaaagacttacatgttagatctaaaaccataaaaaccctagaagaaaacctaggcaataccattcaggacataggcatgagcgaggacttcatgtctaaaacaccaaaagcaatggcaacaaaagccaaaattgacaaatgggatctaattaaactaaagagcttctgcacagcaaaagaaactaccatcagagcgaacaggcaacctacagaatgggagaaaatttttgcaatctactcatctgacaaagggctaatatccagaatctacaaagaactcaaataaatttacaagaaaaaatcaaacaaccccatcaacaagtgggcaaaggatatgaacagacacttctcaaaagaagacatttctgcagccaacagacacatgaaaaaatgctcatcatcactggccatcagagaaatgcaaatcaaaaccacaatgagataccatctcacaccagttagaatggcgatcattaaaaagtcaggaaagaacaggtgctggagaggatgtggagaaataggaacacttttacactgttggtaggactataaactggttcaaccattgtgaaagacagtgtggcgattcctcaaggatctagaactagaaataccatttgacccagcaatcccattactgggtatatactgggtgtatacccaaaggattataaatcatgctgctataaagatacatgcacacatattgcggcactattcacaatagcaaagagttggaaccaacccaaatgtccatcaatgatagactggatgaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctcactcataggtgggaattgaacaatgaaaaaacttggacacaggaaggggaacatcacacaccagggcctgtcatgggttgtggggaggagagagggatagcattgggagatatacctaatgtaaatgacaagtaaatgggtgcagcacaccaacatggcgcatgtatacatatgtaacaaacctgcacgttgtgcacatgtaccctagaacttaaagtataataaaaaaataatttaaaataaaagaatgtggcacgtatacactatggaatactatgcagccataaaaaaagaatgagttcatgtcctttgtagggacatggatgaagctggaaaccatcattctcagcaaactattgcaaggacagaaaaccaaacaccacatgttcttacttacaggtgggaattgaacaatgagaacacctggacacaggaaggggaacatcacacactggggcctgtcgtggggtcgggggagggaggagggatagcattaggagatatacctatgtaaatgacgagttaatgggtgcggcacaccaacatgacacatgtgtacatatgtaacaaaccttcacgttgtgtacatgtaccctagaacttaaagtatagtaataaaaaaaaaagaaaaaaagaaaaaaaattcctgtctttgccacccactaataagaacttgggcaagtctcttggccttgatggacccgttttctccctgtaaagcatagggttgggctgctaaatccttcccagctgagacagtctgggagtgacatgagaagtgctgtaaccagagtttgtgtgtgttgggaagcggggaaaagagaggccagagtcagagagaggtggtgatggcaagaacttctgtgagtctgagtgaagcctttcatttattcattcaacaaacatttcatattcagtgccagctactgtgctaagcactgggaaaataacagtaaccaaaacaaaattcgtgccctcaaggcactatctgtagggggtggcagaggagctgggaacatgggagatagatctagagatgtagtgtgaaacttatcccatgggatgacagttgggacagtggaattgtatgtaccaggaaagagatagcaaaacagtattgagagagaacgagttctgaggagacagaacctgggaacatcctgtggagaaccaatcaatgttcttccactccttgatagaaagcacgtttcttcatcaagtcaatacaacaaacctaaccccagaaatatgctcttgtggctaagaagttaggacacaccaaagagataatgtccatttagacatccatttctccttgactctgtcacttctatgtgtgaagcagaattagaccaaagccacgtatgattttgtataatagctggtctatttggtttcctcagaaaggtctttaataagtaccagtgatacgtataaaatacgtatgggtggcttcccaagtgaactgccagtccctcaaatcttttcccagaccagctggctcttttattttttttccttttccccaagtaattggagcagatccagaaacagatttggagagcctcaagcttttccttttttacccttcagtaattacatatcacaggttgtcttccctgttagagtctgaagctgagcaattagtctcccattgtctttgcaggaaatgacatatcagtgtggcttctggggagggcaactgttgaccatcctggttaaaataatttggaaagtgttcagcatttcctccagttgatcgtttagactggctgatttagaaagctgttggaaatgtgcaaatgtaccatggttatcaggactggaaatactatggggtcagttccctgagcaaaacgagtttctcaactatggctttgatctctggacctactgccttgtccctcatatgattgagcccagggccttggcattctgttctttttataatgctttgttggagactgattagtcaggatgttttccagctgcaggtaattgaaaacccaagtcaaggagtcctaaacaagaagacatttcttggaaatacagagatgccacagacttcaacgccaacctaatgcagtaacctacactctgcttccctgtgtttgttctgtctctggaccagctttatccttatactgaaacaaaatagctgtggaagttctaggtggcgcattccacactacattcagaaggagggagcttctcccaaaggagtgagtagaagctcccagaaaaacattcttcacatctcattggcttaaattgggccacatgcttattcttaaaccaatcactggcagtaggaatgggtatctcttggatcgatgcttctcaaacttcagtgtgcacacagatcacctggggaaactttcaaaatcaattctgattcagttggcttgggtgaggcctcagctgacagctcttacaagctcctggttgatgcgaatgttgcaggtcagcacactgcaaaaccttggactgtcccgcccccactcccagctgggcgtgctgccatgtgcccatgagcactgtgggtgcagaaatatgggggctcttttgggaagaagaaagagggaatgaccacatgcagatgagaactatattagagatgcttgttttcagtgtgtaattagcattttaactttataccgggagtcatacaatagtctgtgatatgtattaaaagcagaattgttacgtgggagcactcacgaaaatttcattcatttatggtgatgcaggcgttgcagctcttgaaacaaaagattaaacagtcatgccacccgttttgttatcattcagctatttttattggtaatgaataccatatatctggtgtgtctcaaaaagaacaaactcaaatgaaatggattgaaatagccttaagtataaaaagagtgtgccaaatccagcctttgttctgtgagtggaaatctcatcagtcatggttattggggagggagagtacacccccacttgtcctaagagtcacttgtcatgatattgggtatgaaaaatgctgccaatggtgaatttctgccaaagcaaatggtcacaatgcccttataagtggttttcagtggagaaagtcattatgctctattcgtttgaaaaggaagaactgttctgttattttgttgtgcttgacaaaagatacacaggattcctgagctgcagctgttcaggaaaaaggctgataagatggagggaccagtgtccacgctgaggctggacaatcacaggctcagcgtgcttagcatgaagtatgtggacaagcactgagtagaccttcccaagatagtcactgtggtagttgctgtcctggacctcatgtgcaaagacaacatcacccaggaggggacatggaatttcactgctcagtctatttgtcccacctgcctcagaaccaccggttcacatctgtgagactgatgggaagctggagcttggtgtggtctcttgtagaggccagagcaactgtacctggcctcaccagcatggatcaccaaagtgcccatacttaggaaatcacaagttgtgtcttgtctattcaaaggacctgaaaggttgagagagtatctgctactctgggctagctggggaaagctgctagacttgaagccccaggaaggcaggcattatgcttgtgtcacacaggcgccctctatattgacagaatgattgaacagctagtctgttcccaggtgatctgtcagtcaacagcatggactaatcactcactctcaaaagagaagtattaaacaagacaacattgtgttgcctaacttcagtaatttatagtctaaatatagaatgcttaggtgtcccatctacatgtttaggacctcataggctgcgaaggagcaatgagataatattaatgattacctgagctcatgtaggacaagcagattgcaccattacccgtggatggactcagcagtcctgatgagcgcctccctgctgtgctgtgataaggcgaggcattattaactgtggaaggagttttaaaatagggaagaagataggaccttccctgacaacttaaaaggctgactttaaaagtagtacatttatttaaagtacctatatcaaataaagtacttttaaaaagagaaaaataaagaggcataagataatactgctttgggaaaatcaaggtggaaaagtcaatgagaatgaagctaggcctgaaagctgggtccatgcatgtaattcagggggccgatgaagttggatggggaaaaacatgatctcatcattgtctctaacccttatctgaaatcgtacatttcctaatattatgaaagtagcattagctatttgtccttaatagaaattatgaatattttcatagttatagatattctgaagtatcatttatgcctaatagtacttcaaaattacagtatattagacttgttggaaattatttaagtattgaaagatgttcataacaattttgtcaaatattttgataactgtataagagtatactctgtttgactcctgtgcatttcatgtattagtttcaagcatttgtaaacatcattctgagaaagatgtctttagactgccatagcacaaaaggtaaagagcccctgcccttgacaatggccaggcctcctaccagaggagggatggcctgcctagaggctcagaggccggacaggcctctgggcgttacagcatttgataggataatgtcgaaaagctggggtgagcttgagtgccaggctaacatgactcgacaggtaaattcgcaggtcataggaagtggtggaaggtgcatccgttgaggaaagacaggctgtgtaggttgtgtttagaaaggattccttgtgcagccatgagagttggatgggaagggaagaaactggaggccaagagaccagtgtatgccaggcatgatgctgaccagatggagtgtaacgatgagaatagggagaagcaatgtgttcccagcaccactgtgaaattcttgcggggctggactgggccaaggtttgcagtggaggtgaagaaggcggtgttagtttacaggcccgagggactgggagaatgatgataacagctcaggcttactgagtgtttactgtgtgccagaggctgttataagcccttctatgtcgtgtatgttctttagttgatatcatttaatcctcatagcaaccctatgaggtcagtacagtaatccctattttacacataataaagcctagaaaagaaaggttaggaaaactgtccagggtctcacagctagctggcaagaagggaggatattactggaaagaaagaaaagaggaattggtttgggggaatatgttgtgagttcaactgcagatatttttccattgttctcttgtcttcaaatatttcaaagggctaaacattcagatatttataagcatagtttctggtatatttcattgtccagttttaaaattttttattagtgaatactgagataatttgtaaattggtttcatcttcctgggaaaaacagaggaaactggtaggtggaatttagtacatcgatgggtgcccgaagcagaggaagaggttgcagtttacagagagaaacataatatgtgttcaattatttctgtttaatgatgtggtttttcttttgttgtggtattgtttttcaggaccagtcctgcctctgttgtagaagacatgtggtgtatataaagtttgtgatcgttggcggacattttggtaagtgttgctgcatttacttctaatgcctcttgctgtaaaagggtgctcacgaagggaagctgttgccttgttctgtccatcttttacttctgcactaaactcaggcagaatggagttctataattaaatgtgacattgaattgatgttttctgacagtgtgatactttttcttgttattgctgatagtattaagcaatatggggttttctaaaacgtaataagtgtatatttagaaaagtttccggatgccggttaaagaatacccttggcagtttatgtgctaagccagccatataatataagagtaataaacttgcagacccaaagaataaaataaattctccaaagcagagagatccgtgtgacccatatattaaaagaaagagaagcaggcagcttaggaaatggaaaattaaaggaagctacaagtccagcttgcctgggagccagcccacagaccagcataacagtggtcttgggagaccaagaacgttcaattcagcaaccacccagaccttgctagcagggaaagaggacagtctttgggatcaggagacccgggttaaaatgtaagttctatacctactggttgttagataacctctctgagcctgtttcttcttctgtaaaatgaggcttatcatgttacctacatcatagggttgttgtgagaataaaatgaggtaggtagtgctggagcatagtaagtgttcaataaagccagtcattcttaggaacagagcagccttgtttggagactagacatttcccattgaagtcaggctaccaagaggcatatttattttccagcaggaaggcagctggggatgggccggttacatccatttgatgttgctagagcatcccagctactcaccacaacccctcctccaatattcacttcataagaacctgtgggaatccctgcaacatttaccaccttctccaaccctggtgacccattcttagacaagcttggctaaataattcccttcctgccatcctcacaaccagtgaggtcaccttgtttgagctgtgttcatttttggagttaatgtcattttgaatcacatttatgaggaaagaagggtgggggtagatgataccattggttggacttcagttgccatatttaaactttcatttccaaacctttcttttgattttacgtttttgtctatgcttattacgtagccttcacagggatccaattgctgggctgaaatttttgagctttgactgaaagaatttggcttttgggtggggcctttacctgtggttgggaaactcagccgtggcattgcagatgggccagtgtttaaggtcagatgtctgtaggtgactgtgctgccatttcatagaatcaaagagagggacatggcttcaagggttgtctggcccaatcccctgctagcaaaaaaaaaaaaaaaaaaaaaaaaatgtctcctactgatccctgacaagggaattcaaattcttccagagatgaggagcttgctgttgcacagggtaccttggttcaattaaaaggacagttagggcctacagggaaacccttgtgaggagggggtatatagttgttctgtatcttagtgctggtggtatttatgcagttgtatgctttggtgaaaactcacagaactgtataatagaaagggtgagttctcttgaatgttaattagacctgaattttaaaaatggaaagaaaaaaaaccccagcatttaaaaattgaacaattagcccaacttgttaaaaagaaagtaaggaggctgggtgcggtgactcacgcctgcaatcccagcactttaggaggctgaggcgggcagctcacagggtcaggagatcgagaccatcctggccaacatgataaaaccccatctctactaaaaataggaacccaggaggcagaggttgcagtaagccaagactacgccacttcactccagcctgggtgacacagcgagacgccatctaaaaaaaaaacaaaaacaaaagaaagaaagaaaaaagaaaaaaagaaagtgaggaatacaaaggagagagggaggagggaggaaagaaaagcaatctagtccttatattgaactattaatacagtatatgtgctccatgggacagggacttggtcttgttcctccctggagtcttggtgcctggatagtgcctgtcacatagaaggcataaatgtgttaagtatttattgaatcacctattgctcttagtcaccttcgaagtaagtccactcactttctaacactccagcccaccaaatgtttgaagacactgtccttcctcattcatcttttcttctctgggtgaatttaccatctcccgggcctggcctctttgtcctctgatgctattttcatatccctccccatctggcagagctccttgaggaggcctctacttccccacacctctcctgtgcacctaggccagcattagacacgctgccccacaggtctggcccacgaggagcacagagggtgcattgcttctgtggatgctgttaatagacacccaatcctcttccttcacaatcagtatgaagtgtctggtcatggatcataaaggatttatttagtgcagtcttctaagaaaggagctcctaaaagtagggagggtggcagtgcaagaaagagcccaggcgcagctcatcctcttacaggccttgtctgaaatgaagccaggtcctggcaccctcagtctgaggcagcatggtgctgttgatggatctttagaggcagtgctgtgtcacagattccgatttttcattacaagtcataggaagtttgaaattcttcaaactaaacttgtgggtgccttgaaaagcctaggtttcttttttctggccatgccaaggaatgatatataaacacgtaaatacatagagcagtggttttcaactggggttagttttgccctcccagaggacatttggtaatatctgaagccattttgggttgtcacagttaggggagggaggagggtgtgtgctagtggcatctagtgggtggaagccagagatgctgccaaatgtcttgaaatatatcgtagatcagtaacgcacactcgtgcacacatgcagaataatcgggcccgaaatctcagtaataccaagctgagaaactctgagattataagtaatttttaaagtgtaaatatttataaagtacttattattttgaaggtttaaaaatggaaatatcttaacatttgatttatgtaaatatacagctaaaaaacttaaattcgttcagaaaatcatcagagtggaaaggctgctaagaggctatcccttctattacccctaactccaagcgaaaaatgacctaaatgaattcagacagacagatgggcctctgacggcttatacagaatgacggtcaactaaagataaaaacaagactcacacaacatgatcccagcatttacacaaagagattgtctcgtattttaaattttaaccccagcttcttcagatgtgttagtcatttgatgacctctaagattaaacggtatttcagtctgggctagtctttctttttgaatcaaggcggttctggtgtgatgaaaatgtgcttagggaggagagagatctcattacagatgattgagattgagtattttggtacacagagctgtttatttgcatcagtttgctagtgacaccacaatctggtttacatgtgagtcgctgagagcttttgtagcctaatatggctacatttgctgaagcagggagattaaagcaacatatgtcaatttatgatataggacaacccactgcaaaagactttacctaattatagggcctattttgggagggtaatggtgctttttgtgaagtatattttgggatgcactcacccggcttctaggccagtaatatcttcccagaaagggtgtggtgtgtgcttgtggacataaatattttcttaccaaaagctgtggtgtaatattctctcaactttactacccttcatttttctttttctgatagtcttttcttttgcaagaatgctatgaaaatgtattctggaaagccagagaaatggaagataaaagatctcatttcagatggccaagtccagagataacagagattttatcagtctactgtttttaagatgaatgggatttggaggcattcagcaacactgactaataaacagagttgagggaggtgataaaaacaccgtgttggcactagatatttttatgtaagtatctgtgggaaaactatccatttgcaaccccttgtgtcccagccagcactgcccctgctccactccaacccctgggtgatcctcaggggccatttccatgcctttgctgttggcttgtgacccagggtaggtatctgcttttacttttgttctttaagactgtgcctttcacccactctacctattaacttctctgttaatacctgagacttttggccttcaaggagaggtcagaacttgctgtctggtctgcaaaataaaattagcttcttatttacacaatgtgtgtacagggggaggagaagctgagatgaagagtgaaaatggacaattttgtaacccaaaatccaaccagacctaggggctggagaaatgcttttacctaaattctgagtcatgaaggccataacatgagagcaagaatatcccatggggagagttaaaggcggagaatcccaccagagagccctctggagaggtgtccctgagactccctgagcagcctgtgggccccttcctcagaactggcctaagagctcattaaacgcacagatcctggcctaccccagactggtagaatcagacagaatccctgtggtgggtgtgtgactttattcttaacagcctctccaggcggtgcttatgcacacgaaattgtgagaatccctgttccagtctccattctcagcttttcttcagggcttacagttccatttgaggttgtatgcagcagtctggccccgcctttaagactgattcccttccataagcgtcacttacatatttaaagaacagatccctaaagcacatcattttgaaaatcagccctgtgcataggagggtagggtgtcaacttctgtgttactgtgtaaccttggttcttaaagtaatttccacagtcattgtatcacttgctcactaagaaaagtatcattttcgttccaggttagttctggcaacattctaaaccagattccttgaagttgctttgcgggaggccatcctgctcctctgctacaatcacccaagtatttgccatctgctttcactctaaaattcacactatgctgtagtttttatctgtagcaacacttataaaccaaaatttcccacttattaaggggaacattttcagaacaagtagctgtcacatattctagtgcatgactagagagataagactgtaatagttcccacctgggatccaggtggttggtcccaccccacagcctttcctctgatggcaggctgcttgtgcagatgcatattagggtatcgtaggcatagctcatttaagtttgtaaacagctagctgggtgcagtggcgcatacctgtaatcccagcactttgggaggctaaggcaggtgggtcacttgaggtcaggagttcgagtccagcctggccaacatggcgaaaccccatctctactaaaaatgcaaaagttagccggatgtggtggcacacgcctataattccagctactcaggaggctgaggcaggagagtcacttgaacctgggaggtggaggttgcagtgaggcgagatcacgtcactgcactccagcctgggtgacagagtgagactgcatctcaaaaattaaggggactccatccccttaataagtagggggggaaaaagctgcagcacatttgatcttcccaaaccacttcctaggcagtgcaatgttatcaccagttggaggctcagataatttagctgatgtctaaggcaggaggcatttgggagtgtgtgggggggatggggaggggtttgttgttgtcctcacaaagactgggaggtgccattggcacatgatgcaagagaaagtggggcagggatggtaaatgtcctgcagtgccttgaacagtcctgcccagtgaagagctgtccctaacacagtgttcatagcacccctatggagaaacactgctctgaggttgtactagaatgcagtagagccaggtgcacacccgcactatctgaatccagatcctttatagccctctctgtgttaaaggcatcacagaattaatttccacttcattgggagctctcagtccctgaaagttgaatccagagtggctattctgcaggtcatgcgattgctgccccaggcatcagaactcaggcatggcccactccatatggaaacaggctctctaaaaccccagtggcctggctagccagcatgttatattgtacctgtcctatctctatcagtgtccagtgcaggtgtgagagagagtactgtctttggaaaagatgagagcccagtaggatgctcggcccacagcctcgcatccacctgacttaaaaaccatcgtgatagcaaattgggtgttgatttcagaagtttttgatttgttatcttaaacgtcatacctatctggtgaacccttacaggagctgttggagttttgtttaaagtttagttttgatgtcagccagtaagggagctgagacagtggctacatcagtttgatgagcacacaatgaaatttattaaattggtaaaaataaaaccatattgaatgaaaaggaacccagggcaactgacctgaatatagatgttgaagggattctaaaagagggagagaaggagtagtgatattatctcatctttttttcctttcctgttttgtatttctccctctccctctccttttccctcttcccctctccctccccctccccctctcctttccccctctctccctccccctctctccctttccctttccctccccctccccctctccctctccctcctctgcgtctccctctccctctccctctccccctctctctcacccgctctccctcccccgctctccctctccctctccctctcgttttccctttcccactctctccctctccctctctccctttccctctccctctcccgctcactctaccccctccctccctccctccccctccccccctcctcctctgcctctccctctccctttccctctccctctccctttccctctccctccccctcccctctttccctccctccctctctttctctcccagtttctttcccaactttttattttggaaaatttcaaacttgctggttgggagaattataaaacaaatttcaaacttgctggttgggagaattgtaaaacaaacactttatgtcctctgcctaaattcaccatttgttctacatttgcagcatttgctttattccctcttctaattatatatataaattatacatattatataaaattttgctgaaccatttaaaagtaccaaacatcttgacactttacctctaaatatttcaccacccgtcccctaagaataaggacattcttttatataaccatactatagtactatttccacatcttaaaaatttaataataattttatattatctaatattcaattcatattcaaatttcaacaatacagtcccaaataatattttataacttacctccccgcccccaccccaaaatctgtaactgatcaaatacacttgatgaatttggttgataacttttccttcattcattatataactttaaacaatgactttttgaaaagttcaagttcgctgtgctatacagtgccttacactctgggcttgtctgcttcttcacagcattgtttagcatgctcttctcttcctaaaattggttagatctagaggcttgttattaagtggaggttaaacatcttttgccaagaatactttataaatgatgtcatgcacctgatattatatcacatcagggagcagaagaagtcaccttgttccaccatcctcagtgctaggtttcatctcttgggtaagatggtaaccagacctaaccaatgtcaaggtgcaccttgagttaataaatcatctgtagtctgatacatgggtcatttgtgaacatcctgctccagccttcctttcatccagtggcttgagtaaccatggataatcctcacctgattcagttattactttggaatattgtctgatattttttactctttcctttctcttcctgaattattcgtagtgtatgacctgggccttcatatttttgcagtgatggttttctagccatttccttgatggtcacctggattttgctgtgattaggctaaacatttttttttcttgcccttgggttaagaaggaataactttagcaaagcatttactacatgctaggtaccacacaggctcctcatgtgtagaacatttttcactttcttcccacattacagcttagactagtgaagtgacttgcccaaggtcacccagactctatgggagagtaagatcaagccatatctgtcaggtttagagctaggatttttcaacaattccatgttccctctcatcccttctggccatgccccccatccctgcccccactactacagttcttgcctcaggccacaagtgcctgcctgactgagtaggtccctaaacaaggaaagtcagccaggagactgcagctggagaagcacaagctatgcacctctaaagggcaggtactgctggacctcagacgagccatgcctgactggaaaccgggatctttatgttaaccattccgacttttcaatggcggtgactaattcagatacacggaactcaccagcccagttgccagttttcagcaccagcattactgctgtctgaggcagccttgggtaggccaaggctttgtttataaatggaatttcattgtcatttgtttgtatgtttgtttttaacatcctcttttacacagaaattaatatgcttgggaagtgatagtgttttgatttgggggatgtttgattttttgaagagggggaaagttgggtttcatagaagtgttatttaactggattacttaataggttaaggtgttattataaaatcttggattttttaattggtaggttaacattacaatagtaggtatttcatatgtaagtttaaaggaaaacaaatacatttccttctacatatcatctgtaggattttgctgttttgaatttttctgactccttaagaagggtgtgacatctgttgttcccatcttgcactctttgttctttgtgtctttaactgtgttaacatgtcacaggaactctgtcagctcagtccctgagagggactgaagcagaactaacagataaatagcagtgactctccagatgggtccaggcagaggctaaagatctctgttggtcattctacttgtttttaccagaattattcttgagtttggagtgaccgggaatggtgcaggtaaagagcttctctagacttacttcatcatgcaagaatttggtcctgcctctcattttacactttaaccgcctgaagcacagagaggttgaggaggacccaggtaaaccttgctatggtttgttcccaccaaatctcatgctgaaatttgatccccactgtggcggtgttgggaggtatttgggtcatgggcagctggatgccattcttacgatagagagttctcatgctcccaattctggattagatctcgagggaatggttagggttcttccaaagtgaggacacccctcctaggtttggcgtcttcacacatatctgccatgttttgacccagcacatggccctcctgagaagctgagcagatgccagcactatgctacttgaacttgccagcctgcagaatgatgagctaaataaacctctcatctttatgaattacccagtcacagatatataagaacacaaaataaactaggacagacctgattagcttgggtctcttgtgattgttcttcatactccctaagctaaagttttcagtctacaagcagtcaccataatgctttaccctgacctgtcaccttgtcacccacaatgtttcttcccatctgaaccaccccagcttcccaccatcagccacatttaacaagtgaagaagtaaaggtctgaatcagcactgtccaatagaaaccaaagtcaagcagcatgtacaatttaaagctatctagaagccagtttagaagaaagtagaatgaaatgagtaaaattaaactttacattttatttaacccaatatatgtccaaaatattatcatttaccatacagtcagtatgttaaattattgagatatttttgtactaagtctttgaaacttcatatgtagtttacatttacagcgtatctcaatttgtacaagccacttgaaatgtgcccagtgtggctactggctatggtgttgggcagcacagcagtacagaagacatagtccaaggtcacacccagctatgttctttaatttaaatctcaagagaaacttgatctgcttttttgccctccccccatctaaaaccacatattcctgtcctctttgtgccattctccccctctccagctaactctaattacagagagatgcttggtttggtcataactgctagctcagcagttttctaccagccctggcagctggtgagaccaacatacactgcctgtaaatgatagtgtaaagcatacttttaaacttctccacagcagagtttccataattttctttctcttagaagtaattcattggcatttttcaaagccagggtgtgtgtgtttttttttaattcattctttcttaaagtcccatcttaatcaatggattcataaaatatttactagctagtaatctccccaggaccacagcagaacaagcaggccttgtgtctgttttttataccagttatacctctgttttgattaacagtggttaggtttcttttttccaactagtcaaatagtctcccaatatgtcagtcccattttgagtattactcacaatgaaatatcagtaaaggttagattccatttccactaaatgtcaagtctctgaccactgaccccactacttgaattattagattataatcacaatctcaggggagaaaatgacaaaagaatggcgacagactcctggagtttgttgtgatagactttactaaaatacaaacccttagctgtaagaattgaaattcaaatagggaaaagattgtcccatattactaattagaggccagaaccccacatcttccaacattctcagttaagtgaaggctagaggagatcatgttttttgatatctttcagtaactgaaggatggcactgcaaagccagccctcttgtaatacaaatgaattttcttacattcccttcagtgctgtatcctttggattttgacttgatgtcaacctcactattcacagatcccctaaaatccaccatttaaaaaacttcaggtgtggggttgcatttggaattagaacagtgttgttgtgagtggcttggtttcttctctttccccaccatttccctagagtaatacacacttagagcccccaaatcacaatccttttatcccatgctgattcaaagccttttcatttctttaagtggatatctcatgttcatttcaaaatgtcatttagcagctgtatttctgctaaataaccagaaattatagttgactccagccaagtggctgagtacctagattttgtttccaagtatggtgctgagcagaaatgttttggtttcatcctcaatattaatagttgactgagagtgatggatgggcctggggatgagaaaaggaaaggaaatataaaatatagtggcagagcatcatctgcttcagggactcttgacctggggtttttaccagaattacctgagatgatattaaaaatccaggttcccaggccccactgtccctccattcattcggagtcccggagaacagggccctggcaagtgtgtaggaaccacctgctcttactcaattgtatccacttatcaatacttagggagaattttactgtatacaaattacacctcaataagcttgtcctgaaatctgtttgtacacatgcatataaatttttgaaagttttgactttccctaccatgaggagtatattgactgtcaaacgttctggagtctgaagacaaactcacagttgaaacaatcattcattcactcagtaaacatgtaaggaacagtgctgggcattgttcctagtctgggaaaacagagatacatccagacacagcatatacctcgaaggagtttgtttaatggataagaaccatatccaacaattatgccacagtgtgaaaagtatatctatagagcaaaaagggaggaatccccaacaaccacatacacgcatgtgtgcacacacacatacatgcacatattcccacttccacccccctgctttttgaaggtagaagagataggctgtgttgtgaaaattttatagaaaagccacagcacgtgattcctgaggtgtgagtaggcaaggaagtgaaaagtgtgctgcctgtttttcaaaggagtagctctcagaatttgattctaacgtcaaaaaaaagtttttacaccctcattagttttaaggggattttaacaacccctgatgtgattcagtttgcttatcctgatctatctagtcccagcacaggtctcagtgctggcacacagtaggtgccagaatagaagtgatgcttttagcagttttgtctctcttctaacaaaccattagccacaattgtatcttagagtacacacgtaattttcaagatagcacctaagggccaggcagggtgacccatgcctgtaatcccagcactttgggaggccaaggtgggtggatcacaaggtcaggagatcgagaccatcctggctgacatggtgaaaccccatctctactaaaaatacaaaaaattagctgggtgtggtggtgcatgcctgtagtcccagctactcggaggctgagacaggagaatcacttgaacccgggaggcagaggttgcagtgagctgagattgcgccactgcactccagcctgggcaacagagcgagacttcatctaaaagaaaaataaaaaaatagtgcccaagttatctttgtaagtattgcttccaaaataccaaaaatctttgcccttgaaggagagcacatttaagaaaatgtgaattattctactggcatggtatgttttgatttttatatattaagggaattaactctttcttacctgatttttactcttgtttttcaatatacctgaagttttagaagagcagctatgtcaaaagatcaaatgatcatagcatgacttactttgtcatttaaaggtagacacagaaaacagcattgtattttcctggatactgggtgatcttgttggatttggggagcagaggttatttgagagcagctgtttatattgcattaaaaatatagtcgatgttggggtggctgcttacctaggacaactatatcccctatatatttttgcagctttatgtgtaaattatgatcattggttactttgatattgtaggacacaataggagaattcccaacttgaccctttgactgtgttgtgataggaaaagacattatatgatttggctgtgtcatcacccagatctcatcttgaattgtagtttccataatccccacatgtcatgggagggacccggtgggaagtaattgaatcttaggggcagttacccccgtgctgctgttttcgtgatagtaagtgagttctcacgagatttgatggttttataaggggcttttccctctttgcttggcaattctccttcctgccatcacgtgaggaaggatgtgattgcttccccttctgccatgattgtaagtttcctgaggccttcccagccatgcttaactgtgagtcaatttaacctctgtccttcacaaattatccagtctcatgtatgtctttattagcagtgtgagaatggactaatatagacagcaagagctggtttacatatggctttgtttagaaggctgaatgatatttctagaggtgccctgtgcattggaaattttttgtggttaatctgcctgctttccaaccctaaaagcaatgtacattccaggctctgttaagatagccattctgactgggaggaaaatagatgatggtgtgggaggtgagcttgaggttaaatggcaggaagggcagggcattaactttgctactgggcatgtgcttgcatctgagctccattgctgaccagctgtggggtcttgggcaagtgaccaccctgctgtgactcaactttctcatgtccaaaatggtattgttttgaggattaaaagagaagaagtgtggtgctgacatgatgcctgacactcataagtgcttactctgtgtcatgtctcttcacttttccctttttacacatatatcaatcttgtcattctcttgtttcagaacttctcaaggctcctgttattcccccaagaaaggcctaaacaccttaacctggcatctgaggccttttatgatctgtctgtccaacccacctctttaacacatctaactctttcacttcaaatgtgatcctgtagcaaaaccaaaccatctctgtgcccttggagggctttgaacactcattttctaacctcttgggatgccttcctgctgtcgcttagagtctaagtctaatctgctgcaaggatcttttttttttttttttaatttctagtcagtctctgcttatccagcaaggctcatcttaagtgtcacttcttcctagtccatcaggctagaaaattcacctctgtgtccagtactgtgtctttttcatcataggtgcttaaaaataactgaagtgttatgaataagtcttagaacatattcatagataacacacgccagagaaataggtaaaggttccttccaggtgggcatttatgtcaggggaaaggcctgggtggcttcaacaacagaatcatattttctcatagtctggagactgaaagtccaagttcatggtgcaggcagggccagggtctggtgagcctccctcctcgtcttgcagatggccactgtctctggtgtccccacatggcctttttctctctgcaagttcccctgctgtctcttccccttcctataagaagaccagccctattggatcagggccctacctctttgaacttatttttcatcaacctcctttaaggcccccttctccaaatacagttacattgggggttagggcttcaacacatgcatttgaggggacacaattcagtccatcacacataggtataaaaattcttctgatcctctgagagtgtgtgtgctcatgtgtgcacacaccctgtgtgcaggtctcctctgttacaagcattcgttcctggcctcattcaggaaacccacaggatagcaaatggccttgctcccttgcggtggcccagcttggcctgcctactctagctgcctccgcatgatcccagcccacaaagacgctgcttcggccccaccgagagggctccagacacatattttctcacccagcggttccatcagagcaccctcctgcctccagctgccagcaaaggggaacaagagagaatgagccacagcagggaagggaaggaattcaggaactagaacaggagggtgacattttgttttttaaaagagcatctttccttttacttctgtttaacattgtccatggggttttttttcttccacctttctccagattcccaattctgaaagcactaaaggaaccccttagctctacgagttaagacagttgataagtgacgtgggagaatgcactctaattaggtccttggttaacctacccctgacttaacagagggaggctgtttggttacaaatagttcttattctactaaatcagaggcttctcacgctgtgtcatctgcctgcaaattagctagaggcacaagctttgcattatgcaaagtacttattctcacaattaatatgctggaaagtgtggtttcacacttttctgccggcacaggagttctcactcaggagtgaaccagatcacctggggagcttttacaaaatacccaaggcttgtccttcctcctccccatgctgccccacagccgtgagagtgagatgtggggcccccaaccctgcaccagtaaccccagtatcactacttcttattacttcctcagaggtttcttattaaatatttcaaatcgcttttttcttttttctttctttctttttttttcttttcttttttttttttttttgcttgacaaaatccagtgaccaattttcttttttaacattttattcatttttttttatggaaaatttcaaatgtatagaaagtaaacagtgtagcctactggactccctgcaacctcacccagctccaacagtgatcatcaacattctgccattcttgcttcacctatagctggataattgttgtcattatttttgaccaattcaattttgtttcatagatagcatagcctgagcgctgaaaattggttatgtgttcctactgcatattgaattgactgtgtgcaaggcacttcccacaccttattgcatttaatctgcacagcacccataggcattgttacccacattttataacaatggaaactgaagctctaagaaattacacacctgcccaaagtctcccagctagtaagtgctcaagcaagcattcacactcatgtttgaaaagcatgcttttccccctaagctacacttcagaaaaataaaatgcatgaaaaaatgtatagttaaaagttttgtagcatgaatagatgcatagctatttgataaagcacgtatgttataatattaatgtttaaagctgggtggtaagtatatggatattcagtgtaaaattatgaaaactatgtttgaaattgttcacaataaaatgttggaaggtttccaacaaaagcaaactttgtcttaactctcaagcagtggacaagacaaacaagctattttcagatacctatcctgttgatatccgctccaaagagagagctttgagacttggttgaattttgaccttaaaaatagtaaaccttaaaaatagtaaagtgtaagccaaaaagtatctgagacaggtttcaatcaatttagaagtttattttgccaaggttaaggaacatgacccatgacatagcttcagggggtcctgaggaacaggtacccagggtggctgggttacagcttgattttatacattttatagaaacagaagttacaaagacagaaacccacacatgtaaggtatacattggtttggctagcaaggctggacatctcgaaggcagtgtgtgtccaggaggtgaaggagggggtgacttctaggtcataggtagatttaaatatttccagattgacaatcggttcaaagaattaagctttgcctgaagagttgaaatcagttgaggtaagtggggtcagggggcctgaaagataaagattcttgtcatgtggatgaaacctccaagaagaaggctttggagagcataaatgtaaatgtctcttatcaaaggagtcagagtcacagaagagacctagtaagggaaggagattctcacccgtgtccagccatttgaatgcgaggacttttttagttacctgtggtggcaggtggcagatatcacaaaaattatgcaaggactttttttttttttaagctcatcacctatcattagtatattttatgtgtggcccaaggcagttcttccagtgtggcccagggaagacaaaaggttggacacccctgcatgcagacttcccccacaagagacacagctttgcagggccatttcaaaatacatcagggaaatatatgttagggtaaaatactttgatttccttttagggcctgttatctgtcatgtgatgttatgctagtgtcaggttggagttagtatcatattgctataagagtctgttctgtcagccttagggtctctgttttaatgttcatgccagccagttgtgcctgaactccaaagggaggagggtataacaaggcatatctgacccccaccttcccttcatggcctgaactagttttccaggtttctttggatccccatggtcaagaggagggtccacttagtcacttggggggcttagaattttattatcgtttacaataaaatagacattacttagaggtataagtaatgagcattaactggtgaggtcttagggaactgagaaaaccagatgcagaagcaaagcctctcccagggtggcccccagctgtggccaacagctcaggaagcttcctcaccgctgctgctcgtggaaagccagagccagataaaatgaacaagttattttttccagttcaagccacttagataggattccatgatgatttctttttaccatttacccaaaggaacattttgcatacacacagcctacgtgttgaagctgttccttctcacggaagggcataaccaatttcttcacataaaaaacatcgagccacccacactcctccatgatgtaatgcaggtcctgctttgacggtgagctgaccagggattgctgagcagtctcagcattgggaatgatgattggatgcagatagcctgtccaggggattctcgagagcattttttttgctaaaagtacaaggagaccctgggcaagcagctagcagccccctttcacaaccctgcagagcgtcctggaggtcccagcagccactgttcttcctcctaagcttgcctgccatggcagcatccactccacccttcagtgcttgaagccaagtggttgtcgccccggaaggctctgcccttctggttttagactgctgtggaggagggagccacttggagatacaaagcccacctctctagaatcttccagggtccccacaaattataaaactatggtcacaccaggaaaccaaggcattttcaataacaacctttcctactgatttccagcttcatcttccagaattccagtgcactgccattcataccattcattaactgttctcctttcactagaccacgagcaggtatacagccacaaagaggaacccatctcatgagttaactactccatcagcttccttcaccctgaaatcttttggcagtacaggctagaaggaagaacaggctttgcaatcagacctgggaatgaatctcatcggcatcattactggctgcaagattttgggaaagtggcttaacttcttagtccagctcacaggattaatgtcaggtttggactcagataaagaatgtgaaggctccctgcctagtctctggcttgtaacaagtgccaccaagtgctagtgtcctttttctgtattatgtatgttgagttgtagatatctgctgtcaggccctgtccctgccactggctggtgatgtgaacacatcttgtgtctttgcatctctgcaccacagtttcatcatctcacaatgaactgcctgctctccaagatgtggagttttttaaattatacaatttggttgcaccttaggggatccctctgattatggaggcacagtaaggtcctgagcataggtggtcagcagtccagaaagggagaaggccgagggcagactggagaatgggactggtgagattcagataggaagagcaggggagaaatggtcaaagtgagactggaatcaaaaggttggcatttctaaaaactataattgcacttaagaagttttgccaaaggcgatttagttaccccacagtgaggaacatgggtgcctatgtctccagtcacttccccacaagaaacctaattgcagcctgggctccgtgcaactcccagcttgaggggaggcccatgggcttctttgtgtgaggagcgcgctgcagcattcctgcccacacacgccactgctgcctttctcctgagaaggagttccgttattatttcatgtgacctcacagccaggggagctggtttgccattttgcataacacacattaaatttgtttttagatgtgctgttgagccttgcctgtggatcttctgtcctcttgtcggtccctgcctgctgcagccatccaggcacttaggatgcctatctttttctctacagctgcgaggagcccagtagttgggtttccttaaatgcaagcagatggaagcgagcaggagtgtggaggcaattagaggatttcctcctccaagcagtgcgggtttgctctctctttgggtgtgtggctgttcttgctcattttaattttccatttgggttttgtcaggctgtcagcttttttttctggctgtattatgctgctggttgcaggagcttgcaaaatggggtgatttggttgcttattgtttggaatcaaacttttcacagtacggtatgggtgacgcatatcgtgatgatgatgacacttcatatttgtaaaatattctgcaacgtaaagaatgttttcacatacgtcactgtctcatttggtctggacagaggcccagaaaaaaaaaaaaatgaaggctgtactcagtctgctagagtcaaagttttgccttatctttttacgccatctctagtcaaaccacagcggagagaataatcgaatgaaaactgaagctttctgctttattccttttctccttctcctttcagtcaggtaaatatttttcactttctgaacacagtgttagattctctggtgacaattaaataatcgtagcagataatcgttgccgtcggggagctttcaatgtaggtggggagacaagacatacaacagtgagtttacataacagtgcctggcacacagaaggcactaaggaactaggtgctgaatgagtgggtgagtaaatgaatgtggaacatagcccaccaaagtcctgaagggcaagaacccctagggggggaaccaaaagatccacagtccttgatgagaatgggcaccgagtgcctgggtgcctgggagtgagcaggcgagaggacccagcaccgttgtggacagcctccgttcggttagcaccactgcacgagggctggagtagagaggaagccatttgtttatgagctgagaagagtgagcaggaaaaatgccattctttgctcttaaggatgagacaagcataaaaagagaggcagacaggcagaccagaaggaagagattgctgacaaaatcattgtcaggaaaagtgccagtgaaatcactccaccttaaaagatctatgttctggttttgagaacctactatattgtagacctgtgccagaagccagaagaaggcaatgggaagaatcaaagagattcttggccccaacccttaccagaccctgccatgcacaggaaacagttaaacaatgtgactgtctcacctgcaaatgatcaagtgttgggtataagccaaggagctgagagagggggagaccagcgcaggtctgaggagctgagaagggaggcttacgtgaagggtaagactcgcatgggcctggccggtggacaagatgtgggaactgcatggacagttatgtggaggtgcattccatcctggctggagagtgtgtgaggggcagtgggagattggtggaaaagatataggccactggtgtggaaggctgggaagccacgcttcagatcggagaaagttgctaatcagagaagcggcgttctggaggtggtaagtggagctttgttcatgcccagaattttcattcctgtcctgccgtcctaaatgctgggctgcagtctgcactgtcccccgctgatggtatgagagtaagccaaaggaaggaaacatcttgttgggatggcactgagccatttcagtgtctcctgggggcactgagccatgccccagggcaaatgcccagtggagaacaggagttcaggagaaaaggtcgtcctccagtctaacaatcagcaggacacttggcttttgttgggtattttcactgccatgaaactatacttggtttgtgaatgttttggtgaccaccaaaaatgtatatgatgtgaattctaggcattttcattatggtggatttttttaaataacgtccacattaatatacacccctagtgtaaagtacttaaagatacagaacaaaacaaaagtcacctattaacccatcacacagagatagtcacgcacatcattagtattttgttgaatgtcctttcccggtgcaaatttaggaatgtttaaaacatggtttcaaattggacttaatgttttatatcctactttgttttaacttagcagtgcaccgtgaatattttttagtcactaaatttatgttgcaatatgattttagtgctatatactattccattataggtatgtactatatttaatcaaacagaaaatcagtctactatctttgcttattttgatgtttccagtgagttaggcttttaacatatttttaaaaacaacatcagaatctagtgttttcagataaccatgtttttattgagtgagttgtccagcaagatccacgtgaatatagaacattctctacccttttatctcattttttttgtcacttcattaaaaatggtaataagtcaacccctctgtggaaaaaagaaatcgtatgtgccatagtttccttctctaagactgttaaaaacatgagctgaccaggcccccatgccgatggacatacctggatatacagtaagagtacagggaacgcaattggatcaagaagttcttagaatttaaatgacatcctgtgttttgttgtagtgaaatttcaacagaagtaactctccctattatcttcatgtaaatgaagaaccaagcattcaagagctttcttaagagctttgcctacctcttgaccaatgtctcccttcatagcatccatctccttcctgatgtgggatgccattttggagggccacttcctgctgactttattgtaagctgtgtagaagagaaggtatcagccatatttttccttttaggcagagtttgatttgcagaggcctggacttcctgcttatgtgtctttccagtgaataagtgtgattcaccacagttcaaagtaaccccatctacaacgcctcatttttttaagtgaaatttttccatgggaatagaatagagaggaatcctgtaggtcttccatgaaattatactccctgcctctcagagttttacaatataattaggttacttgtttgtcttaaatttttttattatcctgtgcttatctggttgaggtgcctgttgaagagcaggagatgaaggtcaagaaatataagcacagtgctcaattttttaaaataactttgtcttactgttgctcgtggatagaaataaaatttttcatattaaactaatacttagccgtttgctgaaacctcttatcaattctaataatttatctgtattctcttagtttttctgtgtaacagacataccatctataaataattacaagtttttgttctttttcaatcttttatcttttatatatttattttttcttttcctaccactctggctaggacctgcaggaaatagcacaggggataggaagtagggatagcggggataggaagtagggatagcacagatccttagcttgttactgattttaaagggaaggctgttagcatttcaccattgagtatggtgcttactgctgggttttggtaaatactttctattagattatgaaagtccccttctgatcctagtttgctaaaagtttctattttaaaaaattataaatgtgttaattattactgagtgccttttctgtatctattgataagatcattggggttttctcttttaatcggatagtacaggaattattgtcatccattttttaaagttaaatcatccttgcattattagcaaaaatccacattagtcgtgatatattttatgcattgttgggttctgtttgctgatattttatttaggatttttacatttgtatttatatctgagagtggtccataattttcctttttcctaccatcttggatttggttctgagatagtcctagtgcttttccattttctatctcctgcatttttttttggttttgatctaaaacacagattttttttttacttttttttctctaaaaccatctgaacctagtgtttattggtttttggatttttttgggtggaaggatgagaagctttttaactaatgaatcagttttttaaaggttattagactattcaggtttctgtcttgttagaataataatttgaatttttctgtgatattcttcatttcattgaaattttcaaacttaatggcacatatttcttcatagtagtgtgctgttatttaatccttgctgaatctgtagttatgttctctcattcattcctaatgttattatttgtaacatctctgtatttttcttgatcagatttggctcttattagtctttccaaataaatagcttttcctttgttcatcttctctagtgtatctttgttttctgattttaatttctaccctttattattttcttcttctgctttctttggatgtactcttatttactttctgacttcctgagttggatacttgttcattaattctcagtccttttttctttctaggacaagatttaagtattttattctaaataaaactgtagtgaaatctgatatattctaatatggagtatttttatcatcactcagttataagaatgttgtaattaccataattatttcttctttgattcatgagttttattagcagcatcattttgaattcccaaatgaatgagagtctttagtaatcattttgttacggatttctaacttaaaaaatctgttgtggtctgggaatgttgtttgtatgatactatttccacaaaatgcattgagacttggtttgtggcctaggacatggtcaattctttttaaatattccgtgaatttctttagtgcatattctccgatgggggctgtggggacagagttctaaatatgcccattagattaaatctcttcattctgttgctcacatcttctatatccttattaatctgtcaatctcttcaagagaggtgttattaaaatctctcactgtatgtgtcactttgcccttaaaattctgatgatttgctttataaatggttataaccattttccaggaagaacattaaagaactttccattggcattatccagtttccctcaaaatactggttttttttattttggcttctaagcagctatgaatccagtttctcagaagcccttgtctcaaggcatttgtttccagattaccttgttagcatccacactatgggctattttagaaaaacaaaaaaagtatcaaaatcatatagctatgattttcctgtgcttgaaggagccttaaagctcatctagtccagccagtatttgttcatccaaattctgccaagaaatctctattgtcaagatattctttaccatctttgggacattctcattattagaaacaaatcctaagaagaaattctgccatatacaacccatccgttctttaaaaaaaaaaaaaaaacagcttaaattttcttgtctaagcacaacaatttccagtgtttgtattagtttttctcaacagaatttcgagtccttttaacatcgtattactgttaacaagttctaaattctgtgtggtcatgctttgagagactgtcagattatacacacacactcaggttgtgtgtgtgtttgtgtgtttgtgttaaggaatgttttagtgggcacctattaaggaagcctctcaggaaactactgtatattaaggccaaaaccaactgaacccatcatacgatttctctccctcaaggaaagcaaatgagaatgagcgactgtaacccttgcctgttgttcataagcatgtacaccaggatctgtgtgatccttttcctgaagataaacagcatactgctcaaggaaggaaaacaacgcatagcaacaaatttcctgttttttaaagaaagatccaacttggtttagaaattatgctggcttgctttctatgtttctaatagagaataaggagaaacttgcttctcatttgccgacatgaggtaagtgttatgtctgaaagttccagagatcacagtttatacattgaagaaaggtagtaaaaggtttgcgaagacctccttccccgtgggagaggtgccctactgtgcatgccgggagttggctgtgggtcatgggcacagtacccctcacccaaatgattcttcccaaccatcaagaaagtaaaccccaacttggggcccagaaatattcagacagtagaagagttccacattcagacagacgataaaagaaatatcttcatattgcctagcattgaatttgataaggaatagaggaacagtattgtccttctgaccgggctctgtctcttgctgcctaaaattttattatcattgcatttaaaaaaatcaaagttcagtcttactagaatggatagaatgggtaagtgtagcttctagtttggtgagtccttcactgtttcttcctactaacctccctagctcagtctggctaagggcagggcctccatgatgaccagcaaaacttctctctggttaagctgagcttggtttgttaagcaactatacccaacatgtttatatcaaaagcacctgtgtttctcagtgtttctggaatcccaacttaagtgaggccggagctaatgctgtatttcagtaaataccacattagatcacacttttaagcagccatgtcaaacaattgacttaaattgaaattactttcagctaacacttccccacaaattgtttttacacatgctgctgctaaaccacatgtccaccgtcctgtacttaggcaacttttttttttttttggtttaggccctcacatttgtccttactaattttatcatgtcagttgtggcctaatactccagcctaccaagatatttttatatcttgagattgtcactcctgtcccttcaaaagtttgttccatctgaatatttcaccatacaaattttcaatatcttcatctaagatgttgacaagtttttgaagagctcagagccccattttaggcctcctgagaccaccttctaggtggacctgagctcaccaatcagccccacttaaatattataattcacttcattgttctagtatctagcccacattttcctatcttattcccaaaggtattatgagaggcctttttggataatgcattactgaaatctgtaaagaaccacacttctctgacccctgtcaaaatagaaagtggcatgactattcctcctatgaaagcatcctgtatggaggatcagaccaaatgctaaaacactttagtaggtttacctaaatacagcttgtctttcatatatcatgccttgacacttcttctgcaagaccagttttttctgtaagactaattgatattgagatttcaatatatatagaaatgggactaaattttatccaaagctatttttgcctctattttgggggcattcaagttaatttcccccacttacactaaactgtcaaatactagaatgtggaagcttgaatattagagataagtaagtgcccagttccattccaccagttcacagccctgtctatccctccatcccaccctcaccaccaccctcctaaagcaagattattaacactgaactggactgctaaaacttcttcctagcatctttcaggtgcttttgtggcagagccattctgcatggagctgccagaccaagtgtcattcttgcttagaactcttcagagcctcccctctgagctccaaattcagtccaagtcctctcttggctgcttgcctgatcagaggagccactgcctccccactcagaccctattccacctggtggacttgtcactcttccctaaatgtcttccatgcctccctgatgcccatctttgccctggcttttcctgtggccaggaatgtctcaaccctgctctagatttagaaatcttgcttctttctcaaacaacaaaatgtctctcctcaatggagccttgactgatctctccattggaagtgacttctttttccactaagctcctgttagcaccctacaacttccaactgacaattgtcttgcatagaattatttgtacacttgttttatcaaaagctgctccagtgggctgatagcttattcatctttttaattcaccaagggctgagcatttagtagagaggatgtatttgttggatggatcatgggtagatggatagatggaggaatggatggagttgaggtttaagagaggataaataacttgccaagatcacgaagttggactaatagaattaataatagactcagttcccaaattcagtattaacatatttgtctagcaccactccacattctcttccatggttttgctttgaacttttggtagaagccttagtaataaacatccagttttataaaataaagtcttatatttgtttatattataaatttattactccttgatttacatgcttaggaatataaatctgagaaaaatacatggtaggattttcctaccacattctaaaagcttaagaaatatctgaagctaagcatggtggctcatgcctgtaatcccagcactttgagaggccgaggcaagagggttgcttgagctcaggagttcaacaccagcctgggcaacatagtgagaccttgtttctaccaaaaaaaaagattatttacatgtggtggtgcacaactgtagtcccaggtactgggaggcgtaggtagaaggatagcttgagcccaggaggttgaggctgcagggagctgtgattgtgccactgcactccagcctagatgaccgagcaagatgctgtctcaaaaaaaaaaagaaagaatttgaatggagacactgccacttctgcacatctgtcctatatgatttaaaatatctctgaataccttgaaaacactgatcttttcaactctaaaactcagaattctcttaataaaatagtatgctgtagttatactgtgtcagcagttttggggggtttttgttgttaattgtttgttgtttttgtgagacatgggctagggatctgatgttaaaaatagacattaagccccaggacaaaatggccattctacctagagacagcagttctggcgttctgaggccacagtgtaacataaacatgatgttgtcaacctgagccagggctgatttgcctcatttgaatctgaaagggagcccacatccttcctgttgctacacaaagatgctgaaaagaattcacagagaaaacaaatggactaatgcgtgttatgtttcccagaagttctgtccccagtgcccccaaaatagtaaaatagttgggaatgaggttgagcaagaaaagaataaaggaataaaagtatacaatgccaaggaaaggccaatagaaactattctttttgctttgcttctcttggtgtttttttccagtgtgactctgtagataatggcaaagagaaatgcagggtcattttttccattttcaagtaaaacttattttgcacaatagacccactgaggcttgcactcattcatgtctacgactcccatctctccagtctcaacaaaagtgaaggtggccattgtgtcctttcattgttctgtgactttgctgcccctttcttgctttttaaaataagttccttagaagtatggaatggcgggaacgcatgccctttgtttcagcaattcagtcaaaatttcccaacttgccttcaatgttagtaaaaaaaaaaaaaaaaaaatgacatgaattgtactggcatgaatctaggtggtctggccaacaaagaaaggaaaggagggaagaaaatgaggaaaggaggagagaggaagagcctgcatccctaaaatttcttttctcaacaaatatttacttggttacctctattacaggcatttatggtcattgtattaattcattctcacattactgtaaagaaatacctgagactgagtaatttataaagaaaagaggtataattggctcgtggttctgcaggttgtacaggaagcatagcggcttctgcttccagggaggcctccggaagcttccaatcatggcggaaggcaaaggggaagcgaggcatctcacatggtgggagcaggagagagggctaggagaaaggtgctacccacttttaaacaaccagatctcacaagaactcactgtcatgaggacagtaccaaggaggatggtgctaaaccattcatgagaaactacccccatgacccaattacctcccaccaggcctcacctccaaagttggggattataattcgacatgagatttggacggagacatacatgcaaactgtatcggttatgttgcagaaagtcagaatggaaggaatctggagccaagtacataaaggcaggagctacttcaaaacggacatatatgttagtagcagttgtacatgctgtcactcttggatcagaagttaaagatgtcagacttaaactggatgtaacagggaaattctacagatgtggggatgcaaattatgggattttttttttttccaggagaaatcatgcagtcttcctagaggtctccatcataagcgagttttccatcatgtaggtcatttatccctgtcatttcttaattccatatttgtttccacacacagattttgaacatatattttgaacatatatttatttaaaatatttgtttttatctagcattgtgctgaaagttttaccctattataattgtgttatctacatttaagttttttaccttttaaggaaaagaaaaaggagaaactctacaatcatgcaaaaagtatataatttgcctgggagatgcagaataacttctagcagataattacatgctttgaacatgaaaagaaatagggtagaacctgaactaaaagaggaccaggttctgttctccctccctcaggggaggatattttagaatattttgtgttcatgttttaataagcttttgttggattattaaggtgcatttaagtttttccatcttagaagtattcggctggtgcaaaagtaattaccaattactaatataatcttgtcaagtaaaacccactcattggggtacatagagcaagcatcctcttttccgtagggcagctcagtctgtgtatcataaacatgattatcattgccattcaattttagctgttgctccagagagacttaaaggcatgtcacatgtgagagatcagcaggcaatatttggggctatgaatattgagcaaatattaaggtttttttaaagttcaccttcactcatgatttacctgccctaaggaatttgccacagattccaaatgtcagcactagaagaagtgtccgagatgatctggatgaaccattatagtgactgaggcccaggaagagtgagtggtttaccttaggtaaccagcaggtcagggtagaatgcatgtttctgttcagtcattttattcacctcctaggaaacatattgcagtgcagttggtttgccacttttgatcaaatgcaccaaatcttcaatttggattaatcttttcaattactgagtataccggtcctttcccatagacttagaacaaactacaaatgcaggcaacacaggtaattaattttaaattaccgagtagccacatttaaaaagcaaaaagaaacacatgaaagtaatgttaatatttttaaatttaagacgacctgtgtaaaatattatcatttcaacatgtaatcatattttaaaatttattaaacattttacattcttttttcatgctgtctttgaaacctggttatatgctttatacttacattacatctcatcttgaaccagccacatgtggttagtgcttgcttaccctattagcacaggtctatatggatgaacaggtccaagctctacaccaaaccacaggcccctaacccttgagatcaaaaatgtctctgagtactagttcccatttctttgaatttttgctcttgatacgccatgcatgtctcctgaaaacccagagaggtgagcaagcatgaactgctataaaatgagtgtgtctgttgaaaacatggtccagctcctgctaagatagcgtcattctgtgatacaatattcctgtcttcatctaattccatgaagttctgcatttccttaatgtcaaaagttcccttaccagctgcagccgtttcctgtggataatgttctaaatggcttttatttatgagatgtcttgtgctataactgctatcagaatgaatgtgtattccaaaacctattccccaagtcagtctaattaacaatcttctaagaaataattgttaaacttcagctgtagctcacaacacgggtatgtctcgctttgacctaattacagaatgtaatgttaaaatatgtaaggaaggagatcaaagaggaaagtcattttgctttctatgtcttcatcttgctttctatgtgcctcatatttcacagctcccaacctccacttccaactggctgagggaaggaaacacatggaatagtaatgaatgagtatagacgctgaggctgttttattttcctcatctttgaagcaggaacaataatagtgcctatcctggagattcgtaagaatgaagcatgaagcatgggatctgacatatcgttgatgctcaacaaatattaaattgcttcagaaaaatagcaaataggtatatctggtgcgaaaaatggaaaggaagcctgccagctttttttaaggacactatctgcattattcttggaattgaatccggctccacccagggctgagagcttttcgtttccattgtgtctttagcatagccatgcaaaccaacatcacttccaatgataggggaatgctggagtcaaagcgactagttcacttcagaggacaggcagtgtataatgtcagggggaggagctgacccaaataatgtgtttcaagtcatcagaacacgttcatgtctggttttcatagtaaattgtgacagctgcgcaggagaagacagaatacactttttagatgttattttgtttattttgtgatgctgctttaaacagttccacagagtaaggaaatggagtttttacactgtgagactttaactcccttctttccttgacttgcctcttggctctgcttaataagccctttcagcaagacctcatctgctttccttgaagcttccaggtattatctcttggttgaatataacaaaaatcacaccaagtagctacctgacactcatgggtgcaagtatctcataggaaactggtgaattctgaaaatgcttttgagccacttcctttcactgctggactctcttaatctacttactaaagtgctacttggacaagagagtattgacagttacagggaaaaacaatgtagaatcccaggccatgtgtaggtttctgtggacacattttaattttttaaagaatattttagttatctaaattatgtacctaaccatttatattgagtacataaattctcagtaaattagcgtctctcttttgagggctgtgtgttatctgctcctgtgatccaaatatatagcactaagacaatataagggattctctctctctctctgtctctcattctctctctctcttccttccccccttcctttctctccctgcctccctccctctaccctctctctgtttgtcctaatttacctgacgttttagcccttgttgctgttggaggattctaaagatgaagccactcataaccttaatgcctgatagcatagagaatagttggtgacttcaccagaacttacacacccatgccttttcttttttgctttgccatgagtaggcagttgcatactttatttagcaaaagagagaactgttaaaaagctactaagtagtggtatattcataccatggaatactactaggcaataaaagctactataatggataaagcaataaaaactactatgccactcagcagcaataaactactgaatatacaatatcatggacaaatgtcaaaaacttgccacataaaataagtagacacaaagaatacatactgtatgattacctttatatgaaaccctagaccagagaaaactaatctgtcgtggtagaaatcacaaccgtgtttgcctgggatggaattgactacaaagggaccccagtgcatctttctagggtgatgaaaatgttctagatcttgatgggggtttagattatacaggtatatacgtttgtcagaactcattgaactgtaaacttaaatctgtttatacattgcactgtggataaattatgcctaaactttaaaaaaaagaagagggaactaaaaaatccacacgccttgctaaacctcctcaaattattagaaattctctttcacttatgaactattttcttgaaagacagctaccaggtatcactatcaccatctttttgtaccaggtacgtgggttcctttcagactcttcctggtgctgcaatacacagtggtcacccacatttgagaaacatacagtgccttccttttcccaggagattatcccagagttacatgggaaatcaatgttgtataagttgcacaggggaaacattactgaaggcatttttttggaaggtataagtgtattcactccccagtgtattgtgggctgtgttaattcagaatttggaagagaatgctcttaagccaggatgttttgtaaagtgttctgtgttgcaatgtgcagatgtttacatcaaattttaaatctttcacttacctgctcaccttctccctccagaacatgctgcctgttgttaagcactgtttctgaaatacaaatccattgtgcaactcttgctcagaaactacagtggcctgctccctccttcacatttgggccctgcttaactctctagttacctgcattcgctcattcttggcttgtgtcacaccaaacaaagctgctccctggcatgctcctctctcctgaatccatgcctttgtaagagctgttctgcagcctgcaaagcaccctgcccatccccttgcgcaccccctttttcaccagtccttcccacaggccccactcagatgcccatcctctgagaacccatcccagcttttgcaggagggatgagtcacatgcccaagcttcaagaacactgtatgtgtttcttcaggcaagcaggcttactacattggagagaacaggtcctttccttgtctgccttctcccatgggctggacacccttcagtgaaagagatggcattcgcgtctgtattttgtgcacactgcttggatacatagtatttgcccatgaatgatgggtgaatgggtgggtaggtggatggatggatagattcattcactcactcactcattcattcaacactgcagcagtagccttctttgtgggaccaccaaagaggagacaaataagaaccagaatgttgtgtggccctagcaaaagcagatttttctgggcggatgttaaagtattccagtcccactttccttgctttatttttccaagcaataaggagaacatgacaatattctttgccggggttgtactttctacctctcctctgcataagggtattcctacctaattctaagagaaaaaatgaaaacttaccactaatgatataaaaagcatatttattgttaggtgatatttgtattttgggggttttttcctcactaggaaaattttctaaatacctttgcatataccactttgttttatctttacaaaaatctcattaattaagcaggggatggatcatcattcccaccaggcaaatgagataactgacgtgtagtaaaagcctgatgatttttccaaagttacacatctggttagtgataatgctgggaccagaataggagtccatgtgttcccaccagactgggagattgttccaaagaacaagttcccaggaaagatcaaataattgctggaaaagcacttccgatctccagcaaaaacagatctttccagctgagtgccctccctaaggcctgaagagtattatctgccaagtagctattcttttgtcttctgcataaaccactgcaggctgaaggccactgtgaaatctgtgagaatcaagagcagccatccactgcagaaatatatgttatgaaacttaaggaataagtcactgtccatccagagagaaattagagaatgccttttctgaaatctctgctaggacacaggtgtgggccctaacgcagatatgaagctttgtccccagtgctaagacgagacagctatttttgctgggccaatgtaatatttaaaagcaaacatttaacagtaggataacggctgctgaagctgcatttgcagctgcagctgcatcattcctctggggaaggcaagatggctcttctccagctattcatgaagggcaagagttgggagcagaaagagaatttgctcatacgtaatactgtgcggtccaatctcatgtcccatgtgagatgcctaagtcagaagctgactgcaaagacagctcatcggcttggagacccagggttcattctgcaagatctttcaggccactttttttctataataaatgaaatcctttgcattttattgggagtaagagagccagatcttttcagacattaacaaatgaggggccgtgaatgtggtccaccttactgatttgctgcaccaaggagaccacagtcactccagatcttaaacatattcataattgtgtttggagcaaagttaccattggaatcagattttcacagtgctggtaccgatctctgggatcctcttgtccttttttgcatttactctgctctgttccttctttcccacttatcttcctttcagggtctccactggctgtctttgctaaccaaatatacaggagtttccttggtcacaattagaaaatgagcttccaaaagaagaggcaccgagggcccttggcacaggacacaggaagggactgatcacgtgagctgtctcagttgaatccctcatttctctgatgcggtcgccagaattactcaaagtatttcattttattttcatgtaaaacccatttatacagctgcctcagggatctgttataaaacatgtggagaaaaatcatgatgtaaagtaagaaatacagggatacagatagaggaagccacatttttgttaaccttgttctttggaattctgatcaaaactacgatgtaaaagattcttggccaggcgcggtggctcacgcctataatcccagcactttgggagaccaaggtgggcagatcacgaggtcaggagttcaagaccagcctggccaacataaccaaaccccatctctactaaaaatacaaaaattagccaggcatggtggcgcgcacctgcagttccagctactcgggaggctgaggcaggagaattgcttgaaaccgggaggcagaggttgcaacgagccgagatcgtgccactgcactccagcctgggcaacagaacgagactccctctcaaaaaaaaaaaaaaaaagattcttatcaagcccctttgtgatctcaatatttatagcactttctcaaacttgtggtcgtgtgtgaccaaaacgtaggacaaattgtaactcattggttgcacgggtatttgtaggcatggggaccttgtcacccggacttctctgtcccttgtttatgtcctcttcagtaaatgggaatggagcaataactagtttctagtttacttttgacataagatggtaaatgatatattcccatctttgtgtttggcttttagcctttgaatttaaacttagttcttcaaagagtggaacagttctgttcagttgcaaagcctattagggcctttttgcacagaacatgtgcaaattcttccctttgttggaagctgagatccatgataaattccccctctcccacttacttcacagaaggcttgcaataataagccaggcatcaacttggatcatctttactctggggttttggggttagaagttgctgaatatcatgttaatgaataaacctggccctcagacccagagaaatgattggatgttaatatcagtgtatatgcttttagtgccattaacaacgtgatgtattacaatttcttaagggtgtttttttctacactggaagatgttgatttgccactctgaatgccaccagcttttcattctgaaagttggagaatgagcataaactttatagtcagatagacttggatttgaaatctgattctgtcactgcctggtggtttgctcttagggaagttccttaacctctctgaggttagattttctatagtaaaaaggattaaacaaacaagtaaaatgtagaccatcccgcacaatgcctggaggagaggaggctctcaaaaattacttatccctgtttgcttcccttctttttcagttggaacttctggaagggggtgtgaaagctagggttttccttagcatgggggattattttaatcactatcattcctacagaaagagcaagacatttctaagggagccgtaagaggcaatatggcatagcctagtggatctcagagtgtagcccaggaccagcacagccagcataaccctgggacttgtcagaacgcaggacttaggcttgatgttgcttcagaccaaccgcatcagaaattctcagggggaggcccagtggtctgtgttttcacaagtccttcaggaaattctcatgctcataaagttcgaaaaccactagtgtagtgaaaaatacactggactagtttcttgcacattctgctgaaacgagaggtgggattggaccaaatgtcctctaagatcttttctaattctggcatcttgtggttctagttttaagccagctgttgtcaccattttcttagaatgaccatgttctttaaaagggaaaagaaaaaaaactggtttattattttttatttcaaaagtaacacactgttataaaaaatgaatataaacaaaatgaaaaaacttaaaaccatccaaaactcaacatcctgagatattcttttatgctgtgctcttattgtccttcttttatgcagatgcacacgtatgcattactctgtgtgtacatacataaacatctcaccatagccattagcatccactgagtgtctgctctgtgccaggcacagttttgggcattatgggtataccatccagcaaagcctctactcccattgagctttctttctcatgagtggaggtagataataaacaagaaaacacctaaataaagaccatttctgagattgttaaatgccatgaagcaaataaaacagtgatgtgaaagagtgaccaggcaatgggcaattaagatctgataccaggaaaaacctttctttctttttttttttttttgagacagggtctcactctgtcacccaggctgacacgatcatggctcactacaatctctgccttcctgcctcaagggttcttccttgagcacctcagcctcccaagtagctgggaccacaggtgagcaccaccacacccagctaatttttgtattttgtaaagtagggtttcgtcatgtagctcaggctggtctcaaacttctgggctcaaatgatctacctgcctccacctcccaaagaggaaaaacctttctgagaggtggcatctgggctgagacctgagaaggagccagctgtgtgagtattttggggaagagcatttcaggcaaaggggaaagtttgtgcagactcactgaagtaaaacagagcagagtgtgttcaaagaagaacagaaaggtgtgcagtgttgctggggaggaggtgtgaagagggaaccacagaagatggggctagacacataggccagggccagagcaggatgaccatatcatttaaattcattccaaagacaataggaaaccattttaagcctgggagtaactttaaaaaaagatgactctgactgtcatagagggtatagagcgcaagattggaagcaaggaaagtagttatgtttctacctcgtgttttgtgacttgtatatttcccttcactatttcattaatatctttcaggattgttaatgtcctgctgtgttctcatttttaacagctgcataggaatctggtatgataccctactttgttaatcctctgagtgcctagattgtatccaatttttttattatcatgaacagcactgaaatgagtgttgttaaatctttctgcacatttttgttctcaggataattcccaacaggggaagtccttgaccaagagtaggattcatttgaagactttttctcgagtctattagttggtttcatctgtatttatttaactgagcattttcaattatttaaaacctttagttgataagcttttactagataggggccaaagtgagatactcccagcactttgggagaccgagtgggtggatcacaaggtcaggagttcaagaccagcctggccaacatggtgaaaccccatctctactaaaaataccaaaattagctgggcgtggtggcaggcatctgtaatcccagctactggggaggctgaggcaggagaattatttgaacccaggagacagaggttgccgtgagctaagattgcacctttgggttccagcctgggcgacagggtgagactccatcttaacaacaacaacaacaaaagattgtcaagtatcagtaactttctatcagtaatttatagtagttggcataatccacattttacagggaagaaaccagaatctttttaaccacctactcaaaatagaaacccttcatcttaatcatggctttgtacacttctgacaccctgagggaatgagaaaggaagagagcaggaggaggagagaagtggaaggaaacctgcctcaaaactgatggagtggaactgaaaccattataagaaaaatcacttctgtttctctcccacatgccactcaaataatgaactgcccagcggcggggcctctcatgagacaggcggctgggcaggcagcaggcagctccagtgggaccacagcatccccaggcaggagccagaaccctgccagggctgtgggcatgtggccaagttgtggggagatgggctccctgtatgtcctccttgagccccattccagactccatttgtgtttatctcatatcatcatctccatttcctctcaacagagcctccacatctcccgtgcatgtgcatcttgccagagccctgcactgtcctcagtgaacaatttaaacagattgtctccaccctccgtgcactgctggtgccgaagggcaggacaggtttcaggtgcccagtggaatctgtagagcttttgacaccttgtaggtatctttaaacctaaaagaacgatagcaacatggtcattggtactttgccctggggtcacttcagttcaaaataggagagtgatggcaatggacagagttaggcattcggcttcatgtagggatggggagagaagccattcttggcaggaggaatgcatggaagtgcaggtgacagagcaccattatacaactttcattagggagaacagagcaggaggagggagggcagcttcacaccagaaggcagaaagcccctccccgccccaccaagaagaagttctttattctactttctcatcctcatctgaaagtattgcttaataaaggccagccttcacagggctcacccctcagtgttaccttctaaagccccacctagatgtttcctctttcagccagggaggatcacattcatagcagcaccagggctgggtgggcactttaggtctttgtgttgaaaatgaggatgatgccaatgccgacccaagcccatcactaggtgaggtgagttttgagccacatcttgctcagacagctaggggtgaccaagagggaagagcaggcagctggtgagcaaaagcatgctgatactgtgctggattttcccagatcctcagaatagttacctttgaccagggaggagcatctccgatggatgtgcaattccccattacccctctccagtgagcagctttgcctggctgcagccatgagccttgggggcacctgactccaaaaacagatgtgagttgaggttgtaagccttcagtccaagacccctgcaggggaggaggtaacatcaccagtggacctataaaaagtgcagatacctcagattcctgagcctcaccttaaaccctcagggtgcatgtatttcctgtttcaggtaggcatggttctttggggtttatgcctaggagtggagttctgctcatgggataggtacatcttcatcttcactagtaatgtaaaattgttgacgtcctgctagcggtgtgtgtggagctcttgttccacattttcaccagtacttgctcctaacagactgaaaattctgccagtagcatcactttatgttggaattgcaatatagaaatggaggatgacagttcatgatgggtgttgtgttgtttaggttgaaaatgagtgagagttttgtcacctggcctagcaggaaagtaaaaatgctctggtaccaaagaaaaaattatttgtttatttgtttttttatgggaaaatagtcaaaattaaggaaaatttgaggccattagtgatattgtgaagtgtatatttggtcactgttttctggcaaacagctcctaaaatccttggaatctccaaagtagtaaacgtctagaggatggggactggtcatgggaaagagaggattagagggttgggactttgagccttatctcccagtctttggggagagaaaaggggactgaaggttaagttgatcaccagtggccagtgatttaatcaatcatgcttatgtaatgaggcctccataaaaagtcaagaggacagagtttggagagcttctagatagctgaacatgtgcaggttcctggagggtggcagggcacagaagccgtggacgctccacgccctttccttcatacctcaccctgtgtatctcttcatctgtatcctttaaaacatcctttataatgaagtagtaaacataactgtttccctgggttctgtgagctgctgtagcaaatgagtcaaacccaaggagggggttgtggagatcccgatttatagccggtgggttagaagcacataccacaacctggggcctgtgactcatgtcttaagtggggagcagttttgtgaaactaagccctcaacctgtaggatctgacactatctctaggtagatattggcaccaaattgaattgaactggagaacagccagctgtgtccactgcaaaattgcttgcttgcttgcttgatatgtggggaaacaaaacccacacatctggtgtcagaagcatgttgtaagagtagaggagaaactaagtttgtttattcctctgtccacaccattattttaaagagtcgagtgtttgaggcacaaaacaaatagtgacaagaatggatgattaaccagcaaccatgttagaacagaaacagatttcaaacagttgagatagttaagaaaaacaaagttagggaacagtttagtgggtttggaaaagtagaaatggtataaataatcagtctcttctataagagttatgcagatccactaattgttagcagtatttttattttagcagtgaacctatatagaaaatacaagtcttaagagagaagcaagatggctagaaaatgatgaagggacttagaggggagtgcatttagtgcgtccagattaaggaataaacctggtggaacggtgaatactcagaatgtgtaggctggttgtacacaggaccattttgtttcacttgggctggaaatcagcatgtcgagtcagcttttgtcacaaagaattatggcagagctgtttcctgggcttatttcatgtgtgtaccatcattacttgctgggtcagtttgggttgtattgagccagaactggggcagggcatgaagccacccttgggccatcattacctggaatcttctaaggcagctccatcggagctctcagggacaggccagttctgcttagtgctgggacaaagtgcttctgccagagctgccgattgatgactcttgctggtggatgagcaagagtttacatcctctgactgttctaagcctgtatatgtgagtagagctgtcattgctgaaaaaataagctgccttctagcccaaagaatgtgttaatattatattttttatgcaaaactgaagtgtaactgccacttctgcatcatgataaagacattcgtatttgacttgacagagcaaacccctccacagctggaggagaacagtggtgatcccctgtgacctcacattcatctgcacctctaaccctagccactccttcaggatcctcttgtgacaccggtctgttgttggattctacttgttacatgcccttttcagtgggcattcctgtctttcttctgatgacctgcattgcagatgtctatctgtggtgttacctgtcctcatcatgtttaggcagccacttacacaactgtgcaagcctatttctcactcctaccagccccaaaagatatgaagtgttttgtgtgccagggctctcagataatgtcacttatatagttccaaagtagatcacctctgcagccatttatggtttcagatctttattctcacatgtaacaaaagctacggctttgccacagttggggatgatttgtgaggtatgaattatgaatagacaggtagctagaatggatagagtcattggtccacttaggaagtcatagcttacttagatacctccctgtccagccacttgcatgcagtctctttctacccttgccttcttgatctggcacccccccatgcttctcttttctccccagcttcagtatgtgtctatcaagacccagtttcactcctgcttaatactggataagtatcagttgtataatgtgcaaatgcttttgcttataggtctcagatttagccagatctgggttaaaatgcagttaaacctagcactgaggccttaggcaaataactttacctcccttcattgatgatgatgataatacccagcacaggatgttgatggatcaaaggtcatttgcatattgcacctaggaaagctttaggcaccatagtgagggctcagtagaatggactcatagttgtttaagatttggcttctgactgcttctcaagctcagccacttacccagctacacatttcaatcccattaaactataagctccttttgagcagggagcctgtcttcttcagccttagcacccaaagcctcgaaatatgcttggcacatatttgaatgctccataaatatggccataaatcaaataagccgtaagaacacttacggttctttgagggtatcatggtgttccacacctctgtgccctcagatatgctattcccttgcctgcagtgcccatctcctccctgcctgggctaatatccagtcactttctcaattgctgacctggatgaattagaactccctctgtgtcccctctccaacctgagtccctcgatttacttgtctgtctccctcttaagtatatattagctccctgaggacagaggccatgtgtacttgactttataccggcagcccttagcacagtgcctgtcacataaaggggatcaaaatatgcttgttgaataaaggctagagctggggctgaatataaataaaagggtatgtgcagagaaacaaaaatgcaaaggaaatgaaacagttgaaaactggtgatttgttactatggtgatttcggagtaacttttgtttggggtagggggggtcgtttcttcattcttgttattgttttcttctaacttcatctccagcagctcagaaggagaacagctgtacctagcaaccctgtagggtagagccagagagaagtggagcctccctgtgatgagggaggagggtcaagaccacagcatgtcatgaatgccagagttggttgagccagatcataagttgttcttcattttagcaacaaaggaaagtggaggacataggtcttctgaaaactgtagtaagaaagagtactttaaaccatagggcaaaaaattaaataaaaactgtaggacacagcaatgcctagctcttctcacatcattaaaactctcataatgtaccttctcaaggctctggcacagcaggggtcatctgagcatttagagccaaacctgagcacttggtcaggtcattccatgagtcctcataattcctgaggttcagctgagggccaagagctgcctgtctgtctgtggactcagtggttctgctcaatgtgtgcaaaaggtctttgggctccttcagcattggtgtgaaccctggagggctccttgttgaagctcacatttttttgtttgtttgtttgtttgttttttgtttgtttgagacagggtctcactctgtcacccaggctggagtgtagtagcacgaacatggctcattgcaacttcaatatcccgggctcaagtgatcctcccgccccagccccccaagtaactgagactacaggcacataccaccatgcctggctaatgtttgtatatttgtagagatggggtttctccatgttgcccaggctggtctccaattcctggcttcaagtattccgcccacctcagcctcccaaagtgctgggattacaggcatgagccaccgtgcctggcttggaagcccactttgctccactgatgagggaactggacttcagaacttcagagtgacacgctttgtgccacggggctactcagcagcctggttccaggctaatgcactgatgaggaaactgggctccagaacttcagagtgacacgctctgtaccacagggctactcagcaacctggttctgggctaatgcactgatgaggaaactgggctccagaacttcagagtgatacgctctgtgccacagggctactcagcatcctggttctgggctaatgcactgcttacagaccttctctaaaacagaagacttaattccagactaagatgtcccggagacttgggaacaaatgctaagctggacttagaaaatggctaggagcagagcacgcttctcaaaaaacagcatggtgtagtaggtagaagatgcaagcgtattagatctagattcatgtccaggtcccacggcctgagtaactctgggaaagttactccaattctgtgggcccaaggttccttgactgtaaaatatacttgtaaggttgctctgaggattaaatgagatagcatatgtaaaaggtcaagcagaaaataagttctcaaaaagtggtaggcattgttattgttactgttgttgttatcctactaacttgccttaattcaagtttaactgtttgtgtcaaaggtaatcagaagttcttattggttctcgggagtggggagacacgtggcccacacagccaccctttgacctctgtattagattcacttcctccgtgtgttgctgcagactccctgttataacaaagatcccactgcatgccctcccccatctcctcccaaagaagcagtggcccacacaagatcaatattcatgcctctcgtgttggggtcagtggtgggtgctttcgggtagacgagcagctgtgctccgtgaagctgtccggggcccaggttccttccatcctgtggtcctgctgttccctgttgggttgccattgtctgtctgttgaagccagttcaccagcaccacacccacttcccagcccacaggaagcaggaaggaaagtggaggacgaccagctcccttttgaaggattcaggagttgaatatattatacccagtcacaaggagttgactagaattaagtgatctggccacacctagctgcaagagagtctgagaatgcagtcttcagctgcaaagccagaggctcactaaagctattatgatggaggagggtggggtggatttggtgggacagcgaggggatagcaggcagcctgcacacccttcacctgccttcacccgccttcaccctccaccgctcgcttactttcagtgacgtggatttgggctgcaagattgccaaggccgtgtccctttagacccagggcaaccctgcctgataccagaatcctgcaagcacctaggaaaaagggaagattaactgctgtgccatttttaaggagtgaacttaaggtttaatcactctgtaggacaacagtataaaaaaacattgtattctctacctcattcataggccaagtgaaaagtcactattaaattgcttcaccataacttttacaagcagtagtgttcgcagaatgtatgctggtatgtaaacccagtgttaccttttttggatttgttaagaaaaatctgactgggtttccatcaggtgttaagtaggtcatccacaagtggtctagcccatgtagcacatgttcctcccacacagagtggccacagcttgtcatcccaaatactgttttttgtgtgctgctggggaaagcatcactaccttctggtggttccacattctcttcctcttactgatgttcctcctttaatttcctctgtgtctctcttggcactcaatttgcattcataaatgcagacctctagtgaaaactttactgagacacgcacgacatattcaaccaccctgggctcacccagggtgaggaaaccaacatcagggaaggcagagaccatcctcctttccttcaggcaataaagtgtaggaggaggctggctggagtctgcctctctgctccttttgttcccgtcctcctgagccattctgtccccatagaggccgtggaattagatagactatgctttctgactggctactttatctgcattcacaccaaaacagctgcaagaagctttgaaattctacaccacggcaggggatgcaaaagttatccctgctgttgttgctgatttctggcagcctgaataaagtgccaacacaaagacccaggggccgggggactgggcttcatgttattcttcaaaggaaagacaccagcctctgccccaaaaacacagtgcaagtggcctcacagccaaattctcaggctggtagatttagattgggctgtgacttcataaccagataaatgatcagcgaaaatgggagacatggagaccacaagcaccgtgctatcagctcaaaggcaaaagaagtcaaatctccttcttcaaagtcctttctgtgtctttaaaggaattggatcttcttgactggaactagtgaattaaagaaagagaaaaagaatgcactgtttttgaaaggatgaggccacatttgcagaatcatctggcgaggaacctctatagagactgggaagattggcagggcgggttttgttcggccttggagagtgaacctcctcggctttcattctcagcggtcctcgtacttggggagggggcattgatgacgcctattcaaacagccgctttgtgctaatgtgttttcttgtggctctgccaggtgacaccctgacccttgggccctcggccagttctgccaccactgttccttaaacaggcgcagcccagaaagctaggctctgccactgtggcccagatgtgacactgaccttcctgtttctctttgctggtcatgaatagaagcccacgtttttgtttttcttttctctttttctctggttgattgtttttatagaatgagggtaaggagggtaggaagatacttgattggatatcaacatcaggaagaaacatctcttctgtgcctagtgtttctgaaaattttcaggtcacatgaaccagtgttgcctactgttctgtgccctgcttggattgccccaggttctaggggcagtggctcaaagtcaaagcattaaaatgcccagctcagtgtcccaacaggaaagggtgaaggcaacaagagcgagggcaggcccccttccctctcccaccaattggcatccaaagaacaaaagtgctttgtttcatcctctccaccttcctagagccaagcccatgcgtggtcttcatgacctcactcacagagagctcctacagacacctcaggaatcagattgccttggttaggtgccaaggtagacttgagtgagtaccgtcattctgaatttagtgggtgtccccaagtacctaggatgtgtggcccaaagggtctcaaaaccccactaatccagccaccctgcttttggttcggttatcccagattccacacttgtcccctacaggatcctctgcatgtggctttgcctttttcgtgcccttaattagatatctatggctgttcattgctgtgcactcaccgcccactcccagcactgcgcctcactgcttactttccagcacagattagttaagagcacacgctcagcaggctcactgtccattggtacctttcacccttcacaccttctagaaggagttgcctctcaacaggctttggaatcagtcagtctctccctcttaatttttcagttgacaaagtatacttcatcaatgtgtagttgtttcaacttacatacaaattcaatcagtaactgataatattaaagggaactttcttatagaaaaataaaggtgatttattctcattataaaaaaagtacattcttggtatagacaaatctgagaaaaaagacacagagagcaaagaaagaacagttgcccatagtgttatcatctgcacaccaccataatctcagcatgtttccttccaaagagttttctaggcatttgttatatagttgcaatcatgtgatccttcctaatataacatgaacatctttccatattgctgataatttcagtaaatgtaagttttaatttctgcttaacttgtctttatgggcataccttacaatttactttagccattgccctcatgctaaacaactaacaagttttctaatttttcaaatgataaataatacttcatagaacctcttcatgtcatttttttaaaaggcgtgtctttagcacacatttacaggttaaaggacatgccacccccgaccccctttttttttttttttgaggcagtctcactctgtcacccaggctggagtgcagtggcgccatctcagctcactgcaaacctctgctttcctggttcaagcgattctcatgcctcagccactcgagtagctaggtttacaggtgcctgccaccacacccatctaatttttgtatttttagtagagttggggtttcactatgttggctaggctggtcttgaactcctggcctcaagtgatccacccacttcagcctcccaaagtgctggaattacaggtgtgaaccaccacacctggccgagtatgcccatttttaagaattttttatattgccaaattggtttaccaaatggttttacactgatttctggtcttctatcagcaatgtaagagagtcatattcatttcaaggaaacttcatcactattgagtatacttatttttttaatgtgtgaatttagaagtgatacatagtatctcactaatctaaattgtatttctctgattactaccaaaggcaatattctcccatatgtttcacaaattgtttttcctttttttgttgccaatatatgtttctgtttcctaaacttagagtttctcttatctgtataaatttcttatatattgaaatattaatctaagagagttgaaaacatatctccacagaaaaacttgagcatgaatgtttgttgcagtattattcataagagccaaaacgtaaaaacccaaatgtccatcagttgatgaatagataaacaacatctggtatatccatacagtagaatatcttttagccataaaaaggaatgaagtactaatacatgttacatgaatgaacctggagaacattataccaagcaaaggaagccaatcacaaaagaccacatatgatgtgactctgttgatatgaaatgtcaagaataggcaaatccatagagacagaaattagattcgtggttgccaggggctggggagagaagggagtgggtagcgattgcttaatgggcatgggtttctttctggagcaatgaaaatgttctggaattagataatggaaatggtctcctttgtaaatgtactaaaaaccattggactgtgtgcttcaagagggtgaattttatggtatatgaattatatctcactttaaatgaaattttaaaaatattaactacaaggggcttttctatggtccaaaaaggcttgcgggcagggggtggagcctgaaaaaactttacaacctgtgctctaattctttctgaaacctttggcatagatggggttaaaacatatcatccttgttttcatcaccatttcactcttgtcttaaccctgagatccagagcaaaatgaatttaagaagaaaatgttcttactcttttcttggagcctttccatggtttggtgttaaagcctcatttggccatttaggtttgggactggttccagcattcagttgactgcagtcttaaatctcaccactggggtctgatgcttccatttctcttttattgagcgcttttgagtcttcgggctcgagaaatggaaggctatgcagaaaggaaagaacatgtttgttgcagggatgtgagcagctgcctcttagcctgggggccatttgaacaagaaaagccagagatggggacccacaaaaatattctaggtgccagcagtatggcttattcttaaagtaacatgacatttttaagagtgatttatattactttggttcccttgctgtgcggtatgagagaaggttgatcctcttccccctccagagaacctttgcaaagtcatgcgtaaatgatcgaatgggttcaactccacttatttctgaagcaaagcttgggtttgatttttaagtaggctctgttctcccatgattgcatgtggctagtgtctgcattgtgtatattcccacttttacatctatcttctcacctcagagactgtaatattttaatacttgcatttggcgaggggctctccctcacaggcttcaccaagagtagaaagctgttattttgtgcttggtggaggcattatatgtgtatctcagtttatgcagtaaatatgttccagaaagttttgcctgtaaagcaaatcatattttaagtgcaataggaaagctgatttttataccaaggaaaccagtgccaactccttcatggtacttatgaatacccttgccatgactaggaaagatgaggaaattaagggctgcttcagtgtcatcggcccaaatagtcattaatatgccaaaccgcacgaaggaagatggtgactcactgcacctagtatggtccagcatctctacagaatccactgtcttgggggaatggaatgtgcattggggatggaggtgagacctagtccctgaaatcagtgcctccgttagtaatgtatactagtccattctcacactgctgtgaagaaatacctgagaccgggtaatttataaaggaaagaggtttaattgacttgcagttccgcattgctgggaaggcctcaggaagcttacaattatggcagaaggcaaaggagaagcaggcaccttcttcacagggcggcaggacggagtaagtgcaagcagtggaaatgccagatgcttataaaaccaaccatcagatctcatgagaactcactcactatcacgagaacagcatgagggaactgcccccataattcgattacctccacctggtcctgcccttgacacatggagattatagggattacaatttgaggtgagatttggctggggacacaaccaaaccatatcataatgtgtgagatattgagctctgtggaaccaattcttccctataggatttttccctcaacacctccagccctcacacccacacccttgcatggactggccaggattccatggtcaggaaatagctctagtatagagactctgtgtgttggccatggaatcaggctatctggtttcaaatcccatctctatgactgacatagctgtggacaaattccccaacccctcttttcctcccttgtaaagtgtggggaaatagtaatacctgtgttttagagttgttactagattttaatgggacagcattttgcagagtccagcctgcacctaggctacagggaacactgattggatattggtcatgactgctgaaattggagccatcatccccatggtgcccatcccaccaaaacatgtattagttttctgctgctgcctaacaaagtactacaaacttagtagcttaaaacaacatccatctgttagctcacatttctgtcagtcacaaatccaggcacggaggggattctctgctcagcaaagccgaaatcaaatgttagctgattatgttgttgtttgaaggcttgactagggaggaatccatttccaggttcattcaggttcttgaccgagctgttctcagctctgaccacccatgtgtctggccacatagccccttcatctttaaaggcagctgtggagaatctcccccacaatgaaggcctctctcacttttaatctacttttccaggaactggcataccgttcacgggttcacctgattaggtcaggtccacccaggatgatctctcaaagtcggctgtgccaaataacaacccgatgatggagtgactaccccatcattcataaatcctagggatttgcagggcacatacaccgggagtaggagtcctgggggacagctcagaattctccctaccacaatgtcatttagcaaggcacatattttcactccctccagttggcagcaaagagaggactttcccacattggcagagtcctgcatgctttttttcatagctgggctggggccattggctgaacccagcatcagtgctgaaagtgtttcatccctcaagtattaacatctccagagggccaacccagcagtgactttttctctgcttcagtaccttgggaaatgcttgtgatcccaagagtggccagcatagccctgctttctgtccagcctccccagtcctccctggcccttctgtcccgtctgtccccagaaggcagcactgcctgcactctctcatggggtgtcaggatcatctgatgcagtatgctacagaggagaaaagccccattgtaaaggattgaaaggtgctgggaaattaggaaatttgggtgacagtttctgtggcccaacctcattgctgctgatgtggtactcaactgtctctgaatgtccttctgctcccagtaatgacaggggaaaactaaagaaggctttcctaggctttcaatggattaactctctccactgagaatgtagcaaaagtccccaagtagattcttatgggtgtttctaattttgcgaggatcaagagccctctgccatgaatcttctatcctgaagtcaaataatttcagatgtgtctctgccacatcttatccttttcctaatgctattcctgctgactgaaaaagtgtgtttgcttgataagcttccagtttttgcttttttccgagaaaagtgtgaaaccatgcagttgatctgcagttcagctttaaattcttttttcaactgcccccatctcagttgcttgcatttggtttctaggttcttagttcagttcccttccttgttcttatacttccattatgataccaggaaacatgccacctctaagtacgggccaaatgtggctttacctgtcactctccaaagtctgctggaggctgtcagaagcagggattatgcctaagggctgtcacttcttcacacccacctaggttggcttctgagacaaaagagcatacacccctgaaattaaagttatttgttgtcggtttcacttcctcttcctgccattcctcctctgcctgcaagtgtatgtgtctcaagagaaagtaatttgcttgtgcagaagactgccagtggcctttttcccattttggtacctagctcctgcacacacctgaaatcttatcacacgtcctgcaagcttataacttgggcttactggcattgctttattgattggcacatgacgaaatatgaatgtgtctgtgtttaatgtgcatcttgtagactggactgtggtctgtctacatcaggaggagggagtgtatgttcaaccagactcatcttggatcgaagcaccctgtgcctgtggtagtaaaggattgaatctatcctttaggtcagtttccgtcaatcactacagggctatgtggagaagcatatctcccatagcatggcagcagaaagggctgtgatctgttgataatgtctgccctgcttatgggagcagggtgcggcgttccttgaatcctgtgtccggcaattcttcccaggttgcttaacactattggcacatctgtaaagaaccacaggactagggaaattttaaatagatcaagttttatttgcttagtagaaaaagggcccctccctttgcaaaaggattggagaatagaggcttcacagctgtaatccagacaccttgatcacaggcacaggatccaattggtgaaaatgcccttcaccagtttttctaggcatgataacttgcagaagactatagccatgagttcatggcatgtggtattttcctgatcagagtaactccagggctccacattcacgatggcatcattcagtgtttcccggtgccccagagatctatagcaagtgaattagtacattctatgtcacgatgcacttacagcattggacattaaagccacagcacataactctgcataataaaggatacttttattttagcatgaatgatcaaaagtttgccttgtagcaaggagcctgggcacactgaatacagctcatgtagcgtcttctgactcttctgtcacgaagcagttagtctgactgccccacgggggagaaagaagaccacaagttcctacataaatattttcattgtgattaacttttaatgacttgaaactgcatttactgatttattttcacttcttcctatgtgtcattgaagagaaaagagtaagcaagatctgtatagaaacattacttaactcagaatgtcaaatgcgtgaagtggtgatggtgctgtctcttctataaaagaggattgttttctccaaaatgattttgattatttttaatttatttatttaactaatatttattgagtgactactgtgtgccaggcactgttctggccacgcaagatgcagcagttaaaaaaaaacaaaaattcctgccttcaaggagctgatgatttttcttctctattacttcataaaattatagataagctgctagttgcttattatagtatatttcttttttaaagtggattttgaaagattattttttcttagtttggttaaatgtaggatcctgttttcttcagggttcttatatggggcttattttgttttgctggagttggaagagtggtttgcaatgagtgttctcattacttccaggttctgtttctctatcacagtgcacaagcttctagagaaaatcagagcacttcatgtcactctttaaaactgcctgcttctacctaacatgcctgttcgcctgaagaaagcatgatgggttgcatgttaatcacatccatgtaagggaaacagctgttaaactgcttcaaagatgtagatataaattctttccttcgtgtaaatcaggatttcttgaccttgacactattaacatttggggccaggtaactcttgtttgtaggaggctgtcctgtgcattgcaggaagttttagcagcattcttggcctctacccagtaggtatcaggagtatccctcccctctgagtgtgacaacccaaaatgtctccagacattgcccaatatgtctcttgcaggggagtggtaaagttacccccagctgagaaccactgctgtaagtgatatgagtctgtgattcaggtctcacattctctaattacagtagatcagtgaaattcatggaaaaaaagaaaaaacatctgggacaagaagtgttttctgtctggtctttgcagaaatgtggagcaactttccaccacgaaagagttaatattatatgagcaagttatcagtctgatgaagcaacatcaacaacaaatgatgaaattcctttagtacatcatgccttggaaatagcttgcatttcctattggaaacttgttaaaatcatatccatttaccataagttacaaagcatgttgggcacggtatactgtaagttaatctcaaatgatttaggagtaaatgtgttccagatttggtgagctcagctcaagcagtaggcgtctcttttccaaacattttcattctcaagaactgacattcaattcaataagtatttattgaaatgtgtaatatgagagagctttagaacagtctgatactgctcccatcacccagtccagcagaaaagcagtgctcagaagagtgcccagggagcactcttctgatatggcacctcctgcattggtttgcaagatagtatagaaaagcatgccttctcctttgctgcctcaagcccttcccatcctgtgccagctgtgccctccccagtgaataaatgttattacacatgatggcatgtgtttcttatgtgattctttggtcccaaatgggctagtttgcggttttggcagggacctccactggcctgttctacctgacccctgttggcttgttggggtattgcaagtccaaagggggaccatttaaccaacttgtatttctgaatcttcttcacttctcacacacataccagtagattttaaaatgcaaggtacactgctgataaaagtcacaggaggggcctgtcacggtggttcacgcctgtaatgccagtactttgggaggccgaggcgggcggatcacctgaggtcaggagttcaagaccagcctgaccaacatggtgaaaccccatctctactaaaaatacaaaaaattagctgggtgtggtggcaggcacctgtaatcccagctacttgtgaggctgaggcagaggttgtagtgagccaagatcgctccactgcactccagcctgggcaacagagtgagactccatctcaaagtcacaggagggatcggctttaatacagagagggtaaaagagaaacataataggctacagaatcttcactcatctggttgctatttattgttccaggcactggcaatgtagctgtgatgaaaacagacagggtcccgctttcctggaacttgcagtccattgggcaatgagacaaataaacaggccctgttttaatatggcgccaagggtgccagaaggagggagatgaggatgccatgggagcacttcagaaagcacaacccagcctggaagggcagggcagtcggagaacgccttgcagaggaagcggtgccttattaactaggacatggatacgtcacatatcaaagaggaaggggaaaaagtgttcaaggttatgttccaaggcccgaagcgggtgggggaatggagtctttgaggatctgagaagttgggcgtgtttgaataggagagccgagacaggaagagtgggaagtaaacaaggaggaggaaatgaggatgcttctcaggatgctgactggagcaactgggacactggtggtcccatttacttagatgaggagcctgggagaagagggtttgaggagggtggggtggcaacaactcgagtttttaatccgccactaactctgtaacatgggaatgatttttttttaatgtttttgaaggatgtcaaaagctaatggaaatttgaaaagttaattagcagctttaagtgatttcattactgtagactatcatgacatcctgcaaatatactctgacctcttaggttctgccgattttatttttcatccagtaactagttcttagttttgatacttagcatcatcttagtgcttaaaattgaccagttttgtgcctgaagatgtggtacccatgagtgaagcagtctagtgacttgattgaaggttgtattctggcttatccaacactcctgtgccctcttccttaaatttcctgtgccctgatggaagtttttattctaatgttgcatagactcattctacagagcatgtattattttttttagatggctaaaggcagaattggtaaatatgattggaccgtctgtaggcaggtgtatgctgttacagaattttacgagatacaggccttattcgaggaaagttgctgcatggtgaacattgtgctccgtgatgatgctgtcatccagaacatatggggaacaaatgcgattgtggggtcaaggaactgaacttcctcctaaccatctccccagccactgcctttcctcatgccccctaataggcctgaaatagccaacagtgagccttgtcaattactcctcgtttactgtagagcaacccagcaactagggagcatcccagcttacgtgcccccttttttgtctttggcaggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggtaagcccccaaagtcacagagtgcagagagggggcagccacccttaaatcttttggcaattgaacatctgggttcccatcacttccctttgactaggggtttcacatgtaagtttctaatctgtctcctctactagatgaggggttgtaagaaaagccagagtttgatgtacaaacaaaatgcttggctacagggttgcaaggtgccccaagttgctgctttctgaggattctatatgggttagtgagctacaacattctactgaggcactgtaggtcaatgactctcagcctcacctggctggttggcacagaagaactagggcagccttttcaaaacacggatgcctgagccatgtcccagtcttttgaattagaggctccaggactgggtctgggtgtgtgtattttgagttctctagatattaatgtactccctcttcccactcacttcttcctaatcctcagcctgcctttcttttttttttttttttggaagtttccttgtctttcataccacaaggctatattctgctgccatgtgtatttgctgacttagctaatactttgtaaaatatctggcgtacgttctcagacatatgttttccgaaatatttgtaagttatgtcatgcatccctagtcatccaaattttctctgagtatgtgaaccatggtaactagatatttcacattatttgttccagaattattttgtttattgcaaaagtttgaaagaatgcagcatctctcagttcatctggcagcagatgtcttatataaaagtttgaaagaatccagtatctctcagcccatctggcagcaggtaccttttcacctagggaggaggcactactaaggcattagcaagttttttttccctctgcacccaacacacatcacacatcagtgtagttgtatcaaggagcctgaccctgagcctttggacattatctacttctcttctgctagcatagcacactctgcccagtagaagaagtatttatgttcaccctcatgctgtggtgactctagctttccttttaacccaggccttgcatgggttgaatacgtgctaagtacctttacccatccttcccaccttcccaaaggtgcctgaagagacacagacaggcagtctaaggccatctgtcttctgatgatgcaggagaaaaaaagaggcaaacacaacccccatccttgtgcctaccgtgagaagcataagggctttgccagcccagactgttaattctactgacacagccattgtccttgttcattcattcacgagtgctggatatggacccctgggtctgcaggtatcattcattaaagtcactagagagggccacttgtgttgagcatgtgggtctccaccgtagtcaggaggagtctttgtttaagaggctacctgatcccttataaaatttgaaagttaaaacacagtactcccaaatgttggcagatttttctgccttgagttatttggttttaatatatatgcatgtcctttctcccaatactgccttcagtcctgtaaggccaagaacaacgtctgtgtttctctgtaacctcctttgattctcccctcagctcctggaacatggaacataaaagccctcagtgagaacttgtcagctgatgcaaggagagagtggggtgctggtcttcatgtgccttgccttccacacagtggggctggcttggcttcatttttaaattgtttttaaagaagggaatctggtcatggagtgttaaataagaataggcatgaccttacgggcacccacatttttgttttaagccaatctcttttcttacctttcaaagaaatctaaggaaagaaggaaagttgccaaatgagcctagctttgcatggtcagacctctgaatgctaactctcctgaggaaagtcccacttgggatggggcagaaagacaagccccactcttctctgtggtccttgaatagtgccatgacacatttcttcccttggaactacctacacagcaaattggcagcttggtaaaaaaggtggactctggccgggtgcagtagctcatgcctgtaatcccagcactttggaaggctgaggtgggtggatcacttgagcgcaggagtttgagaccatcctggccaacatggcgaaaccccgtctctactaaaaaatacaaaaaattagccaggcgtggtggtgggcgcctgtaatcccagctactcgggaggctgaggcaggagaagtgcttaaacccgggaggcggaggctgcagtgagccgagatcacgccattgcactccagcttgggcaacaagagtgaatctccatctcaaaagaaaaaaaaaaaagtgggctccctgtcatttctgtaggtcatagcaggcactctgaagtgcagagagaccagaatgaaaaggcagactgcagggaactactattagttatcaactgctgtataacaaattgccacaaaacttagcagcttaaaacaaaacacatttaatttcttttttttttcaatttcagatgttttttattcagaggttcttaaaagaaataaaacagaaaagctaacagtctgatcaaacatacagctcaaaaatgtcttttgacgtttaacaacaagtcctaggaaagaaaactacagagttatcttgaatggggtaaataagttaccactggcaagtctgtggcactagtaaaacaaaaataaaaaattaaatctcggccaggcgcagtggcttacacctgtaatcccagcactttgggaggctgaggcaggcagatcacgatgtcaggagttcaagaccagcctgcccaacatggtgaaaccccgtctctactaaaaatacaaaaaattagctgggcatggtggcaggcacctgtaatctcagctactcgggaggctgaggcaggagaatcacttgaacccgggaggcggaggttgcagtgagctgagattatgccactgcactccagcctgggcgacaagagtgaaactccatctcaaaaaaaaaaaaaaaaaattaactctcttgatcatatagatatctctatatctctttttttcaatcgggtacaaaagatctttcttcataattttttttataatttaatggctatctactatatgatgtttaactaattttttttttaatatacagaggttatgtttcccaaatcttacccagacgagtatggcacttagttagacatttctggcaacagatttcccctcccctctaaccaaactatcaaatttctgccttaactaatgcagaagtatcaactagtgggagacccaggtttataactgtactaggtacacagagggtgctgcgttcagcctgggctttcacaaagcagtaatattccagggagcatagaaccagtgataccgtgacttttaaaaaataaaacaaaaacaaatttatcttatgactatgtaattttcactagaatctacacttctcagagcagccaggactttggaaactatgaaatgtcactgacatttatcatcaaatacaagcataaaatgtaagaactaaaaaatactcaaaagaaataactgcttagccctagcttctgagctaggaggatttgggctgtggaaacagggagggccagcaacctgtcccagcacaaaagaaaatagactctgaggtagataactgatcatacacagctgaccagacaagtacacagttttggaaggcaacttaatttaccattgcttttaagacatatgcaattgccttaataaaagagctttaataacagtgtattatcttatatgtactaaaatagaaataactgtgtatttatgaatcaggaatttcatagtttcaaaactggttttctttacacttgaacacttgtagtgatgacataaagtgtggcaccgcttggatccaaatcttccttcatgcttttttgtttatgtgtgtccatacatcaattaaaattataaaacctaaatttacagtttctgtgggtcaggaatctgcgaatggtcagttcggtccttcagaatctctcacaggctgtaatcaaggtacgttggctgggctatagtcatctcacagtttagctgagaatgatctgcttccaaactcatgtagtgctggcaggattcggtgcctcgctggctgttggccagaggccaccctcagttcttggtcacatgggcctcaccagcatggcgccttgcttcatcaaagtacacaagctgaagtggcaatagagagagtctgctagaaagacggaagtcaccatcttttgaagcctagtcacttaagggactgcacattctgttgagtagaagcaagtcgttagatccagcccacactcaaggggaggggcttgcacgagactgaatactaggaggcaggagtcactggggactatgctagaattatgcctgttgggttgggcacagtaggtcacacctataatcccagcactttgggaggccaagccagggggatcacttgcacccaggaattcgagaccagcctgggcaacatagtgagacccccgtctctatttgaaaaaaaaaaaagaattatgcctaattatatggaggaaatcctaggccaaatgacactggatattctctgctgctgctagcaaacttctgtaaaccaggaagggcctctctagagagccagatgagaggacatagggtgggtgtgaggaagagtgagtgctacaagacagtgtgaggagaggtgagttcaaggtagggggaggacaagggagagggttccattttcagcagtggggcgagcagcacaaaactgcaaaatgaactgcagatgccaagggcagtacatcctctaattggggtgaatattacagaaacggtcttctctaaatttccccaagctgcaggaggcatttcctattacgttctatgttactgttttaccaggagaaagggtggtgcattttacccagaaactaacataggctccaagtggaggagaagatacgaccagcaaaggatgtcagtaactgctgcagagccctgcaaacctgaaccctgacgctgacgctgcccttttgtttgggatgcaattttaatatttccctgctcctcagccctcattaaaagctattacagaaagaagcccttcaggtctaggtttctttcagatacagtaaggcttcccctacaaagaccaaggcataaacacagccctgtgactgtggttttgacacgttaattacaacacttcatcatgttattagtgctggctagatgtagattgtgagaatgagattttagtgaagatttaatttcttggaattaatttccccttgtgtaataatctcccttcttgtgaatttcgtttcggcaggagtgacactctttgtggccctttatgactatgaagcacggacagaagatgacctgagttttcacaaaggagaaaaatttcaaatattgaacagctcgtaagtttggagagggaggagaagcatgtatacctttcaggttgggaaggggtcttgcatttctggtctgcatctcttcagatgtctgaaatgctaaaagaacatttgctaaattcactggtttacaacaatatactttgagaaaaagaagagtcagtgacacagtgcagtattttatggcactgtgtgtccaaggagatttttggagagtaccaaaaatactagcacagtccatgtttattggttttggtttaggtttaaaggttgtaaaatcaccagcatcgctctccacagccctgagtgtttctacaaacctacagtttcaagtgattggcacaagccttggctacccacgtttcgtgctctctgccttgagattttcttcacatttcagatgttacactagctaagccctcacttgaggcttgcaacaagttctttattttataaactgctaaacatttctttggtgaagcctgtggaggcgtttccctataacaaaaatttgggagtgactggaatcttttggagctagaagaagtgattttacccactcttgaatgaatatgctgcatggttgtttaatgttggccaggaggaacaacagttaaacaagcagtggggagatttcaagagtgaggatcactcacttttcaaatcctacattcagtacctccataagaagagtaaacacgggtcagattttcttagggtttataaatactgcctctattagattgaggcagtgtatgtggatgaggcccttcagaaaaaaatctaggttctgaagaaagtgtgggggggtggggttccacatcagcaagccaggcatctccagcgtccctatgagtgctcccggtggttgggaaagaatgccacccaggggctgaggggcacaccaggaagttcttctatgccaccaagtctggttgcttctcctctgctctctgagcaaatcagattccatgttggcagaaggacttggagccaggctcctcagctttcccagaaggatatgccagagggagtaagaggcagccctggtcacactgcacatcccaggaaagaggagtgctgattgccacagggacctccttcaggcctgaaaactgcctccttggaaagcccacccttttcttgaatgccccctggctcacagaaccatgcagtgagaatatgccgcctttcaacagcaagaactgaatactgccataaagggccaacgactctcttcgagacatcagaaggcacagtctacatagccacagggttttcaaacatatattaggattgtcatcattaacaaaggtgtggggtggtgtttttttaactttttgttggaacacatgcagaaaagtgcacgtatcaaaagtgtacacagtgatgttgcacaacagtgtgaacgtacttactgccgctcaactgtacacttaaaaatgattaaaatgataaattttatgttgcctatattttaccacaattttcaaaaagtatacagtttgctgaattttcacaagctgaacatgcctgtgtggccaccagccaggtcaagaagagtgttacctgccccccaggagtcctcctcctgtagccacaggaagtttttaaaaaataataaacagctaccattcattgaaggctcctgatgtaccagccatgagctaagttacaaacattctcatgcattcttccactactgtctgaggtatgcatcgacgtcatcgtttgatatctgaggagccagaggcccagattaggaaactgccccagagcacagagctggcaggtggcagagcccagggcgaggtgcagggaggcatcctgagaacagtgtcaggtttgatctgggaaaggcccagatactttatcaaaggggatgggaaccttcaagtgacaggaagctttggagagttgactggggctggggaggaggggattgggctttgatctctctgggtatacctccttgctgttattttgctgcttgttggagtccattaactttgaattctgaaatcctccgccccttagcctcccctacatgccaaggttgattagaaatttcaagactatttgtaaactttcaactgcaagaaccaaggaatagtaagagtgcagacccagctctcaggaggctttgtccacactgcacgtgcgtctgtgcattacgctggagggcgttggaaagtcagtccctgccagtgtcagtcccatggcttcttcctttgttaatctggaaacgatctgcagtgtcaccaaattgaaattttagagaaacacttaaggaggatccaatccgtctcaatctctattttgtgacttccatgcacggcctttgatgtttacggagtcctttgagcctccaaccctgttcttgtagaggaaaatattacaaaggttctcttcctcttaatgttcttcctttctgccaatggaattccatatcagtggaattttaaaattccctttctcaaggttatagaaaagaaaaataaggtttgtgtaacaagacaatatcctgaagtcaagggtaataacagggaagagaaaatcgtgaaggaaaaacaaagcaataatacagaagcagatggcacacggctcctcccctcccccatcctctcccgcctctggctctggtcctcagaggagagggaggaatggggctctgttctgccagggcagctgccacacctcctagtgtgtgtcctcccactcccttccctggtggagccctggtggcgctggaggccacagggctggctttgttaaagtacaacatacaccgtgggatgtgcatgtatgtatgtacccagaggcggtgttcctgctacccagcaaggggcaaaggtgcttcattgacccgttgtaagtgctcagtgtcatgtattaggacattattaaatttgaaccccttttgcaaagtatttaagttcatccattttattccttgttttcacatttcaagactagtcgtttaccatctacgaacagtgactctttaaaatgtaatacatgttttacacagagtggagtattggtcacagctgagggtaggtttgttgttttttttttcctattgtgataaaaagaaatcctggtttagagccccacccaagcatttgataaaattgttaccgacataaaatgctacactactgagcagatcaaggctgacttctgttggcaaataactactccctggctccaaggctctagggctcccagctccggggcccacaagcctacgagcaactttggggtttgggggtagacacttttcttggtgtggggtgtggtgggggcacagaatcttttagcaagtctttaaatcagaggaacagagacagctgttataaaaccttaaaagccattctaaaccagcgccaggctttaaatcatatatttgaattagagcaagataacaaagaatatctcaccaagtgcaaactgaaaaatctgaactataagaaccgtttaaagaaatacagctttaacaatgctaattacccacagtaactcaagaaataaaagataacatagtagagatcctattttcctaaatcaacatgaatatagagtatatctatttataggtgaattggtgcttctagtgtatcaaaaagatgacttaattcactcgctcaacggctctcaatgaatattttgagtctgtaccagcctctctaggctcaacatgtgaggtttactacataataaacattgaatctttgtcactttatgtctcctttgatgaagaagatgaccctagaaagcctagaaaaagagaaatcaaggattttatctttctcatgagtagctgaaaacccttgtgagattaatagggtcaagtgagaaaatcatgaattcctgattcatgacttcagaatgagctgataattgcattctgatctgtgctacactatttaggtacctagaccaaaatgagatagttaatgctagatttgaattggaaatgacttcattaatgccagatcacctgaataaggctgggcttgtcccaacctgcagcaaaatgtattggcttcccgcccctattgacagtctcagataccctaaaattgatgctagccatttttttcttaatttaattcaattagaactaacttgatgaaggttatcttgcattaaaaaacaataagcctctgctacaagcacttaattttttcctcgccattttggagcatttcccaggctgggcgggagagggtggagggggaggagctgggtattgttatttttaatgatgaaatgtctccatctagtggaacttcagagcagtaaaccttgtcactatattaaagtgaagattatgtctccaaagccattttccttaaacacatacagtgtttaaagaaaaaaataaacttccacatatgttcttagatgatatccttacaactgtatgtattccttttggaaggcatagaaatgagaccagtacaaactgttaacatttttaatgtcatgatttgaacctcaaagagaggggtgcttacaataggggagcagcacagtgcagatcccacccagttggtaacgatctagctcttaagttgggcagtgggttcacggggttcatatatactgtacctatattcttcagtatgtataaatatttcctaacaaagatctagacatgaactaaatttaagattatgaataaatctagacatgaactaaattttatgaataaagaactttctgaatatgagtactgtacttttgctggatttgtaatagggtaaaaaggagagattaggaaactaaattaaagcataaggttttaaaaacctttgctggcaccttggttttttttgtgggctattctgttacttatgccaccaaacattttcccacagcagcacccccagcacatgctggctggtcacctttgttctgttgctctattaaatcctatctggaggcgttgctcactgctcaccttgctcagagagtccagctttagagagcggcctctggagtaatgcttgagtttaatgtggaggctgattattctctacctgattaaatctgtctggggagcatctttaccatggccagaagctaacacattttttttttcccctggctgaaagctttgacacagaactcagccaaaagaacgatttttttttaaaatgcctgaagttttgcttgctgcctccaaggaccaaaaaaggaggaaaagaaggtcctgagccccaggagatcagatttgctgggaggtctgatttgcttgagggcaatcatgtcgttgactgcaggctggtggaaggttctgcagatactcagtggatgtcagagccgcagcgccacatccatggcctccccgatgttaatgggaagaggtacacactccattcctgctcttcatcacaggtagccctgtttgaatctaagcagatgaatttgaactgcttaatgtactcactggctttaagatgagagtagctacaagatcccctttcacctcctctgagagctccccagattgataccacactgctgtgctgtggcatggagcctaaggcagtacaaagtggcgtgactaaaaatctcactcccttgccgagtttctgtgcttcacctgtgcgagcacacgcagccattcccatcctcaccccttgcccatgagcctcaggccagtgctctggacatttgatggaatcacttcagactgaaaatgcctggggaaggtgatcctactgtagcatcattctacctgcagagaggtgtctccccatctttttgagagcaagccaggcacgtgtttagagcatgccttcatccctcatcagacctcctaacctcccaatgttaagatgttaacatttctaatgtcatgatttgaacttgaaagagaggggtgcttacaatagggaagcagtactgtgcagctcatattgacctcagacctcctaaaaagcttcccttcccagatgatctgcagctaacatgttctgcttaattaggctgaggctggattccttttccatccatccaagttaaggacactaaccaagcaaaatgccccctaccaagagagacttctcatggccaggattccacattcttaattcacaaataaggcaagagacaactgtgggttcatctcatggctgactcgaactggaaccttctgaccttcacagggggactatgttggagttcagagtaaaggaataggttggagaaatcgggtggcaggatgattaggtgacagttatacacttcagaccacagtgagtctctaactgcaagctgttgaaatggtcaacatatttacttttcttttttatttacagggaaggagattggtgggaagcccgctccttgacaactggagagacaggttacattcccagcaattatgtggctccagttgactctatccaggcagaagagtatgtttcattttgttttcacttaactacttgattttaaaagttgattgccgcaataaaatgccatcagcattgggcaggagggagaagaaattcacagcagtgattaaggctgagtttttcaggctttctgccccggtttttaccctgtgtaatacttgcactattattaacttaatgtttctcttgaagcctgctcacttattttgaaagaaaactttctatcaataccctaaatgaaaagccagtaaaacttgtcatagattaaaagtagccataaaaatatgaaatgctagctagagcatatattattgccaacccaagtttctaagcccgcagtccactccctctgttgggaagagaggggagagtagcaagtaattgccacagattaaactaagatttttctcctaagtgtgatcagaaatattaaaagagtgctgaaaagacaccttctatgcccggtaaaagtgactcacatacagtgtgtccccccaacttgggaaatactacagtgatttggaacctcagttggcttctttggtagtaaacagtgacgagcagttatttggcccaactattcaactggtagcagtttaggaaggtgttcagtaggctgaagggatctaaaagggataacctttctcccttcttctgacccatgaggattaacaggcactcccaaggggaagaactgccagtggctgtttgccagccctgagggaaggagagatggagccatgatttcccaaatgcaggaacttggcctcctcctgacaccttgggtcttgcctctctaaaaaggaagttgagaaaagtcagtcaccaagcccaacctttggctctgctatttaatttcaccatggatttgtttaagtagtgcaagagggattagactccacaccctagccaaatccccagttggattgttctattctttaattcctttgtatttcctctaagaggatctgttttgtttcccactctcaaatactcagtggttcttagttgtttctttctcctagtgactgtgtttcgtcatcagtgaatcaaggtatttgtatttaatttgtattttagggcagatttgcaaacatctttgtgttctttcagaataaaaagtaccaccaaaatgtagcattaccctgatttaactgggaatttgtcagctatatatttaagttatttttataatggtcaactttttaaatattttgtttttaaagaatattattttttaaaataatgccttcggttttacatatgcaattaactatcattatcttaaaatactattgttttggtgcaatccattgttctaacaattcctttttcaccactgttttacacggcattctaattgggttattggtacaaacccagaaagccatttctcacaaataattgacgtactagtctttacgccacctaatgctagattaagaattgttgcacattttggtgtttctaaaagtcactgaggagctaatacgcaatgtctcttttcttcagtgaaacttaattcacaaaagaatttgacagtgaactcatgatacctatattcaagcataatgaattgaaatttcattttagaatctggattctttcacagttaaatattctaaaaatggttcccacacacagattccaattgaatgctccagcattctcccttgggttttgggggcacctgctgctcattcagcacctagtgctgaaatagtaactaattgccaggcttggttaaggcttgaaagtgcagggggaggatataaggcaaataacaaaagtcttgaggtgacttaatgtgatgcctcctaaagtggcacagagtatcattagtttcttcagggataatatattgaaatatctgcaacaccaagtcattttaagggcatgctttttgactgggcacagatctcaaaggtgtacagtaaccagttcttacagttgtgccaaagaaaagatgtacagggtccaccgtgatggctccctcctgtaatcccagcacttgggaggccagggcgagaggatcacttgagcccaggagtttgagaccatgctgggcaacatagggagacagtctcactctgtccccaggctagagtgcagtggccctgtctcagctcactgcaacctccacatccctggttcaagcaattctcgtgccccagcctcccgaatagctgagattacaggcacatgccaccatgcccagctaatttttgtattttcagtagagttgggatttcaccatgttggccagggtggcctcgaactccagacctcaggtgatctgcctgcctcagcctcccaaagtgctggaattacaatcatgagccaccactcttagcctctacaaaaaaaatttttttagttagcaggtgtggtgatgtgcacctttagtcccaggaggctgaggtaggaagattgcttgagcctggagaggtcaaggctgcagtgagctatgattatgccactgcactccagcctgggtgacagagtgagaccctgtctcaagaaaaaaaaaaaaaaaagaagaagaagatgatgaacacagatcacaatccaggtgcttggtaaataaatgcctttacttatccaagtcctcacacacctaggggaggaaaacaaaatacaagtaagtactcatgggcgtttttctcagaattcttatagggaggaagttattgaaaatactattcctttattcatatcatatctatctaatctgactttttttaatgcttgattatcttcatatacattaagactgtgttttgttatttcccagcagttacaataatgcttagatatcaagagattcaagagttttgtttttttgtttattttttgttatgagacagagtctcgctctgttgcccaggctggagtgcagtggcgcaatcctggctcactgcaacctccaccttccagattcaagcaattctcctgcctcagcctcctgagtagctgggattacaggtgcatgccaccacacccagctaattttttgtatttttagtggagatggggtttcaccatgatagccagcattgtctccatctcctgacttcatgatccacccaccttggcctcccaaagtgctaggattacaggcatgagccaccatgcctggcgtttgttttttttgttttgttttgttttgagacacggctttgctctgtcacccaggctggaatactatggcacaatctcagctcactgcagcctgggcctcccaggttcaagtgattctcctgcctcagcctcccgagtacctgggattacaggtgcccaccaccacaccaagctaatttttgtatttttagtagagctggggtttcaccatgttggccaggctgatctcaaactcctgacctcaggtgatctgcccacctcggcctcccaaagtgctgggattacaggtatgagccaccatgcccagactagagtcttttagataagtgtggaaagggtctcctgcagtaaccatttcaaatcaaggtcttagatttctggttttttgcatacaggtggcagttttaacacaaaccagttctggtcatgtctagaggggaggaaaacaacccacaactcaaatctgattttttttaaagagtgaaagagatgaattagggatagaatccaggatagattgaaaaggaactgaattaagctagaaaaaaaatacatccagggaaaggttaaggactaaattggaggagaggggaattcatgggcaaaaaaaaagcctatgctgttgcattttgtaaatgactatttcaaaatattttctttccttgatctaatttaaaggtggtactttggaaaacttggccgaaaagatgctgagcgacagctattgtcctttggaaacccaagaggtacctttcttatccgcgagagtgaaaccaccaaaggtaagataacgagttgaagaagttggcttgtcattcaaatctgtggattagtcagaggggatgaaaggcttatctctaatgtacaaggattttaaaatggcacataccctccctgccttgtgagtggagtcctgttttcagtcttccctccaggctctaaaactgcagacagcaccaaaagaactacagaggccccaaatcaagaccttcctcctgaaacgggctggatgcagctacactgctccaggcacacaagatcgtagaattttcagaagtcctttagaattttgattttctgaaatcttagttcctcaggtgccagtcatacaggttgtttttgctttccttttgttttttaaataactgaggacttcacttctcttcctccaactgttggacttttcattatttaacaactccttacaacccacaagaggagacaggtcaaggaagaaaagagtagtggcctctagcttaatttgccagattatccattcctgtaaaaagtgttgtaaagcagaagcttgaagctcacttctagagaaacaagccttagatttcttttgcacatgctgctgctacctcccagtatgcccctgggtagagaagacaagggaagcaagctcagccattcatcgtggtccttctttacccttgggggaaaggagtgttggaattgagtctacgctgtattatgcaacaaggggtaccgaacagtgtgtttaagaaaaatgtccaggaagctttcagtctcaagggcagaatcattttattgctaatatattctgacatttgcagaacatcaagaagcatcttcttcctgttactgagtggagatgctgtgtgtgtgtacatgtgtgtgtgcatccttggtaattattaatcagagtcaagaaaatgaggcctaaaaagcaagctgatactctaaatgattggagctgctaatgctttccacgtttaccaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcaggtaaccttaattctaactacctactaaccatttggatgctggagggagtggataggcccagagcaggaaagtggaaaggggtaaaactaatatgtacaaaatcacttatagagtatgttttctttgccagcccttaatggtagggcttggctgtataggttctattgctattgttctactgttgttattattagttccacatgtttgtccgaagattctataatatttttgtttcccaagtagaaagcaataggttaaattttaaaagttgtttgttttttcatcttcaagttgtcttttcccattccccgcgttgcatgtgagaaagcagtctctcggagggcgcttacatggggactcctacaaggaatattgtgtttccactatcactttaccctcagcactgttgcaggaatagctgcacgtacatttcattctcatgcaagccatttatcatgttccccaccaatactgctgtttcctaactaggcttagacttacacaacccacagctcttagatctattatgtctattgtgttaaattaaacttttataatgtacatcagtttctgtcctaacacccagatatcaccattattttgttctttctgaaaacatataattattagatatgcagtttatacattttatcaaagactggttttatgtgcaattgttaaaatgattgctttctttcctagattagcaagtattatatgccactatataatacatgttcacatgtgcctatagatataggtgcacatgtatagacacatgtctatatcctattaagcctagagatatttttttgtgtgacccatttctccattttctattgttctccaggacaaaggcaagactcaaaaatagtatatgatttacctctactattgctctgtgcacaatcattgaaatatgtatgtataatttttggcatgaaaaagcaatctttcgaaaatgacaataagaaatgtctgttgatcccttgcactaatgaacaatagaaaatattaacagcacttgcagtactagttgattatggcattggctaactcggtttatgtggattctaatgaaacatttgggagaaatggaacaaaatatctccctgagcttaagtgatatactcaaaatgcctgcatgttgtaaggatttttcaaatgctgaaatatatttcattacagccaaacatcagcaggatccccagggtttggatcatttgaaaatactgtgttcgaaagggcaccttaataacattgtaaagctggaaggaaagaggggatatgaacaatagacactttttttaatctcggggaaaaaaaatccatctcacgttagacttgtttttatattggctttccctcttccctctttctctctcacacaataaaatgcctttgaaatgctgacacataaataatttcctacctaaacatctcagagcctgattccatcaaaaagaaaggagtaaaaagcaagttacagcccagcagcacatctgctttccctgggtccgggggctgccaggagggagcgggaggtctgtccacctcacaaggcaggctctgtcagcttttgtcactccctgatttcttattctttgttaccttttttcgcctgactgatttttacttggcatttaagttccccttagcactgccagattctaaaaggttatattctttttaaaaaagaagagaaagaaagaaggaaagaagacaaagaaagaataaaaacctccgagtgttaactactttttcctttcttcttttttttataaagaatacattctttcacatcttgaatttctgtgaattttagtttccattctttctcctttcaaaccagacacctaaattatacgtcgaagactgttaaaaagttgtttttttttttttaatggaaaatatccaagaagcagcccaggagtatctgacatggtggaatggaatcagttagaaagcgaagaaatcactaaaaaaagttacttctttttttccccaccagttataatcttcaaccttactagtttataacagtttaatgtcctatagaaggatcctccactaaagttataattttaagtatagtcatatagagagatccctaatcccctgggtaatctagatactaaaggtggggaagaacagtcatattgacattctttaatccaaaaccactgtttgaaattagtaaggatattttcagcattcccaaaaacatgttattagcacgttgagctgaaaacgtttttcttcctcagtgagtacagaaaccaaagcagtctgcgtgtatgtctatgtatagactgtatcgtacctgggctcatggagtagtctaaatttaaaacgtcctctcttctacctccaatgaaaatgtttccgtgtgtggcgtctgatcttccaccgtgtgtgtggtcgtctgctggtgtagcgctgtttaaggagcgctgtgtgctgctagtgttccacgatgtgtgtggtcgtctgctggtgtagtagcactgtttgaggagcactgtgcgccgctagtgtgggtttacacttatgagtgttgtcattacatgtgttctgctcttctctccctctcctgcccctgccctgctccatcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctaaaaaaaaaaaaaaaaaaaaaaaaagatagtaagtgggcaaaattggcaaatggctcaagttgtactattacatgactctcaattcataaaccagcaaatggtccaaggaatgttccagctgccataaaatatcttgctcttcatttccaaaagcaaatatttgttgagtgtcatcctaacgggcaagtcaccttccatctttcctagtgcatgcataattatggattataaggactgtgttttctttattaattccctttcctgtagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtaaggcagagggcacattttgttttggctgcatctcaaagccgattaaaaggatggttttgaacaaaaatgcacacacagccgttgggacaaagacacttaacctggataactagacgggcacaggccatccagattttcagaatatgctgataccttgctgtgctcatctgtcctacttcatgtggttaattaaggcacccgcagaacaggaaaccagtacactatgaatctggtgtttcctcttcctaagaaatgggaaggtaagatactgtatatgggcagccataagaaagaccatggacgttttgctcaatgggcctgggtttgaatccttactagctaattaaccacgaacaaggggcatatttaactcctttaagcctcagttttttcatctgtaaaattggaatgatacctttttgttgttgttgagacggagtcttgctctatcactaggctggagtgcaatggcgcgatattggctcactgcaacctccacctcccaggttcgagtgattctcctgcctcagcctcccgagtagctgggattacaggtgcctgccaccacgcccagctaatttttgtatttttagtagagacggagtttcaccatgttggccagaatggtctcgatctcctgacctggtggtctgccagcttcatcctcccaaagtgctgggattacaggcgtgagccaccacgcccggctggaatgatacttatttaaaggattatttttaggattacatgggttaatatgtttaaagtcccttgcagatagtagatattcagtagagatacatacttctctttatttgattgtcattgataaggctggctgcactgggcctttgtaatttcttttatagcccttttgggtcagttacagctttgcttagaaacaattcatgggtttaggccccactcaaaaacatgtttcagtaaaacaatattaatacttatggaatcctctatcttccttcctcagaactcattaaaaacaatatcgatcagtaccctttgctacgtgtgggtatagatctttaggtgtggtctgcattaaaagagttaatacaggtggccgggcacagtggctcacacctgtaatcccagcactttgggaggccaaggcaggcagatcacctgaggtcaggagtttgagaccagcctgaccagcatggagaaaccctgcctctactaaaaatacaaaattagccgggcatggtggtgcatgcctgtaatcccagctactcaggaggctgaggcaggagaatcacttgaacctgggaggtggaggttgcggtgagcggagatcgcaccattgcaccattgcactccagcctgggcaacaaaagcgaaactccgtctcaagaaaagaaaaaaaaagagttaatacagttaaagcacttaaaacatagcccagcaaatgataagtactacaaagatgtatgtaggtatgttaggtggataaataggtagtagacagacatacacatatatatgtatgagttagctagtttaataaatccacattattgtgtccatctctctctggacttaatctcaagtatcgtaaaatatatgacctccttcttcctcattcaccctctaataatagaggattttagtcaaattactcacacaatcacagagaattggaccctattagaaaatttattttcaaattttacaaatatcaactttaaatcattacatatactgttcacattttgttttccaataaacacaagacaacatgcccatcagaattgggatggatgtctgtgtaattgacgaagtttgtattacagaggaagatcttaatgtatttagaattttgggtgctgactcttaaatagcaaagatcacttataaattgtcaaatttcccatgaatgcttagtgggcagatattttatgaagtttaaatgaacttttctttaagccacttgttttttcataatttatattttgtaggttgcatgttgtaattgtatgaaccatgtctttaacaggataataagaactccaatttacagaatccttaaattccaaagtcagttatattaaatataaaaatcttaatttaaaccagtcttctttttcaaatagaaaataatctaaattagcagatttcttcccctttataaagttattcttaagcatcataggtctaataatggaatacacaaagaacctaggtatggttttgttttttgaatgctggggctgaaagagacccaaaagataatccagttccattcctatattttacagatgaggtaactgaggacaatcataatccaggccttgccttcagatttgctagatttttttttaacatgctaaatttaaatatttctgttccctctcagctgctgtttaatttcccctgtctacctacctgacagaagccattgttcttgtggctagccatcagtaaagctgaggaaatttgccttaccttgttgaagtattggcaagcagactgtgagctccttgccagtgcttatcagcatgcttggcacacctgtgcaaggactcagtcaagtaacttgtccattgcagacattgaaagtctagaggtaatttccagacatcctcatgtggtgccatatttttaaatggcacaccccataaacttaaataatctaatttcttccatgcacactgtactccctaagggacagctattagatggccaggcctgttccaacccctggactttcatcactgtatggtgcagagcttttggtataaatgtgtaatcatatgactgagccaaaaaaagagagagtggtaatatatcaaaatttaaaaaaattttaatgagttataaatcttaatatagccatcttagccataaccacaaataaactcattttttctgttaaaatacttgacagagtccttgcaattgaatgtctttgttcaacaaaaactgtattaagtgttttaaatttaaaatctaatcttatgcaaatagctggtggtcaaaacctttttccatcaaaagaagatctttggtttgacttcatattctgggatgtttgtaggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggttgggcaacacctctcctgtctccagctcacagtgccttaaggggttgtttaggggagagaaatggaagtttcctacttgctacttttctagtttctgcctgggtcaagtattcccattaggaaccaccagttatgtgctcgttaatgaaaacattttttaaaacagactaaccttgcgtttaccccaccccaaatccttatgaaatgccaaatactttttacatgttatgtgtgtcagaaattcaagctcctctccataattaaaacattcatttttaatatcagggtggtacggagggttatgatagtttgctgttattttgaatgtagtagcttttgttacatttcctttttgcagggctaaacaattaatatcagacactggtctctaagctaagtttagtctccatcatttcaacatcttttttatttccagctctcttcttaaacgtcaggcgatgaaattacatgctttcagagaccacatttattctcacattctctcccctacaacccctctgtcttcctaatcaaaccagcattgttagggataaggccagagatcattttgttttggaaaaatagatgaaccaaacaagaaacagccttaaaaggcaatacattgtttatcagaggataccagtgtaatttttcttttccatgtactttcttttaaaatttaatgggaatttttttttctggcaaacggtttgtcctttgtatccagggttattttgtaaataactttgtgattaaagcataaaatatcactgatgaccatcataagcctccagcttctgcaaatgattatccctgctttggtgttagttctaagccttcttaggctgtgttataatagtggctctgaagcttccaatgtttcatttcagatgtctgatttaaggcttggctggctgtgatctaattaaggggaaccatctgccccacccatattcttcagattgtcttttcttgattcaaaatctgtaaataagctaagctagtgagtctcaaactttaccttgtattattagaatcacctgtaggccttcttaaaacccaagtttctggacccaaccttcaaagtttctgatttactcgatctgggatgggacctgagaatttgcatatctaacaagttcccttgtgttattgtagctgctggtcccaggaccacagttttggaccactcagctgggctgtattttccccacatcaattctttgtgcaggggtgattggggaatgggattgaagaggtgcagttcttcataggttcctctttatgacatacagggagattgagtcccatttcttctagttttatcaaatatatgttgttattcctagaaatggaattaatgctgtttgtttttaaaaggtaactgttacttctccatgcctatacttttttctaccctgcttttttatataaacctttttgtccccccatgtggatggcattattccatttgactaccttattacttttaataagaaaaccaaatacagctctctgttgggaattatctttcaaagtaaattgaaatgattttatgttttgttcataggaagtttactggatttcttaaaagatggagaaggaagagctctgaaattaccaaatcttgtggacatggcagcacaggtaggccctgcagggtaacttgatgtgccatagatttaatgacgtgtctaagtacattgggtcgtggtgtaacatgtcctgttccctgggtttccacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgggcacttgaatgacaatggctcgtgatcacagctgtgagaacagtcacttactgcacagcccttccttcctccttcccttcccttccttcagaaaatacttgaaatgtcattcttcagcttggtttggacaccttgatctggcaggaatttgacagctctgcaggtgggagactgttgtgggcccagtggagggatgagatattggtttttggtgggtgggtgggtattggtatttgctgctgtggtcctcttggctcatgctggtctcctcacagcgtccaggcctagaatactctgtttttggagaaagagaccacatttattctcacattctcacatgcctgtgttttttacaaaggcacaggcagggtttcagaaagccaacagggcatggtgcagtgtctcagagcttgtaacagcaacagaactaaggcctcaaaggtaagggggcagagaagtgggcacaagaagtcagaatgggccactgcacagagagggcctcctcagtaaagagagacgtcagggatggatctggggattcacacccaaccccactctagcccacttctgggtcttctgccagacccaaccagaagtagaggtcacaggagctcagcgatgaatccttatgggtccagagcagggagagggagagtggagagtggacttacactacagatggtaacagcatagttactcgaaaatctctacctcctttcatcatccccgccatcccaccctctgcaaaaatttatagaaattagcctttaagtaaaatatatcccaactcagcagccattccagtggggcagcttttcaggtgctattagagcaccagatactagaaaggagtttttaggaatattttccttcttcccagatactgacaaagtggtcaccaggtaaaagtgtgtgattaagtatgtggtttgcaatcgagtataggctcctcatgtagaatataatgtttatagctggggcaagggggaactttcattgttggtgtttctaaccaaagcctagtcatcccaagcaaagcggagcagtgactggaatgtattacagggtgatgctttctactgcatttcataatggccagctctggagtccttttctttctctttttccttctccttctcttgcccctgttcctcctcctcttgattctttcatttcatgccaattatcctctcccttcatttgatctgagaatggaagcattcttagcagcctcaagtgatgaggaaaaatgttaaactaagaccctggctgctaccgatactgtccaaatgctgaattacatgtcggtcagacagctcagctatttgaatttccccaacacgtggcagttcttgtcctggagccaaatgcccacacagcaagcatacccgtgcgttacacacacacatacacccccggtgctgggccagatggcatgctgtatctctaatcaaaggcgcactgcagctttgattggcactggccgtccagagaggaatgtgcatgtgaatttgaggcaaggtgagccgagaggacctgagtgccagtggatctgagacttgccctgaatgagggactttatcctgaggcaagtctgtcagatcccagctcctcagactcagaaggagagtgggcaaaggttgtgagacatgaatatttgattaaggaaagggctagaatagagccgtgtgctcacccttctgtgtgtgagtcgagtttttccccttttcctggactttgaactctacagggtttgtggttaacgctcatgaaccatgggtaaatgaaaaggttgccaggccaggagccagaggatgctggcaggggtgctgttaatagggcctgggggtttagtccacgccttattcactggagtgaggctcctcaggctgtggccctaggtgattggcaccctcgctggttcccctcccatcaggctgctgccctgagcgggtcccaggctgctgccctcagcctggcccccagccgttcctctgcattagctgtcctgattgcccttctgccggctgcccagctgcaccatcatgtccccaggtgccgtcagagcccctttcaaaaggccaaccttgttcttttagcctttgtactgcgtttccttacttaatttccaaatcgagggtcccgtccttccttcttcaaacatttttcttctttcctccctttcccaaacaccttcaaatccatgccaaacactagaaagagagaagtaagaagtaagtgaactggagagctgaactgggggggggggaaatgaagcttggcaaggcaggtcccaggatgtcccaggagaataaaagacatgctgtcctgcagcagaggggtagggagtggcagagccatttataaaacaccttccaagtgccaggcctgagaggaaacgtgaggaccaagcagggaaacaataggaatagactcagaggggttaagtaacttgtacaaagtcacacagctaggaaaatagcagagccaggatttgaatccagaaatggctgaccctgttgcatctaccattctaagctatgctgaccacatctcatcaagtcagtgatcaaaagaacagaaaataaagatagagaggattagtcatacatcccttttcccctttattttatgggactgtttttaaggagcaccttctagtgtgtctgtatgagggagttggagagaccttccttttccagcactgggacaacccagctgtttataaaattcctcccgagggcctgccctgccctggctgctttacgaggcagaaagggcctggtgtgtgtctgctggtgtactctgcagatggcatgtgtgctgtgtgctgaagtttctgctgggaattaatcagctcctccagacagctggtccgcatgcctaataatatttgcaagtcgggttttatgttacccacaggccacagccatgctgcatcttgattatgggaatgcaggcggcattcggaaacatgcaccaaacacagatattttaggaccatgaatgacaattgttttcaaaacagttgtgagtttcccatctcagcgtgcacggaaatatctgtcaccccttgggcagatgaggtggcattgcatagggcacaagcagaattggagtgtggagctgggttccacagtccttcctgtgctccttacttcgcaccatcccagctacccaggactgagcagcagcccatgtcagggaggtggtcaaggccaggccctgagcctgtgaggtggtcttccactgacagcactctagaagcaactagaaatttggggcgattgcttattctctattccctggacatctcactcaattacagcagatagttcgtctttagttacaaacactttgctaaattctgcccaatcagagtctctaaataatgccaacatcagttatttgagtgccttatctatgaaaggactttactaggagctactgatatcaagaagcctaagactgcacgacagtcagcaagcatgaggaggaagacgtgggggattgttgaagtcagatggaactggttttgaaatccagcgctaccacctgatgttctggggtcttaggcaagttatttaacttttgcctacctcagtttacttatctgtaaaatggaaagacattttgtctgctgtatgcatttttgcaaagattaagtgaaacaatgcatgtaaagtgtttaacagggtacccagcacatagtgataaatgttgcttgttactgttggtatatctggtacaatactaagttcttggggaataaacaaatgagtgaatggattgtagatacatggaaagtctcaaacactattcaggaaagggagagaagaatcaaagataattcccaagtagtcagatgcaggtgattgtgagaatggcattaccaataacagaaatgagtacttgggaagatcttactttcagagaaagaggatgcatttgggtttggatctgttgagcttgaggtggtggtcttggtcctccaagcccagaaagatgagtcggggtgccctcactgggtctcactgccacagctgggccctcagccttccagccctcccctgagttctggtcacagccacctccctaccccaccactgcaccttcttcccagaatcattccagaactcaccacaggcaccacaaggatctgctgtccatcttcttgtccataccacacctgtctcctgtgacccccgacataggcaatgtcacaagccttgcttctggaaattcacagcccctccagccctcacttccttcagagattgcacaagcaggagagaagcagtgggaaaatcctctgcagactctagttttttcttcatgagctttcagtgccgactaatgttgatttaaacctaacaagttcagacagacatggctgtgtgtaagcataacttccttttgtggatacctttttgttctttatgagctataacacacatacagtaaaacgaacaaatctgaagtgtgcagcccgatgaatttttatgtacatatatgcccctgaatccaccccgaagataaagatacagaatacctccagcactccagaagaccccttattcccactcccagtcagtaaccacccccacaaatagccttttttccccttttcaccatagattggtaagttttgcctgtaaatgaacatcacagacatgaatcctatagtattactcttgtgtctggcttctttcccattatgtctgtgagattcttccatattgctgcatggaacagtagttcttttcatggctgagtagtattccactgtacaaatatatcacagagcctccattctactgttcctgaacatttggggttatttccaaattggggccattataaatacggctgctgtggtgatacacacatgccctcatctctctgggctgtgttctccagtggaattggtaattacagggcaaacctaggttagcaattgcagttactgcctaacagattttgtggacatatttttaaaaaggtgaatacacacttagtgtgtcatttgccagtactgtacttgcctctaagctgctagtgaggcagcctagtgagactgaggaaccaggggttggacattaggatccctggctttgaatcagctctgtcacttacaagcttggtgtccgcaggccagttacttaagctctttgagcctcatttttatcatctgtaaaatggtgataataaaaatgatcacctcacatcattagtgtgaaacttacatgggctatctataaaagttctttgagagttgtgaaatgtaaaaatcatccttatcacctcaactttttgtatttgacatacattttccttgaaaacagtctaaaaagtttttaaagagaatcactattagtaataaatagggaaaaaatcaatctttcaagaaaaaaaatactgtctccctattttatagcctaggccagtcagtggatctgggcagtcaccactttgatatacctgcatgctccaagggccccctcaccccggacacagcggggagtcacacatccactgtcctcatctccggccagcttgcctattttctcatatttgcattctctgttgagaactatccctgcctctgcgctgcctctcttgtttttaatcttgtgaagtctgaatatcagatgggccttctcagcattttcactgaggcatgtgcatacacacatcaacatgagcacacatgagcacacacacgctgcatgagcacacacacgctgcgtgggcacggctggagcagttctcccgagtatctgtggagtcggtcttactgcttctctatagaagtgatttagtttaaagactagcagcgggcccttgtagacacagagcacatagtagtatttaataaatatttgtttacagcaatggaaataaccaaggtcaccaacccccccacactcttgtgagacatgctctcctgctgtctctcatcaatgtgcatggctctctctgggaatcaaatgctgttgtggctgcaggaacctccagaaagggttgtttattgcattgatattccttgcacactccaagattgtctttggagtgatgggaagcacaagagctttggagctagataagcctgtgttcacatcctgacgccgtattcctagagcataagttctggcccctctgagcctcacctttctcatcataaaataggattggtgttggttacctttaaggtggttgtaagaattcaagaagacaattagtagaagttgttggtattattcacttcttccagctcctccccacaacactttggagtttttttgttctgttttattttggtttgttttttgttttttgggttttttttggatagcttgacctcttttcttcttcccacatacacctcagtcccctcccaaagagggcagggcctggactggttaagagcatgacccatgagatcaaagtgtcttggtataaatcctagcattgctgccaattcactgtgagaccttgaacaagttgcttaacctgtctgagcttttatttcttcctcttaaaatagggataataatagttatctatatcatagaattgtatggcttccctgtgaataaccataaagcagttggcacaaagccaacactgagctgatagtggtagttggcagtagtagtaatagtaatattattataatattgatccaatggatgccaatagctgtgtttctctctctctctctctctgacacacacatacacacacacacacacacacacacacccacccaccccactttgggttttcctgatcgctcccatcagggctccttccacatggaggctctgcctctatcatcctttctcctgatttgaatcctcatgaaggacaggaactggggttgctctatggttttggttggtttgttttttaagttcaaaattaatgaaacaaatgtcaaggaaacataatctttggatctttggactgtaaataaaaataggaacattcgggtctttgtataagactgctgtaagtttaggcttatgtattaaatagaagaagaaaaatgtgtctgttcaaatgctcccagtattgagggtttaaattgaatagattattgtctggaggaaaattcaagtataaattagactacgaagaattactaactgttgcagttttcatgttaattatttcatgttaaaaaattgttaccgcataaattaacacattctttcatagaaaacatattttagaaagatttgttactttaataactctttgtgtattagaaatcccagatgcctgtactaattaaatataatcagattttagattcaaaaagcacagtagccatttaacacaaacaagcaggcagctaggttgacaaacacactcaggaagaagtggatccctgtttctttcgaattttgaatttcacaatccagaactgtgaattcaattcctgtccttcctttgtattacaacgactggggattattagactcagagcgccagctttccagctcaagggctcctgcagaattattaatcagccgcttctgaggcccctgtaatccggtggcagatcaaggctgatctcgccgtgagatgccctccctctgcccccgtcagcacatgaatttcttgttctctgtcaacaacagcattgccattcccgcacagtgtgctgtgacctgaacagcaaatatcaggagagagaaaaggaagaaaaaaaaaacctttttaattactgaatttaatctaattcttcccatgctagagaagcaaaccatcctttcatgaaaagcaaaccctttaaaatgcaagccattgtcttaagcaccgactagtgtgttcccaactcagtggtgccgccataaaatgaccatgccaacccccacctccccagcccacattgagagtctatcatcctgagggctgtctagggagagaccccaggggacttgcccgacagaatgccctgccctccgaggtcagacacggctttcccgctgagctgagtcgcatgcctgaaccgtgctgcttgtaatcaagcttcccggatccgagtttggtacacttcagtcactaagcagaaaagctccttcatttgtattctgtcgcttcaagctctgagcttccacctcgtttctgggagggacggctttgtttatctgctgagccaccgtggagcttcggggcccagattaatagttagggggagcaggtcaaattggcagggaaatggagatgaattgtagagcgcatccattttcctcccggaaagggtgtgttgaaagccaaagatgaaaattaaaagaaaagggactctaaatcaccctttcctactacagtctctctttaaagattaaaactgtttcaggtcggagatgggaccaatttctttcattcccaccctcgggcagctctgactctgcccagaggatacaaatggattggaggtaagcagtggtcacctcaagcccagcttctttgcacacctttcccctttatctgtgctggtcagtcccattttgtattctgtgtgagcatctctttctcctttgtgctgttttgggcagagccttttgatggttgtttatgaatggtcaagagcaagtcctcagtctgtgcagcccacgtttcttggtaatcatcaagaaggaagcagatggtcaccctctgtgattttaaagtgtgtaaataggaactgtagactgccatcaaacatcaaaaatgtcagttggcttccttgtcttgctttgctggcaaaaggaactcctgcatttgcatcatctgggtaatcatggacacgcagtacatttgtaaactgccccaagttctgaagcctcatttcttacagccaaaggagggggctcagtggcattgctctgccatccccagggtggctcccccattggcacagacactgtaccagattgaaaaggggagcggtttgaaaaagccaccccaaagtgatgtttgtcttctgtatatcctattatcctttgatatgttctgagctcccagtcaaaccccgtgacctccaactgttcccacacagtatccccaaacccagtgctgcccatgcagcccagctcgtcatgtggcatgaagtcagactgacacgggccctctgccccttctgggggtggctggattcttggcatcatttctgtgttgagctacatcccacacatccgttgatcactcaggtgagttcctctcaccaccctgggcagcagtgtgcagttggttacaaagctcttgtcttttgttctggattgaaagtccgcaaacatagcgtttatgctgttgaagctgtgaatcagaatttttattctgtttgttttgttttgttttgttttctctttacagaggtaatcaagttacagaatttttattctgatattacttcctttctggctcttcggaaactggaaggataattggaattattcagagcctcagtattctagaacagcaagcagggctccttttttcttcagtcccacccaagataaccacttaaataagcctccataacacagtctgtactccaaggaaagtcccttcgatggttctcagatttccttcttaaaaggactaaatacccacagtttcaggagatgcccattaatgttatcctctacttttgtgttgcccccataagttaccctgggtttgtcattggtcaccgttgcaaggagggtgatggagaaaggcaagcagcccagagtttcctcccttcacttcctggctcctctagggatatttggaaggaatgtcacagtttaccttctggtagcctccatgtctggatcgaatgcccttccacaatttatcctgcctatccttccccgactgcaaaaccccaggattaatacctagagtccagccttgcccctgcattctccctggtagctgagcctactcccctgtgtcctctagttgtcctgggttcaatttttaatacccactgatggaccttctgtctcttctctgtccagtcttgaactctgggctctcttggaactttcctcacccctctcagcctgaatattccttccatggattccactcaaccagactttggatctgtgcctacttaatcaaccttatctttgcaatatgttcgggcccaccttccactccttggttcttgtcctccttggcctaacttgtcccttctccactcacatccccggtgggacagcattcctccttcctcccaacctccctccttctcaaacttcttgctcaacattatgaaatttcagatggaatataatcttaacccattgtaacatatacttttcaaaaaaacatgatgctaaaactttatgaacttgaagtagaagtttcaacagagtgcgtcaccggggataactggaaaacacccagttgtattacttcagaagcatttgggaaatctgaaagtcattcctttggcctagtgtgaaaattctgagttttgctttgccaagtttcattgggtttgaaatcattgttttgtttaaataaccacaaagttccaggtcaggtcagctttgattttgcttctttcacaggatatcctgtcctggtaccgccttgtcacctccccctcctgtaaaccaaatttctgttattggcattgtttgtgattttttttttttgttttattacccagagtaactttcaagttgaattattgcatactattaaatattggatataataatttgcagagttagtggctttataattaaaaagggctctgggtggctctttggttcagaaaaacagtgtctattgttgaagttaatgggtttcctccttgaaaatgctattagggcacagctcagattctctgtaggaaggatttggcttcttttattcaatactgacttcaccttctccaccttggcctagttttttagccagaggggatattctctgagactatggaattggcctggtcaccaagaaaaataaaaaagagagagacttggcagttcagctctccggagatgtgagctgggcccacccaggcctgtcctggcccctgccgtgaccctccccaccgcaaggagagccatgggtcatgctgcatcattccaatgcggctgcctctccctgaagccctcatctcctgcttatgttctcttttcctgtctctgctgagccctcttcttcctaaaggcagtgccaccatttagttctctgttgggtttgcccgtgaagtctgtctccctggctgcctagaaaccccaagggcggaggcaacctgtgcttggttttcccaggagcgcctcacagggtgctggggacatcatggaccctcagaagattctcagtgattggttgatgagtgttttgattaggagggttttttcatcttcttttcctcttctgatgtttggagagctttggcattgctgatggcatttgccagtgcaactcagggactttaggcctttactatctgaataaaataacagctggtatttattcagctattaccaggtaccagacgctgtgctgagccttttacatcaactgttcttcccaccacaaccttaggaggttatcatccccagtttacagacaaggaaactgagacttagggatgttttaaatgatcaaccagcaaatccagtgtgcaagcacagggatacctgactcggaagctcctttcctaaatgatcatagtggtccttccacaagtgaccactcaatcccagctcagcccacaatcggaccactttgcattgtcactgaagagcatccactcctcgtttcctggccggcttatgtactcttactgcaggaggtgatttggcagcaaaagtatctgcagtcttcattggagcatttgaaatgcccatgccatcatcttaatgtatgaaaacacataaagaacaggaagtaactgagtcaagtaagctatttctatttgaggcagaagtgaaaaacagattacctggccactagggatagagggacttcattaactggaatgtggcctggggcttgggatgggccatcctgacatgatgactttgggcagtcatcctgttggcactgaaaaaccgagagcatcagtcaggctgtgctgtcgtatgaaaggaagattttattcctataacttttaagagtgaagaaaattattagtttattacaccactgtattgacactctttgcgtttagtttgattaagtctgtgtaaaggaagagaattactttgaccgtcagggtgtcagataacttactgcctggctggaccctttagctagttagagcatttattgctgtttaaccagccttaggcaagttgctatgaagaaatatgtgtctccaacctcaaaggatttgcattctatttaaggagattttttaaataacttatgaaagaactagtaaaaggacacagaggagacatggacacagtggaacagtgtatagtgtttatgcagtcaggctctggcaccttcggttcaaatcccagttctgtcatctacacttgtcctttgtttggcacattgctttcctctcggtgttccgttttctcatctgtagaacaagactattgctggcatccacctcatgtgcccagtgctttgcatgcctgactcttagcaagcgctcagtgtatgtttagctattgtggtagctgctattatcaagcattaaactgttgtttctagcactggcgctaggtgcattggagagattagtgaaggctggagtaatcacagatggcttcatgaaggaggtgggactggagctgaggaggctgtagctaagcaggtgaagagaaagagagcatttccaaagccaatgtaaaagaaacaagtgtgagcatgctaagtgcaggacacaggttatagtaaagcaaactgaactagattaactgtgtttggggtagcaagaaccaagttaggtcaggcacggtggctcacatctgtagtcccagcactttgggagaccaaggcaggaggaccacttgagcccaggaattcgagactagcctgggcaacatagcaagatcccatctctacaaaacataaaattaaactaggtgcagtggctcatgcctgtaattgcagcactttgggaggccgaggtgggtggatcacctgaggtcaggagttcaagagcagcctgaccaatatggtgaaacaccgcctctactaaaaatacaaaaattagccaggcatggtggcgtgcaccaatagtcccagctactcaggaggctgagacaggagaattgcttgtacccatgaggtggaggttgcagtaagtcaagattgcaccactgcactccagcctgggcaacagagtgagactgtctcaaaaaaaaaaaaaaattaaattaaattaaacattagccaggcatggtggtgcacatctagcatcctagctactcaggagaggcaggaaacttgcttgagtaagcccaagcaagaagaagagcccacaggggagacacacaaaatgcttggaaagaaaggaaggacatggggaagaataaactcagaaaaataattcatgcatttctcatagaaatgtttgagctttgcgggttggaatatgctaagttttactgctttgttaccgaaattattggtattattcacatgtgagaagtgtgctaaaatagtacaaatgtacccagagccactcgttaagtaaacatgacagaagtgacaatggaagcatcatctacccaattgctaattgctgatagacacccatgggccttgaaatgtcacgatgcttttgaagagttttgaaaagtcaaaacacttttcccattctgtctcatcataagtcattctcaaggtaatgatgtgttatcttccatgttttaaaagacaaggggaaagaacgacgtgggaagtcatcgcacttctgctcacagcccagtgactttctgttgcgcttaggatggaatccaaaatcctagtacaggttacagagtcccacaaaatctgtccttgtaccccatcttattattcttcatagcactttattgtagttgacatatataatagccattcatttattttatctccctcaaactaagcttccagctccatgactgccagagactgtgttccctttcgtcctcctggcaccgagtgcagtgccaggcactggggaatactccagaaatacttgtggtaggaagaaagaacaagccagcccagcagtggtgggtgtttgtgttgttatttctgtggacaaactttgataactgaataaatccacagccctctcctttctcttgcttgaagcatggatgattattaactttattttaaatgaggaagaccagggcttggtgaggtcaaaatggttgatgtctagtcacttgcattcatcccagtctattaagaatttattcttaatccagtctattaaggattttccactttgtttcactgtgaactctcccaaggccccttgccacctcgtctttctgctgttgtaactaaccacccccatccccagctgcagccccagtgaactgggcccccttgtcctcagagaacaaagtatggggctcccccactcagatacattcactccgacccaaaggggatctgaacacacttcctttggcagtgaaaatgcagggttctccaggtgttttaagtttcattagtgtgtggctgttgcttttctatttcaattggcaattcttagactcttaaaaggacatccagacagtgacactggtgctgtcaccaaggacaagtagaagactcaccagagggcagggaactgataatacgctctgtaaggaactgtggttattcagccaaaaagggaagggctgggagggctgaccagctactcattcattcattcagcacctgtttatcaagtgctttctctgcagcagacactgtactcagtactggagatgtggccatctgggaagacatgctccagcactcaagcacagtatttatctggggcagagacagccttcagacaattcatgcattcattgccctttaataataacagcttcgttaggcaatatttactgaaaaaaagtagtgacaactacaaagagggaggtgctctggcagcatagaagtaggaaacctaccgcagtctttagtgatcaggcaaaggttccctgtgcaagtaacactttggctaggagcaaaagagaagtaagaattagccatgggttaagggcttttgataaaggaaatagcctgtccgtgaagcaggtaggagcttggcatttgcaaagcagtcaaagaagggcaatggagaggttgcagaggagagaggagggaagcagaggagaacaagtctgggatgataagaagcagctggggaagtaggtagggaccagattatgcatgtagattctattagaaggctactatagaaacccagggggggacatgctgagcaagcgaggactagaggaagggtagtgaattcaagatcatgaaatggtcaggatgtaatggacctgacacgggcagggacaaagcaggagagcacagagatcattcagtaaagatgtattgacctccttcaataggcaggccctgtgctgggatctgagtgcacagtgatgaaaaatagagtgtccaggtgaggatgattctcaggattctgttgtcaccaactgggtggtttacaaagtcaccaaggattgagaagccaaattgtggggaagataaattttggatgttgcatttgaggggcactgacttgtataaccaatttcatggagagacaattgagagggaaattggttatgcaagtcagggactcgagagagaggtcccatctggtgatataaatgcaggcatcattggggtcaagatagtcattggagccatgggattgaataagatccctgatattacacagagtttgtgaccacttatttcatatctcaacagaattcagagaaacaggattgagctgtatatcagaaattatttaaaacatcgacacatttattcattacaggaataattcagcctaaggctaactggtcttatatatgttcctgggagttaaatgactaaggcacaaagatcctcttacatggaagttctaggacatgggtaccagtgacaacaccaggttgtcaagttttcacaatgacaagtcgaggtttcggcaatgagtttaccttgggagtttggtaaaatttgcaaatagtacctggaaaacattcagtggaaaagatgcttccaagtacacacaccacacacacacacacacacacacacacacacacacacacacatattatggccttcgtgtattggcttatcctaaagaatcctaaactgttaagctaattcagtaagaaatgacagagtggtcacttctttttttgaattcatgtaaacatggaacaagtacagtaagtgttacagtgaagctcaagatatcagtgacatagatgatcattacctgcatagtttgctctgtttcctctaaataaaatgcaaggaggagaaaactgttttcatatctaaatcctgctcccaagcagaagaatttcaaagtgtgaatcagctagttacataacaattccaagttaactgcattgcggttctcctgatgttttctccgttgttctgtaagtccatactacttagaagaccactttgattctgactttttgcctgtcagaactttactttcaagggaaaggcaacgtttacacccaggagatccttccttcaaggtgtctgaagtctcctaacttacagagctcactgcagcagccctgcagcagggacatctgtgggattgtataggttatgtactacacaaccttagggatgctgttttcatagactgggattttacactgtgcaacctgcaaggctagttttaaagacacctgccaaaaatccccagttaactccaccacatttagagctgcattttagggccaatagctttgtaccctcaggaggtgggaagccaagataaggggaaacagaagtaatgagatgtgtccaagaggaagcagggattagctcttttcagtagaaacctcagttaatcattaataccttattgctgctttgatttaaccttttgtcttccttgaaaaggaaaatgagttatctataaagaagcttcttttgttgaaagcagctgctgttttaagacagagaagaagcaggagaagttggacaaagacattatgttttattcctccaaatacattataaatacattgtttggtgtaaatatattgcttgccttagaaagaaaattaatacaaaacaaatttaagtaagttccgactagtagtaactcagaccacatatctacaaatgacttcctttcaaagattccttacattaatgcagcctttgttttaacattttttgaaggtttatatattataatccttattgtagattataaaatgagaaaataataaagctgactaatgcaactggctgatattgccgttggttttttttaatctgaaattatgaaatcccttggaaaatctaacatgacagtatccaaattttaaatagtcactttcagcaacacacacaccttcaccaatgttgagtgattcaaagaaggggaaaaacaactcctttggttgtcattttatttacaggatttgtctgcacagcagagaaaaatgttccatttacttcagagatggtcagagatttccaagccatttggctcaagagatggtttaaataggaatgaatgtagtatacctttaattctctgaagtaagagaactccagctgaggtttggtccagagcaaagtctgctctcaacattgaagaaaatctatcacattaatcccagtggctcagagtccaaagctgcgtgaacagaatgctaaaggataggaagtgtgagaagaatgctttgaaagaaaccttaaaaacaaaacaactgactattcagagaataccaggtcttatgtggaatcatctagcacgtaaggaaagatataaataattatgcctgagaaacataactaattaaaaataactccatgcataaaaggaaaactatagaataacttttctgctccagtgttaatgtgagatgcctcataatgaaatagtaggatttttttctttcatttcatttcacacagacacatgagagatggagaggaaaattatattgcctgaaaatgccagggtagatttactaaagatgttatcatatgctgtatttaagacaaaaatctaattgctgtaatttatcatacctctggctattaaaactgtgccaatttaaatattttaatcattcgccacttttgtacatagtgactttttatagaagattctatgaaatgttctgattttgtcagcctttgtatgattttcaggagctccttaagcagaatgaacatgctttaagcatgtaactgtgtttccataagtaataaaaattccttgtgtttttcttttagtttgttcagtaaaatacctggaactgctttataattgctgagctgaatgtttgagagcacaagctgctgaatcccttttattttattttattttatttatttatttatttatttatttttattttatttcatttttttctgagacggactcttgctctgtcacctaggctggagtataatggcacgatctcggctcactgcaacctctgcctcctgggttcaagtgattctcccgcctcagcctcccaagtagctgggactacaggctcgtgccaccatgcctggctaatttttgtatttttagtagagacgaggtttcaccctgttggccaggctggtcttgaactcctgacctcaaatgaccgcccgcctctgccttgtaaggtgctgggattacaggtgtgagccaccacacccggcctgaatcccttttaattccctgcacacacatcaagcttgtagaaagcaaggtggaccacacccttccttttggtttagagacaggattctttcaatgatcaaataaatttttgaaaaaaaggactccactgactttgacatgaatttgcaccttggtcttgaaaagtcagagactcataagacagtcatggaggcagaactgctctttaaaaaacaaacattaaatagtactcttgctgggtggtagaagaaaaagtggtaagaaagtgatcttacagtatggaagaaaaaactatcccaggagtaaagatggctactacagggagaaagaatggaggaaaaacagcaaatgtggagagagaaggagctggaggcagattcctttccctgctgtgggtgtgggaggcctttgggaaatctaacacatttcagcagaacacatgggcagtatccagttgtccccaccctgggagcagctcagtggtttaatcaggttttgtgtacccagtgagaccacactatcttatatacccgaggactcatgagagcagcattatgactaaatcctatgtatgtttattaaaacatagcattatttcaaagttaaatatatatataattttcctaaatcataagaaaccagggcttcttcccccctttattgaggtactaaggtgctttgagctggattacttacggtcacacagtcaagaccagaccctacatcttcccaatcccagcccattcctgcttcacctcctttctgtcttcccctctaaacctgctctcaggaaagtagcttgccaagtgcctttccctcccacaccccatgcccattgcagtgccctctgcctgatgaataaccaagtgttcattctgcaggtgcaaagttccccatcaagtggacggcccccgaggcagccctgtacgggaggttcacaatcaagtctgacgtgtggtcttttggaatcttactcacagagctggtcaccaaaggaagagtgccatacccaggtaagagcagggcctcacagacatgggcctgagattggaggcttttttgacaccatttgggaaaacttcatccactttgctttctaagccccatcctcagctttctgctgagcttgagtttgaagaacatggccaggtattcagcgagagaaaagcagaactgggagccaccatgtatgtagacaagcagccaccatgaactgtgtgccaggattaatgtaagtagcagctggtctaaatgcttcagtccccctccagttcatagaatctctcctctctcagtaggagtatgtgtctgtggttcccagagcagaaatgtcactggcagtgcctctgcccaaatggagtttgcagacatgtctgggaaagagaaggagaaaagccccactgctttttgattacactgtagcactgacccatggagtgagcctggcaggaaggtgccaggacctgttctctccacaggacccagctccagatggccaaagagagcagaggcacatgtgaaatgcaatttagagccactcactgcctgttgctgaacagtcaaaacatgctataccaaagcaagtataatgtaaagaaattggaaattcttagactctggaatgtttctgtattatcagatttatgctctccaaagaaaccacgagtttggcttatccatgcttaaattgattaacgtcgacagatggtgacataaaggacacccatgccatttcacctccacgctttagtggttatagcacagggacgatctgcttttttgaaatgttaaggacatatttttcagttactgctgagtgaagaaagaacatagctccccctcattccctgcgtaagaaaggagcttaaagaaaaaaaaaaaaaaaaaaacaatgatagaaacgatagtgacgattaatgaggaatttaggtctcttgcaaatcctgggtttgtaatcatagctttgcagtcagaggagctagcgaaggcagattaatttgtaatccctttgttccttttttatgattgtttctggtcatcttcagagaacacagagaggggcacatcaagataatctcgttctgggttggtgtagccttgagactcctaggagagccaagttgacatggaggcaaaattgacaaattcccagtctctgaagtgccggcactgggcgtttagagatgcgggtgtaagtcagttttattgatgctgcggtgactgctgctcccggcatgcacacacgggcagacactccgggaatcgccaaccagcacagaagaaagggccgccctgggggatggagcacagcgtgggtgtttctgaattgcttctcaaggggggaaatgtgcgggtctcaggagggcgaggatgtgaaggcatctcttctttatttattgtctgaattttgaactgatttcttcctgatccctcccaggtttatagtcaccctgtgtgttaaatgcaactggggagaaaaggttaatgttgttttgcgtttctgtgaagccttcccttccagtaatacaaagcagctttttgtttctcagggtctcacacagaaaccaagacaaaggggtggaggtgggggccttggagaaggaaggcaggtgcgtgtttctgagggagtcttttgtcaggtttggttttagcataaagaaaatgccctcattttaccacttagaccaggattcattcattcagcgtagcttcagtcactgtgaactgtgccaggcattttcctctatcggggagatagtgcaaataagaccctcatactctaaacaagccttgattagtacctgcctcaggctaggcattgttagcacagtgggcaagtaaataaatttagtccctatgttcatggatattacagtcagatagataaaatgtgcatcaaatccaggaagaaaccagccttctttattccttgtttattatcagagggagtcatcctgaaaggatggactacttggctttacctactatggggcctagatcttcattctgataatggggtcagggacacctgatccaggtatccacacacagcaggtcctgagagggactcttcaagctgagtcctgtgaggatggcagaggagtttgaagtgagaactaactccagcggctcctgcagagagagctgtgagcaagtgctggtctgcagtgggctgtgataactgcctctagctgtggaggagtgctggagagggggctgtgtagggaaggcaagtaagccagaccttggaagccaagtaggtttcctcaagcccagaaggcgggaagagcatcccaaggtctggcacgtgggaaggcacataggcctgggaggacagttccagggaccacaggatgaatctgagaagatgccatgtgcaggggcacacctggagatgtgactggaagggtggccgagagcctgcgttggggccttgctggttggcagtggcaaccagggaaccgtgtcctcattgggggtgtcgtgagctggtcctcattcaaagaaagccacaaaaaattgttcccaggcctgttcctagccatgggttcttcctgggttttgctttttaacatagctataatcctatttaattgggtttgtgaatccaacagaaaactcttcttgagggagaagcttttacagagggattccaattataggattattaccctaacgaaggataataattcctaaggaacaagaggtttcacgaagcttccttcagatgtcactgtgaaggcaaagaaggaccttcctctctgcattcttgctatttgttggtgtggcaagtcagtcagtgtgcgctgaggggtccttctcagcttcccacgttgcgtctttgtgcctgttgctggtacctcaggacagactcccagtcccggtccgtcatgatttccattctgcattttgatgtagtcatgtctcatgtctcagttggctagagtatattttgaagtaattcttttttggagaacagtagatggtggtacatttttctgagtcttccatacctgagaatagcctgctgtttccttgacacataagaaagctcctttgcctggtaggtgaagatggaggtgcgggaggagggggtgacatataaattggttttataaaagctttccaggcatctttgcccagcgtgaaagaaggtccagaagtgacaatcccagaaggaacttagagtggagtatgtgaggtgtgaccaaataaagggcaaagggaggcggagatgttagaacattggcaagttgtgtgagaggagtggacaaaagaagggaagacgacaatctcaaactgaatgataacctggaagccgaaggaaaaaatactgaaatatgatgctgagattaacgggggtggtagagaaaagttacatcaccttaccagatgaggaaggttgctttcgagatgtgtaacaagtatggatgcagttccaaagaagagctccatcagttccccgctagcagcctgagctgaacgcattctctgcattgcagtctagcttgcttttctgcaagcaagagttcagaagctttctttacttcaagattagaactgatttcatactgatggattgttgtatgtgagaaataaaaagacttaagtaaaagcagttttctggggttgatgcataaaatcagttatgcatttttacctgtcatttcaccttaatacctttctcaaatccttcttttcccctctgcttccagtttctccccgcctccccaccacccacccacccaccattctatcattgttgccaacagagttagtattctagaaaacacagacctggttatctcaccctgctagttaaaaacgtccacggcttccctttgcctttcagataaatcctagaaaacgtaattctacatagttcttcataactctttttctgtagtcattccacaaatatttattgtgcacctactatatgccaggtactgttgcaagcaccaagaatacagcagtgaagcaatagacaaatgctgctgccctcatagacttccattcttctttgaggagacaaacaataaacaaagataaataagcaaaatatattgaatgtttgctgctggtaacagctagggagaaaaataaaacagggaaggggagagaggggagagtggcaaaggagcacctcactggtgagtagaagacctaaaggaagcaagaatccagccaggtgggtatctgggagcacagccttccatcaggggaagggagagtgcagagaccctccagaatcaaaggaggccagcatggctggagcagagggagcaggaggtcccagaggccccaggggcaaatcagataaggcctttctagctcatggttgaaacttttgcttttagtcttagtgaggtgggaagtgaggggatttgagcaggagagtgacatgatttctctcttgctgtcttccatccttcacacgttaccaagacacatcaagagatgtctcttgaacatgcaggtctctctttgtggctcccctgtctgcctcagaacccttcaaagcccaactgaacatcatctgctttggaaagccttccccatgtccagaccaaatggggtgctccttctgcttgcctccatgacacctagcatatttctgttgggccccccgtttgtgtgtatttctcagcagcttcagagaagggagtccctttgatggattcccgaggtccagcacagggtccaccccatagtagactgtcagtaagtataagcaaataaatgagtgaatgaaacagaaaaaaaagaactcacctatgaggtttttgaaacaaggtttttaaatttagcccatagcctgcaaagccttttaactgcattccatcatcttcacacatggatatatattttcctagccacaaggtagcctctgtcctcaaagttcttctggaaaattgaccctgtgatcatttcaaacatcatgttccaacactattctaggcagagtgtcctggctattctgtgccctggctcttaaccgaacacctgttttgtggatttggcaggacctggtagaacaggaacactttcttttttttttttttttttttttgagatggatggaatcttgctctgtcagccagacgggaatgcagtggcatgatctcggttcactgcaacctctgcctcctgggttcaagcgattctcctgcctcagcctcccaagaagctgggattacaggcacccgccaccacgcccggctaatttttgcatttttagtagagccagggtttcgccatgttggccaggctggtctcaaactcctgacctcaggtgatccactctccttggcctcccaaagtgctgggattacaggtgtgagccactgcaccaggccaggaacactttcttaagcaaaccacacttattcattcattggaagcactttcaaatcattcaacaggtgactttcttgaatacatctagtcgcttgataatgacctgaagaaataagggaaattaatgaaactggtggctttttccttaaaggattccaaatgccactctggtcctccctctgccttagagccctgaaccgtagatacattttcctttgtgttcaacataacaacaggagcaggtttttcatgggagaagaaagggttaggactctccaaccaggaggagactgggaagccgaatgaaagctctcatcttagccgagggtgcgtgtctctccctggctcgtccacagtccctggggtttttcctgcagctcatgatgtcccctcagagagggaaccctgcctggaatgcccagaggtcatgctgtcacctccttctacaagatttctcttggccagcatgtctagtgagaggaggagggagaccaggggagaatgcgtgtgaagagggtggccaaagagggactttcggcccccagtcctgtgttccagcctcacgtgctccttgttctcaggggtgcagttccggggccttcctcatgggcaccctgcctctctttttcactcctttttttttttttttctgggacaaaggagttctctatgatactgtattatcaacttcaaatacagaaatacctgtgtattcagttacatgagtagctgtctttctgtgtttattaatacaatgggctgaataaaaacagctgtcctgaggttatctggcaagatgaggaaagagaaacaaagcaagtcattattgtaccttctcaagataagttctttattctcatccacactcttccatcagcatctccctgcccagaattttcacaatgatcctatactaaaacctaactcagtgtcacggttattaaccagtacgatagcaaggacacatgagaatctgttaatacaagcacatgcgatggcgcaggctcatgctgagcaagcaccattaacacccctcctccttcccagcgccagcacagcactgctcaacagacatgtaaacaccgggccttttatgcacagaagcaaggggagcctcagacccaaggccttatgcacaacgttgtgtgattccctttgaacggaaagctcagttagcaaaaggaatttgggtatctgataatctaaacatcattcccattgttaaagtgcttaattattcacatggcacaaaaacccaggttttgcaacccatagtcaaatccagatgcaaacatggacgggtaacacttaaaatccctgattgtacagatatggcccatctgagatccatattgggaagctgcacaaatggaaagctataaaacacaaacactcttctttcataaaagacattttttcagatagctgaaagcacaatgaatgttgaggtattttgttaacaaatggagaagccaagttcaagggaagtcaagtcacttgctaaaagatgcaaagttagaagtcaagaagtgacatctatttcggtgctctgccaatgaaagtgatttttattccttccctatagaatctaaaagaagaccaggtatagtggctcacagctgtaattccagtgctttgggaggctgaagcagggaggatcgcttgaggccagaagttcaagatcagcctgggcaacatagcaagatgctatctctacaaaaaaaaaataaataaaaataaaaatcagccaggcatggtggtgcatacctatagtcctagctgcttgggagactgaagtgtgaggaggatcgcttgagcccaggagttcaaggctgcagtgagccatgatcatgccactgcactccaggctgggtgacagagcaagaccttgtcccttaaaaaattttttttcaaagaatctaaaaggaaaaagggaagactactgagttcatgtacagctcaaagaagtggaatagggaagtttaaaagaaaagggaaaagaaaacacacacacaagaatagacactgttggcaaccctacagagtcagagtttgaaagtgagagttggaaacttgacctctgagtttgctggaggaagccagcaacatgatttagaaaggataatataatcataatggcaggaagtgagcacagtcttcttggctggagaatctcagttgcagtgtttggggcagactgactggaaatgatgctatgtcggggaccatgtttgaaagcctaaaatctgagttgacaaggagatgttccatggaggctctgggaaagagggactcgaaggcagacccccacacagcggactagtaaggtctcgctctgtcacccaggctggagtgcagtggcaccatttcagctcactacagcctcaacctcctgggctcaagcaatctttccacctcagcctcctgaacagctgggaccacaggtacatgccaccatgcccaggtaatttttgtactttttgtacagacagggttttaacatgttgcccacgctggtctcgaactcctgagctcaagcggtctgcctgcctcagcttcccgaagtgctggaggtgttttatggattgagtactgttcagttgtaccctatgaaagtgacccaccacaatggcctgttttcctgagcaattctagagagacagcagaaggggctggtggctcccgtgaggctagaagggcagaacagcagaggaggagagggttggaacaaaattgggcagtggcctctgtgcttgctggctccccagccccaagccgcctctctgtgggaaccagggaacattcatactgctcgaacgtggctcttcccacagtcagacaccactggccagccaggatctcccctcctgttgaaaaatgctctcccttgcagctcccactaggaaacctggaaggccaaactgtttatgacattgtttccctaaaatgtgctcagacaccatgttttataaagtttctgtctcttctttctgttaagaaaggagaaaaaggatcccagctactcaggaggctgaggcatgagaattgcttgaaccagggaggtggaggttgcagtgagccgagattgtgccactgcactccagcctgggcaacagagcgagactctgtctcaaaaaaaaaaaaaaaaaaaaaaaaggagaaaaaggaaaaacatttccagcactcttgtccacctcctcagttggaagtgtaataaaaagattcttctggctgggcatggtggctcacacctgtaatcccagcactttgggaggccgaggtgggcagatcacttgaagccaagaattcaagaccagcctggccaacatagtgaaaccctgtctctactaaaaatataaaaaattagccaggtgtagtggcatgcacctgtagtcccagctactcaggaggctgagacaggagaattgcttgaacctgggaggtggaggctgcagtgagccgagatcacaccactgcactccaccccagatgacagagccacgcttcatctcaaaaaaaaataaataaataaaaaataaaaggattcctctctctagtgtacccatgtctctcaagacactctcccaactgccctggtgcccaaactcgtgtttattcccttcctattcactatccttcacctctcaggtattaggtaaagccaatgtcttggggaaaagtggctaaaaagaggaaatgacagttttctttctaacaaaaatatgaaaccatctaagaagaaaaaaatgaagtagacctatctttttgttagtgtgcagagtaaaagccatttaaaaaaaattatttaaaaaaaccatgattttcaaaattcatatagctgagaatactgtattttaaatacaggttaagtatccctaatccaaaaatatgaaattcaaaatgcaccaaaatctggagcttcttgagcactgacataacacgcaaagggaatgctcaacttactggttgagcagccctataatgcaaatatttcaaaatcctaaaaaatctgaaatttaaaacactcctgatcataagcatttcagagaagggatactcaccctgaattaacacaatccattcaatttagctattgtttataaaataaaaactagcccaagccttgctgagtgggcatatcttgattgccaccgttattgttgcagaggtacattgtgaagttgccaggtctgcaggtcagcccgttgcaggtcctggtttatggatggttggaaaagagctagtcccattccaattgtcattgtcagccaagtgcattgtcaaaatatcccactttcctggcaaagccctcattggtatgtttccacttggcccagtgcgtggaattgttttcatatactccccttgctttgagaggtctgggcagaagaaagcaggagaagaagaggagtggggaagagcggaggggtgcagacaggaaaggggagagcgagaaggagcctgaccatgtgggtctgccaggaccctgcatgggccagcttatgccctgtcccctggctccaaatgcccaggaaagactgcctcgggagacgctacatgttgaggttcacatcaccaagtgtgctgtgtctgaggcttggaccgagcactggaaaaatgacccagtggccaattaaactttccattggcagacattggatgaaaactttttttttaagtgaaatctttccatttgagtagtttgttttttaatgaaatgaaacatgtactgacatgcgctctgtggagcaataggagagtgattaattaaactctgtgctgccattttggagggaggcactcagagccagagtcaagcattaggaggcgtttcaggggctgtaaccgcacccagaaggatctgtcaggcccttctgcctgtttcccctcagttcctgtggactcctggaagggacagagacaagggagatttctgctggtccaagctctgtcattgctgaaatatgaaaccaaggacagtactaaaagatgcggcaaggcaaatgctttggagagtgccagttctgctacgtgattacacactcttcctaatctttctgggcaatatgtatgaagaaataaaaacagtaaatagcctcgtaatcagttcaggttttgtggccagatgaggtcagttcagatcagttctgtagtcaagtgagttacaaaaacttgatggtgttcagagctcgttggatggtggaattgtggagaaggaaatgctggcctctgtccgcgtttatctagagccggaggaggctgcctttcattcccgagcatgctccagttcctcccttgcttccagctccccgcccccatcccccattttcagccattggaggaggatgtaggctaattagccacagcgctgcctctcactcctcccatgcaactgaggaagtcgctggtaaaggcatgcatggcacagaggcagggaccctgactccttcaccaaacctctctccctaaaataaggggtcgccctgacacgtgagtgaggttattttacaataattgcattgaaggcctacttcagtacagcagaaacaatatgtgaatttttattacctcaagaaatgataatggcagagaataagaaagcatcctgaaaaggtctggagagacatgtgactgacaggctgtggttgacagccaggaggagccaggatacactcagctccacaagtaacaacacaaccaagaggactggcaacagaccccgaagtccgagtgttccctctgcagggggacaggctgtgctctggcccagcgcctctggctgtgctgacaagtttctagctaacgggtcgccacctcccctagaagtaaaggaagctccatgcatatggtgtgtgctcctgctggctgtagccctgggaaataggggaagaaatcttggtttctatatggcttgacatcgggttcttgctcctgcaaattaaccgggtcagatactggggaggattccagatgacagcctcaccggccaggaagcaaccaaagcacagcacagcttgacggggagctggcagaaggtgatacaatgaaaaagggaagcaaaactagagaatagtggctggcagtagttgggaggaggtcaggacactggccaccccctaagcatggtagttcctgtagtgttaaggcagccagtgtgcaggaggccgcactctctgaggagttagcgatctgtcttctgttagtgctatgcagcccagtgtttcaacagcttcccaagagtcagaaaaacctcaaatgatggatggcctggctgaagtcatcagtagagataggccccggacatggtctatctccccatcaaattcaccaaacctcagggcactgtggggttgcagggccagacagtgcccagccacgctggcatgatggcagatctccaacagtggggaactaagagtttgcccaggcatgaagaaaacgaatttatgaagttcataaatggagtttataaatgctataaacaaggggcagcatgctttcattctgtgtggatttttttgtctgctttattcatatattgttgtcagtttaattgaagtataatctacacacaataaaattcaacaattttaaggatgcagtttattgagttttgacaaacataaacagtcacaccaccccatacataatatagaacaggggttggcaggtctggctcccaacctgtgtttgttttgtacgtttttaaagggttgttaaaaagaagaagacagggatcatatgtgacccgcaaagccaaaaatatttactgtctggccttttacaggaaaagtttgttgacccgttgaccctgacagaacattcccatcccacttggagttccctctggccccttggcagggattcctcccctcccccaggcagccactgatctgctttctatagatgtagttgcgccttttctagaatttcgcatgaatgaaatcataccgtatgttgcctgttgtgtctggcttccttcacttatcatgttttgagagtcattctgaatttttcatgtctcagttctgcactccttctttactcctgagtagcatggcagggtttgactcctggggggatgggagtactccgcatgttttagccacatgcagacgcaaagaagaagaaaggggatctgcaagtgcggcggtcagggcctggatccccggggtgcccactctcactgcgcttgtctttgcaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaaagtattattttccaaaagtggcctctttgtctaaaacaataaaattttttttcatgttttaacaaaaaccaa

SEQ ID NO: 37375 - DNA, 316886 bp, Homo sapiens; identical to SEQ ID NO: 36960

SEQ ID NO: 37376 - DNA, 11115 bp, Homo sapiens
tgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaagggggtaggttgggctggtggtttcgagagcggagtcgggagaaggacgaaaggccgggaggggctgggttggggggtagtggggtggtcgccgctcggaggccgccgcttggaagcggcggggctgcgcctccccgaccatctcccacttcagggagggcggcttgccgatgggaggacttgctcaggtggaattcagtggacgacgccgaggcccgaagtaggggacatccagcattttcccctttccctgctggcttggcctccgccattttgggtacagtggcgcggccacctcggcttcccgcccttccccgctctttttacttttttgttccccagcttccgaaaactgatctagaaggccaggggagggggtggtcaaagctccctggaagggatgagggtgggtagtgaagcgagcagggaaaggccgggcagttgggtggagggaggatcgggtttgccgggcgcgctcccgatggaaatggcgccggatgggcctggcctcccaccgcggcctcccttcctccgcagtctcggcagggctacctgggctgacgggactgcgagtgacttctgacgcagattcccaagatgagagaggctggagctgggggaggaaagccaatggcgacgaaggtgctcaactcccaaatccaggacaaaggaggcagacggcctcctttgtaattctgccgcccggtggcgaagggttttaagccaggcttggctgctgacgggagggggaaggggcgtactctccctagctttctggtctctagggcagctagataaacggaaagtctcctgggaggaataaaggacgcttagccggcccttatattccagatttggaacttcgaaaagagtacgtactgattttccaaagggttttttttttttcatgtttaaacgttaataaggacttcggggatgattttgtgagcagaaaagtgggtgatttatcaaataggaatgtgaaatgggcatgtttcaagtaggtcgtctgggcccagtgaactataattgttgctttttgaactttcggggtgggggtgggtgatgtagcaattgttttgcgtagtttggcgtatatatgttagaatttgtttttaagttttacttttgggaaacagttaaaacaacccagtgatggtagatgtgtgtgtattgaaattgagctttcgatgttaaatcttccaagagttgtattttgtgcagtttttttttccgatggcattaaggctctagaagtaaaatacttcaaaatacggttatggtttattttcttttggtagctaggcatgttttttctttagtgtaggagtatagtacactgtaatcgtattttaaacaagggaataagcctactaaacataaaaacaaattgtaaacccagtcacgtggtggtggtgtgattcggatgagggtcctgagaactggatccgtaattttcattgaagacagtacaaaagggaggagaaaggcctgagagtaagaatttctgataattcatgtaaaactttataagaatattgttacctacttttccagctctaaaaacaaaaacttattattattgaagatgttcagtgatgctttctcaagattgccaaggaaaagtttacgaaaatcttaccttgaaacagtaggtttgagtgaccctttgaagagatagtccagactgtcctgtaaagttatatatgatataacaaatagctttactaattggattggactacacatcttttttctgtcctcttttcatttgtgccgttatctggaaatccatctaattgcctttttaaaataatgttatctttgatttccttgttttggtaaactgactgaactgcagtagataaaaacctggttctagtgaactaacattttagagaccttacctccttaagctattaggggtgtgtctagttttttgtttttgtaaagagcaagcccattgggaaggaatgatgtaaattttctgttaaacttaaatcatcagcactttttccaaaaaataaaattcattctcatttcttgaccactgggctaccatttagaaagttatttattgatgtaaaatcctttatgtattacttcagaagataggctatgcctccgtgttaagaggattctctatttcatttgttctttagtggattttttttctttaacgactttggtatataattcacataccgtaaacttcaccaattttaaatgtacagtttagtggattttagtacattcacagcgttgtgtgaccgtcactacaatttaattttagaacatttttgtcactccaaaaagatatccataccctttactggtcattcccattgctggcatcctccctcccctcaagcctcagacaatcatgaatagaaatggaatcatgcaatatgtagtcttttgtgactggcttgtttcacttggtgtaatgtttagaaaattatacttaaagtctcataaaacttgaccaaagctatcctcatattttaactgtggtatcttttattggtactagcacctagaattcttaaagcagagtagtgattagccatgacattgttgcaaagaaaggttgaggtggattatcctgaataattagtaaactgttttaagtagtttctgacagctttattagagcagattgcttcttcctgtgcccttagagtttttcttgtttttgttttgtaggtaggatttttagttttgaaggggttggtagagtgaggctgtttttattgtatgtgctttgcatacacagtcaccctataaaatagattaagtgttccgagttcggttgggttttccgcaattaaaaattgtgttaacagtttagtgtttcttacagataacactgataacactttttttgttttcattgggtcttatcattggtacagactgatccaaaaatccaattggcttgctagtaattttttcctgtgaattgctaagatttatgggtaaattaatttttctttttcttttctttttttttttttttaagcatttgctccttaaatgcaaatcgtaccactaagatcctctcacaacagattaaggtcgaatttgcagagttcttcaatttttcatgaagcagtgagggtagatctgtaccactttttccgttctgtgtaaatcaccgtttatgggaaacacttgttttttaggttggtgctatttaaaaaaaataaataaaacggtaggcattttcaaaacatctctgaactttttttttttcccaaactggattggggccgcctcctctcagagctactctttagaatagtattaaacttataaaagcctttgctggctttgggaaataaaatttttaataattctcagttcttttcaaggcttgaattgttttctgtccttcagggttcacatattttgtgtatggtatagctcactggcttttgcagggccccttaaagtccagtaacaattgccatcagtaaatgcttaccatgaggcagaccaagcacttgaatagtccagtgaggtacaggtacaactgctatagtttacaattgaagaggctcagaggtaaagtggttcaggtagccagtgagtggcagagtagggattcagacccagaacattcataatatttatttgtgtgcataacaagtagttgtaatgtcagttaaaagtttgtattcccattttggttttctatgtctagagtggcacctagggctgaaggtgattgacactagaggtacttaactacttccagagaatttctacattagcttattttaagtgcatgaattctagggaaaaatattttaccctttgcagatgccacccctaagagatgcaccaacaaatagatgacatgaaattaagcattagtgaatgctgttgatacgaaatatgatcttcaaacataaaggaatcaaatgaacaaactttgtttacaggggaggaggtggtgagggaaaggtttgaaatactcaggtgagtaggattcctacagctgcatagtgagatttgtaaggttctggtaagtttctgcagctgaaggacttctgcattcacctcttttgtaaatattatggaattttaaaaggaaggatggttgcctctggggaagggaactgggaactgaggttattttggaggggaaggggggcttctagatgtaccttttatgctttattaaaaagtatattacctattaaagtttgtttaaatctatttgattaaaaatttgagtaaactggtttctaaacactgtctccagtggcttcaaaaacacaggtactgttggaaggcattcacttttgagtggcctttgacctcagttttaatctgattaattcagtcattttataatcttgctcttggtgagtttaaactagatttggctaaaatagaggtgggagtgttggcccttcaaagacagtttgatgtgttcaaaattgtagtgcatttaaaagggttagacttctgtgatatttgtccaacgtcaatcagtactcattgcatttttttacttaggctcttgatgttagtggatactggtattatatgcaacttctgaataagttttaaagaatttgaataatcagttgaataaaaacctgaaaagtggtgaatgaaaatttgagagataaggaaaggctagagttggcattcaggggacacaaatagtttgaagactctggtagtagaattatgcaagttttcttaaaattaggcaatatataatattgatactacgaaattcagtacttttccgtaggagggggtcaggtctcattgccttttccgtaccccaaaatatgaaaggtggtctacaattttgttgtggcattgtcacagcagttggccccatgttacatttcctcttgtggcacctctgagaggtgtttcttcattacctcttgacaagagtatattttgattgactgctctatgtgcttgtttattttttatagcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctagttaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaataggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaattaagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtaaaataaatattaaagacatttttattcataggtaaattttagtatttgctttgcaagctcttagtggtaatataggaaacttgtataaagttaattcagacaaatttcagtgcattcctatatagagctttataccttgtatagtatgtatgtatacttccctacttgtatctgtaatagtttataatcttggcaaattgtgttttccaggtatgggaggacatggctatggtggagctggtgatgcaagttcaggttttcatggtggtcatttcgtacatatgagagggttgccttttcgtgcaactgaaaatgacattgctaatgtgagtaatttttaataactattagtggttttatacttatcctggtgtctaaatctttaagcattcttaatgttctcatgtttatagcttaataccaaaatcccttgaatataaaaatagatctacctttaattctttttttgagatggagtcttgctctgtcccccaggctgagtgcagtggtgtgatctcggctcactgcaagctctgcctcccaggttcacgccattgtcctgcctcagcctcccgagtagctggaactataggtgcccgccaccacgcctggctaattagatctacctttaattctaatcactgatggatatttttgtatccattgtgtgtcaacctacataggattcaaacaagtaaaaagctacattcgtgaagtccagttaagagtataatgaaagactgatcagcatagaatggtgatgactataccattttgtgctggtgtcttttgttgtaccgttttttgttttgttttcttttttgagacagagtcttgctctgtcgcccaggctagagtgcagtggcgcgatctcggctcactgcaacctccacctcccgggttcaagttattcttctgcctcagcctcctgaatagctgggattacaggggcacaccccaccactcctggctaactttttgtatttttagtagagatggggtttcaccatgttgatcgggctggtcctgacctcatgatccgcctgccctggcctcccaaagtgctgggattacaggcgtgagccactgcgcctgacctgtattagggtttgaaagagtgaatatataaatattagtgatttggtttggctttctaggctagatggtgattagaaactgaggagttggaaataacaggaatagatgctgctgttgtcactgatgtgaaactggttggtttcagatttgttaggaggtcagcaaacttcagtccatgggctaaatccggtcacaccattcctctacctgttgagtggttacattagagacccaatggccattcaggccaaaagtactgactctggctttaaaagcaatggtgtgctctagatcttactgggaatcagctggcctgagttccaactgcttttaatgatagtttaaaacctggctaacttgtgattagaaccaaatgatatcttttggggaacaatttcatatagtcttaaataggtggctttattcaaaccgcatagttccaaatcatgatatcccgtatttctctctgtgtgtttgtgtgctttttttttttgacagtctcccactctgtctctctgaggctggagtgcagtggcgtgatctctgcttactgcagctcccacctcctgcgttcaagcgattctctgtctcagccttctgagtagctgggattacaggcgtgagccactgcgccctgcctatctgcttattttaaaagcagtaaattctttacattatccctaagtgtatactctgatattcacagaacctctgtagttgactaagttattagtctgacagggcagtggaagggtttgttttaattgatgaggaaaaatcaaggtatgtggtaatttactttaatattctcaatagaaaagtaaataagtgtttccttttatttagttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggtaagtatctctagttcagtttgtgttagtccgcatatgtagtgcaaactttaaagtgcaggtattacttttattattttatgcagatatctcctgctgagtgattcttaatatctttttcttaaggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagat

SEQ ID NO: 37377 - DNA, 201916 bp, Homo sapiens
gaactacaattcccagaaggatgtgcggccgaaagcctcgggcggccttttgaggggctcggctagcttcagcgccgtggggtctgacctggctggatatagtgtaccggcccggcaggaggggcggcccggtccgggttgcgcctcctggagccgcccccgggacgtcagtcctggaggaggcgagggtgagtaggagggggcctggctggggaggctcagatcattcggtccgcaccgccttggcccctgctgcagactcacggccttcctggcctaggctgtggcctgagcctccatcattggcctcctcgcccgctgcctcttctttctgctctaattcctgcattataaagtcagagccaccactcggggcctcagttgaatgagtcaatgacttatccctgattgtctctgagggctcctgtaaggagtagatgtggtacgggatgggatagcacgtcgtaaactggaaaactgtgtgagtgattgctgctaaggcgtggatcgctcctccagtataattacgaaattccctagcaaagcagtcgaggatcctaacttggccccaggtagctctgcggcttcttctgcaaacactcagtgaggtccaggagcccacgcgatctctgcttagtacccaggaggcacactgtgcttttgtggttctccctgctcccgcctttgcttcagctttcctgctgcctggaatggccttacccgttctctctctggaatgctatcttaaatgtcaccatctctgagaacttcccgaacaaccaaccctttagtcctaatcagaattactcttcctatgagtgtgactgcagtacctctagttttgtacggttataattattagagcatttattacacgggcttgttgtataattaggcaaggatgatgacacctttgcattttatagcactttatcaaagtggttttgacttttttctataaaaaatgatttattttcttaaaggggcaaaaaatacattttttcttaagaaaaaaaaagagccctgcataatggctttctcagggtgacaaaattagacagtgatagagccaatactcttaccaaggcggcctaactcctagactagtgctcctatctcttgtccacgcccctgacagagcccaaagatagttgaaatgggaaattttaaaagagcagagacttgtaagtatgaactcattattcaagaaattaaactttgatcctgctcactttttggacttagcactcagcctgtgacctttcatccaacaaacatctactgagtactggctatatacctgttactgtgctaagtgctaagaattatgaagtaaaaagtatatatatataatatatataatatatgtacatataatatatataatatatgtatatataatatatatattatatatgtatatataatatatatattatatatgtacatataatatatatattatatatgtacatataatatatatattatatgtacatataatatatatattatatgtacatataatatatataatatatgtatatataatatatattatatatataatatatgtatatataatatatataatatatgtatatataatatatatataatatatgtatatataatatatatattatatatgtatatataatatatattatatatgtatatatattatatgtatatatataatatatataatatatatacatatatattatatatataatatatattatatatataatatatatgtatatataatatatatattatatgtatatatattatatatattatatatgtgtatatataatttatatatgtataatatatacacacacacacatatatataaaacagagatcacatttttagtgtatttttcaaagggtataaagaactttttttgtggttctgatgtgcctaaaactctgatcacttagaatgaaaaatgacaggtcttagagtttagaacagtgcctagcacatagttgtcactcagcttgttgaatgaacgaatgtgaacatggtctaaccttattattttttgcattttacagaaacctagaaagctgacatagcctgaggacacactgctgattataaatacaactgggcctagaacccaagtgcagttactcccctcccatgttttcacctccacctctattttgtagcttctctcaaataaccttaatataatcctggatatgacagtagttcttctgacatgactgttagactcagacatgactgaagtgtctcacaacaccctcttcctccatattttctgccagtccttaactcaaattgtcagcaaaataaagacgtaaggagctgtgctttaccataattaagaaagtattaatatgttctctcaagggcagaatttgaaccaataatccttgtcgatgacaagacaaataccagctcatccgttataaatttatcttagaaaactctcagatccccaggagtaacagcgattggcgtgacctgctttttggtgaaatcagaaaaggacttgcctaccctcatggcagcaattaactggagctgattaacagctgctccctttagataagtacatatgcttgagtttaccgtgattctgtgactccctacgtttctaacagttgttacctctctggtccttgtaggcattcagctttggaactttgataaagcagcttaagggtttaggaaggatgtttaagatcactgatgcaactattcatctttccttcccatcaggtgtttgaattgttgctgcatttctccagcctctgctttcttaaacactcttgtgatagggatctcactatcttcctatgcggctgatacttattttttattttattttattttttttgagacagggtctccctctgtgcccaggctggagtgcagtggcatgatcttggctcactgcaacctccatccacctcccaaattcaagcaattctcccacctcagcctcctgagtagctaggattacaggtgtgtgccaccacagcccagctaatttttgtgtttttagtagggacggggtttcaccatattggtcaggctggtctctcaaactcctgtcatatgtttttaaaaggttcttacaagctccatgagactaccggtcagaacaaaattgtccttattgaaatatggttcattttagtgatacgatgttccaagtaagatcttatggttaagacctctatctaggtatattttcctggtggaccaaggagagaacaaataaaaatttcactttttgtgagaatgacggcaagacctagataccttttaatttagtatttagccaggtgtgatggcacatgcctgaagtcccagctattcaggtggctgaggagggaggatcgcttaactcaggagtttcaggctgtagtgcgctatgccattcaggtgtccactttaagtttggcatcaatatggtgatctcccaggagtagaagaccaccaggctgcctaagaaggaatgaactggtccacgtcaaaactcctatgctgatcgtagtgggattgcacctatgaatagccactgccctccagcctaggtaacatagcaagatcccatctctttaaaaatagttttttaactaatttttttttcagatggagtcttactctgttgcccaggctggagtgcagtggtgcgatctcagctcactgcaacctccacctcccaggttcaagcaattctcctgcctcagcctcctgcatagttgggattatgggcacgcgccaccacgcccagctaatttttgtatttttagtagagacacagtttcgccatgttggccacgctggtctcgaactcctgacctcaggtgatctgcccgccttgccctcccaaagtgctgggattacaggcgtgagccatcacacccggccttaactaatttttttatttttttctgagtcagggtctcaacctgttgcccagtctggcatgcaatggtgtgatctcagctcactgcaaaccctgtttctcaggttcaagtgaaacttccacctcagcctcccgagtagctaggattacagtgcatgccaccatgctcagctaatttttaaaaacttttggtaggcagggcatggtggcttatgcctgtaatcccagcactttgggatgccaaggtgggcagatcacttgagatcaggagttcgagaccagcctggccaacatggtgaaaccccgtcgctactaaaaaatacaaaacttagccggtcgtgatggcaggtgcctataatcccagctactgaggaggctgaggcaggagacttgcttgagccctggaggcagaggctgcaatgagctgacatcgcaccactgcactctagcctgggtgacagagcaagaccctgtctcgaaaagacaagaagggaggaaagcagggggagaggaggggaggaaaggagaggcgaggggaggggaggggaggcgaggggaagggaggggaggggatgggatttgtagaaatgagctctcgctatattgcccaggctggtctcaaactcctgggctcaagaaattctcctgtcttggcctcacaaagtgctgggattacaggcatgagtcaccatgcccagccctaattaatttttttaagtttatttagtgcttaaatccagctaattctgacttcacaattgagtttatgttatactctttttgtggatcgggctcacttttatttgcaatatcaattctaatgtttaatattatgtggcatcatattacttgtattaacttagattatgtggcatcatattgcttgtgtcactgtaaccctgagccctgtgcctaatgttaaatattgtctttgttttttcctcagatagtccctaagaagagtcctagaagcacctaccctctcattttacagatgagcagatgagcaacttgtacaaaagtcacctaatttgccacctaatgccaattccaggactaggactatagctttttttcttttgagacaggtctcactaagatagacagcctcactatcttgcccaggctgctctcaaacttctggcctcaagcaatcctcctgcgttggccttccaaactgctagtattacagatatgtaccactgcacccagccaggactatagatttttctaatcctagtcaagtatttctagtaagccatatttataaaatacccacttggaactgatgagacaggtttcagaaatgtttgctgcatgcgctcattgtctgaatcattgtttcaggttgctccggttgctaagaagactatgaacaagtcagagaacctgctgtttgctggttcatcattagcatcacaagtccatgctgctgccgttaatggagataagggtgctctacagaggctcatcgtaggtaagcagtccccttaagtacagaaactttaaaagcaactgtttgtcctgaggaagtttgttaatgttagttttaatttgcaatgtactcatacattttaatggaaatatgttattatttatattttcttccaacacatgaacaagaaaggaattaagtcctaaaacttaaaaatatgggttaggattaggtgaaaagtacttgagaaatttctatgtatttagcactaagtctagatagatattctaaggtactaagggaatgaattcatctttatgttaacagatctcgaatgaaacagtggataatcttttaacatttaatatatacccaaagtattaaagtttacaaatgatttaatttttaatgatttaaaattgattcaatgttccccctgtgatttgcatatataagtgatatatagagaggtccaatgcaggagttctagaggagagaataaagagaacaaagaatagctaagaattttctagaaccttagcttcctgctaaagcagagcaaagatccatctttctatcacaaatccagatattcacaagttgcaaatcccaaagagaaaaaaataaaaatatattatttgtagtctttattcacaccagtgtctgatgacatcatgattgacaacttgggctacaaaataaagtccaaattacttgaactttcatacctgttccttccgactttgtttttaccctacatttgcagtttctccaggaacttctactggtgtaccgtaacctctggctaagctagaggttacttctatttcccaataagccatgaattttgtctcactttctccatatgttctgtttccccaccttttttctatctgctactctgttaaccttcttctgtgctaaacaaactcctacttatctttaaagacaaaactattgtatctcacactctgtgaagatttctcttcctctgcttatccttactttacctcagctatctacattcactggaacttgacattttccaccacctccaaatcactcaaacattctaccattcaactaaaactcttactttcagctcacttactgatgacaaacaatagttttccatgctcactgagacctccaatccactagcttctctagttttgaccatcagttttccttctgtcttttccttcctcactactcagccttgattctatgtctgttattaaaatccttctcttggaaaaattccctttttttttttttttttttttttttgccttctgttgcacttgactgttgcattctcaactctggatgtaccaaacctatcttgctaagcagttgaatccagctgaaagattgatagcaccccaaattcatgattacccacttcaaataggcactcagtacttactactcatcataccacattttttctgtaatgaatgtttcatacctctcactctactgaatcctgtgactgccagttccccctcctttcattctctttaatgcagtaggcttactagaggaaatgaagacattaagtaggaactccctcatctttcagtatggtatctacaaatctacctcgatctgtacccatcttctctcttcatcttcctgctaaaacagagcaaagatccatctttctgttaaaggccagttcttccacacatgctctgtgttccatcccctcctgtcttctcagggacattgcttctttttttccccctctgattactatatcttcaacctttcttctatgctaaattctttccatcaacacttaaacatgcttcattgtttccattatttaaaaatcccatctctgtttcttcatctccctttaggtattgccattttcaactttccctcacgactgcattagcgcacaggctaaactgctacaaccatgacttgaataagatagaagtatatttcattctcataatattgcaatcccaactctagatggaccaaacctatcttcctggcaactactaagcagttgaacccagctgtgtaatagtacacagttatgtgggcagtctaggttagatagatatctccatttcacaaaaccatttaggtatactgccaggccttggttcttccattctcaacatgatgcttctatttctgggtcaaaggcagatacgttcattatagtcatagcccagtcagcaggaaggaggaagagagagcacagggaaagcaatttgtcagtaaggaggtagactagacttagaccacaaagccacacctagaacaaaagaagctgaaaaaaaaagtcttgccctggatggtatcatgcccagctaaaactcacggtgctcaattgttgaaaagaagaatgaaagaatgaatggggggcaaatattgctgtctgtcaccaaaaccaagattcttgggccagctgtacccattgtccacacttatttaccttaattcactcttttattaaaacaaaatatactttcttattttgaagtatacatatagagaagtgcatacaacttatatgtacaatttaacaaataaacataaagcaaacatccacttaaaccacctaggttaaggagcagcacattgtcagtaaccccagaagcccctaatgcatccttctctccccactagaggaataggctatcttgacttttataataatcattacattgtggttttaccacctacatatacatccttaaacactttagttaattttgccatttttgactttttgctaaatgttccatgttcacttgaactaaaaaatgtatgtatattacatttttgtcattttcctgctcaaaattctttcattattcccattatacttggaataaaatttgacaggttacttgtatctctttacctgtccatcctcacgttttacctcacgtggtaaaacttgccttctttcagtgtctcacacctgccaagccctttttcatctcagggcttttgcctgaaacgctgttctccctattctctgtctgaataactcttagtcatccttgagatttcaattttaaggtcacttcttcaaagaggcctgctaaccatccagtctcaatgaaatctgttcattgtattccctcttggccctctgtagtttttcttcatagaacttgtttcagattatcactgtatatttatgtgtatgaatattttaacatctctctcctccataagctagtggccttcatgaaagtagtctgggtctgtttaattcatcactaaatccacaaaatccagcacagtacttggcacataagaaatatatttgttgaaggaatgaataaatattttaatcattctttaagtatcttttctcccaagtagtctataatcatcttgagggccaggactaaaaatgaattgagttgaattaaattgaattgaggagcagattgggactaaattccatgagaaaaaaaaattttaagtcaggacgtatgaagaaaaagtaccaagtaaaatgaattcattaatgctttaattaaaaatataaccttcaaagaaaaaagtgcagtatgttataaattaaaaacacttatatttttatggctcagtcatacagattaattaatgtgttattattaaaacctgaaaccttgaaaatccccaaagagaaaatccttaaaaaccaaaaagcaatcatgatgtgaagccagtaggtagctaataaacttatttataaattgtttttctgttttctatcatcttgtctgaggaacttcttattaattactgactgagggtgccactcctcatcttttaagaattgtgccattatgttttctgtgtacctttgctctagagtattttccagcatttgtatatttgtgcaaaaataataactgtttcatcttaaatttcaatgtaattttttttctatgcatatgaatgccaggtggtaatttcaatgtattttaaacatctttttatgtatcacatatttgatgatctctaaatatatgctatttctcttttctaaactagtgacatagtactacagatgaattttttttcttgaatccttgttcaccaactgctcagtgaattcattcactttagcattttctgttttcccctctctgtttccatggagaagtatgtcagtgatgtgtttgactccatggaaacagatgagtgtctctttctacatacacaacgaattaaatcgaacactttctgtgctgcccattgtcctggaggaggactggagaggccttctctgaatgaaacatcatttcagtagcaattcttagtgtttaacctaatacagtggattaatgttttaccataacttactgcttctagattcagatgtattagggcttacttctgagccttaaaatataaacatacatagtaaaatctgaatatgctatggttctcatttatagatatttagctttttctcttaacaccaaactcaaataatttgaatgaatactagaaatgtaattgagaacagaatttagtagattcattttaatactatacagtgtagtattggtagaaaaaagtatagattttagagtcagataaacctgagttttaagttctaactgttatttattagtagtaatatcttggctaagccatttaatttttaagcctcagtttcctcatccgtaaactatagattataatatttcacttgtgtgagagttaaatgaaataatgacagtaaaatatctagcatggtacttgacacatagtagacaataagttaatatcctattactgttattgttatgtcagcttagactaaaataatcaagtttttcatagcttcagatgtctcaatatgaaagagcactaaatgcaacaaagattaatattgtgggttttttgtgaaaactaaacaaaataatttgtaaatatgcatggtgtgtaatgatcaatgttgtcattactgccaataatatttgaggtcgcttgcagtggtatcgtgaccaggaagcaccattctgattctactacaacttttgtttcactgtccatgttctgagcagcataatctctctaaatcatttcctctacttgtttatttatttatttatttttgagatggagtttcactcttgttgcccaggctggagtgcaatggcgtgatctcggctcaccacaacctctgcctccctggttcaagtgattctcctgcctcagcctcccaagtaactgggattacaggcatgtgccaccatgcccggctaatttgttgtatttttagtagagacggggtttctccatgttggtcaggctggtctcgaactcccgacctcaagtgatccgcccgcctcggcctcccgaagtgctgggattacaagcctgagccactgcgcccggcctctacttgtttttaacatcttctgacacagtatttagatacggaagtgagcctcataaatgacagagtagaggtactatttcaggttacttcttcccttacctcaatccctaccttaaaagctagagtcattaaatgtttttaaaatgcttgcctacatgcaaatgtgtttataaatatacttaaatgtttatgcatccatcctaacaatagtaataaaattagctaacatttataaagttatgttttatgtgccagccactgtattgtttggcaactcattaacttaacagtgaaataatatgaagagtttggggtattagtattaccctcatttttaaataaggaaattgagatgcagagaggttaagtaacttgtctaagaagtatcagaactgagattaaagccaagaagtctgattccagagtccattcttttaactgctaaagtatgggacctcaatgtatgggtagatatttttgtacacacgtgcactttcatatgtataaataaataggaatgagaaagataagaaagaaagaaccgattaggtgtgaaccttgcatgatgaaatgaatgattatctagatgggatttttcttaacatttttgtgctatgggcccttctggcaatctggtaagcttctggactcctcagaacaaaaatatatgtatatttttaagagctgaaatgcaatatagaggattacaaaggaaaccagttatattgaaatatcaaatatttttaagttgagacataacaatattctgccataattttttatgaatgtattaaatagcaaggtgttggggcaagtcttacagctatgataattttgaaatagcagtgagtgaaaatgatattttaacatacctgcacaaattataagttatagaaatattttataaaatctcaagtcctctcaaaatacagtatgtctcatgttattattattctcattttgcatgttaggacactgagactcagaagttgagaaatttagttgcacagttaataactggcaaagttgagcctcaaaccaaattatctgatgatgaatcctatgttctttccattgttcccatgttgtcactctataacaataagcagagattttttaatgacagcaaaatgccttcccaagattgtaacagtataaaatatgtaaagtaagaagtgggtgaaatcagatgaaataaatacatcttggatgccatgcaaatataacattttagaacaagcaaataagatacaaatagagactactcttgttacttgtattgggcattgtgttgctgtagctattgtgcggactagcacaactataactgcaagtgacagtcatttcctctaactgctagagttggcgctctggtttctgcacataccagcccattaaccatatgtactcttatgcttccacaagccttaaaataactgaatgcggtagagcagtggctttccagtcatgcttccagctcagctttctggactgtgttgagacagagcacaggcagaatgccagccacgttgagcaagcaccaattggtcatggattagaggccatctccacagttgccagaataattagcacaacacagcacagtagccagctgctttctatattaactgttcctgacaggaatgcaaatttaaatgcactgccatccagtgaatattagtttacatcataagctctacgtttgtacaacatgttacaattaccaaatatttccaaacaatacattgttttattggatcatcaaacaagttgcggtgtagattggacaagtattagctgaatgttataagtgaggaaactaaggaagagagtagggtggatagataaaggcacagacctcgctcagttactggccaggaagcccagaacctaatggtaccctcattattcagaaactagccatgaagccactgtccccctagagctactcaagacaggacctaagtgaggttgaatgctgctttttctaatcatttaggggatatatactttctttctttctttctttctttttttgagacagagtctcactctgtcacccaggctggagtgcagtggtgcaatctctgccttccgggttcaagtgattctcctgcttcagcctcccgagtacctgggaccacaggtacatgccaccatgctcagctaatttttgtatttttagtagagacagggttttgctatgttggccagactggtctcgaactcctgacctcaggtgatccacccgcctcagcctcccaaagtgctgggattacaggcatgagccaccacgcccagccgggggatatatactttcaatttcctcaaatagacaaattttgccttataggcacaaaatattggattgtggtgacataacccaataacatcttctcttctgggaaatacatatatcggttacaaagaaacaatgtatgtcagggaacaaagagaaggcttgaagtttccctgtatcttatataagacttaggaagatgacaggattgacctaaagttctgtgtccttgaaggtgagttgcctattaaccccatgatgctgactctgctttgaccctgaggagcctaatcaattaggacaggggtgttcaagcttttggctttcctgggtattggaagaagaattgtcttgggctacacataaaatacactaacactaacaatagctgatgagctaaaaaaaaaaaaaatcgcaaaaaaaaaaatctcataatgttttaagaaaaattataaatttgtgttgggcagcattaaaagccttcctgggctacatgtggcccacaggccacaggttggataagctcgagttaggattatcccagaatgtgagatggcctctgtttctcagcacttactcttgtgaccatagttcctaatcctctcctttactaaagcttctaaggaggaatgtctctctaggcagaaagtgtaaatgaattactgttatcttgctaatactagctactactatctttgcttaacctaacaagatgccagtagagactgccctttaatcatgaaagacaactagagactagtctcattatggcatattctctataagtatcactgactccagaaggactcaaactgataaaaggaacatgctcttatactacattttagttctgttaatgagtttcagtttaaataaatctttatctataaatacagtgatagaatctttggaatcttctagattagatattgaaggctctagtacaaagaatatactgttgtactacacagagtcttgtgcataagggcttctgttattatatgtgttgaatccaatgcaaaatttgcctccatcttcaaaaaagttctgaaaaagaatatctgcctcctctaggagttacacacaacctgaatacatctgtaaggctctttcaaatttccagagcaatgacctttcttgctttttaccagcgaagtaaattgctgaaaagctaggaagtctttctgggttccagcgtatccaagattaaaatatatgtcgaagtattgcaaactaaaacagtagcttagtttcatgcccaaaacaacccaggcatttatctggtgtcttttttgtttgtttgtttgtttgtttgtttgtttgttttagttttaattgatacatactaattgtatgtgtttatgggggtggagtgtgatgttataatacatgtatagattgtgtaatgatcaaatgatgatatttagcatatgcattaactcaaacatttatcatttctctgtggtgagagcattcaaaattctagctattttgaaatatgcaatacagtattgttaactatagtcaccctactgtgcaatagaacaccaaaacttattccttatatctaactgtacccattgacatttctagcattctattttccaaagaaaacactttcattttgtctattcacttcctccattagcacagttcaggccaagataccttggaagtaactggcttccctcttgttcaacccagatgtaattaccctcagctagtaagagatgaatacttgatgattatctgtaacaaaagtggcaacatttttttcacttacaatacatagctggagccatggcatcttttgtagttattgtttttaactaaaatttattgaggtatataatacagtaaatttcacccttgttcgtatacagttatttaattttgagaaatatataatcatgtgatcaccatgaccatcaagataaagaacaattctatcatgccccaaaatgttagaactgtgtccttttatagccagtttctccccacattccacatattccagtccctggtaaccactggtctgttttctgtctctatagttttaacttttccacaatcctatgccaatgtgtcacatgatatatatgccctttgaggcagatttctttcttttttttttttttttttttttttttttgagacagagtctcactttgtctcccaggctgaagagcagtggtacaatcatgactcactgcagcctcaacctcctaggctcaagcgatcctcccacctcagcctcctgagtagctgggactacaggcatgttccaccatgcccagctaagtgtgtgtgtgtgttttgtagagatggggttttgccatgttgcccaggctggtctcaaactccaggcttcaagggatcttccccccatcagcctcccaaagtgctgggattatgggcgtgagccactgtgcctggtgaagtggatttctttcacttgacataaggcatttgagaattttccatgttgttgagtggatcagtagttcattcctttttattagtgagctatattccattttatggatgtactgcagattattttctcattttgcagtttaaggacaattgggatgtttccagtgtttagcaattatgaataatgctgccgtaaatattcacatacaagtttttatattaacttaaactttcatgcttttatttctcctgagtaaacacttaagtgaaaaattattaggccataattattaggctacagttttaatagtagctataccattttgcatttctaccaacaatggctgagaattctattaatagttctacaactaggttctacatccttaacagcatttggtattgtgaagtttgcttttgattgttttcattttagccattctaatagatgtgcagtggtatcgcattataggttaagtttacatttccctgtgtgttaatgatgttgagagtcttttcatatgcttatttagtgaaatgtctattaaaaccttttggccaccgtttaatttctctttttttattttatttttattttatatatatatatttttattatactttaagttctagggtacatgtgcacaacgtgcaggtttgttacatatgtatacatgtgccatcttggtgtgctgcacccattaactcgtcatttacattaggtatatctcctaatgctatgcctcccccgtcccccgaccccacaacaggccccagtgtgtgatgttccccttcctgtgtccaagtgttctcattgttcagttcccacctatgagtgagaacatgcagtatttggttttttgtctttgctgagaatgatggtttccagcttcatccatgtccctacaaaggacatgaactcatcattttttatggctgcatagtattccatggtgtatatgtgccacattttcttaatccagtctgtcattattggacatttgggttggttccaagtctttgctattgtgagtagtgccacagtaaacatacattgtgcatgtgtctttatagcagcatgatttataatcctttgggtatacacccagtaatgggatggctgggtcaaatggtatttctagttctagatccctcaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccagtggtgatgagcattttttcatgtgtctgttggcttttaatttcttttctttcttttttttcttttttttttttttgagacagggtcatactctgtcacctaagctggagtgcagtggtgcaatctcggctccctgcaacctccgcctcccgggtttaagtgattctcatgcctcagcctcctaagtagctgggattacagacatgagtccagccactgcacctggctaatttttatatttttagtagagatggggttttgccatgttgcctaggctggtctcaaactcctagactcaagcaatctacctgcctctgcctcccaaagtgctgggattacaggtgtgagcactgcacccagcctaagtttcattatccatcttattattctattgtaaaagtttttatttattctggaataaaaggccttatcaaatatgtgttttgcaaatatttcctcccaatttgtggctttttaaaaatttttcttaattgtgttttcaaacacaatttctttatttggatgaaatctaatttattaatttttatggattattcttttgtatcatatctaagaaatctctgcctaacacaaaatcaggaagattttcaccttcaattgcttctaaaagttttatatagttataggttttatttattttttatttttttaacaggctttattcactttatttttcttgtataaaaccctatgttgtagccacagctggagcctgagtccgctgcacggagactctggtgtgggtcttgacgagttggtcagtgaattcctgacagggagacttggtaaatacaatcttccagaggtcgggggtcaggtagctgtaggtcttagagatggcatcaaaggtggccttggcgaagttgcccagggtggcattgcagccccgggctgaggtgtagcagtcatcgataccagccatcatgagcagcttcttgggcacaggcgccgagacaatgccagtgcccctgggtgcagggatgaggcacaccagcacagagccgcagcggcctgtcaccttgcaagggacggtgtggggcttgccgatcttgttcccccagtagcctctgtgcacggggacaatggagagcttggccaggatgatggccttacggatggtggtggccacttccttggagcacttaacacccagaccgacgtggccgttgtagtccccgatagcaacaaacgctttgaacctggtgctctggccagcacgggtctgcttctgcaccggcgtaaccttcaaaatctcgtccttgagagaggcccccaggaaaaagtcaatgatctcagattcattaatgggcagggagaagagacagatttcctccagggacttgatcttcatgtccttgaccaagcggcccagcttggtgacgggcatgcactccttatcctcggccttgccttctcgagctccacggcctcagcccgggccccgtccacggccgcaaccccggccccggatgccactgcggaaacctccgcggaagccaccgcggttccccatcccagggccaccagggcctccggccccccgccccccccgcccacctcccgctgcaccggcgttatcagccatttggtgttttctcggagaagaagcagttataggttttagatttaagtttatgatacgttttgaggtaatttttatatatggtgctattatggactgaatatttgtattcctccaaaattcatatgtttgaaaccctaaccctcaatgtgatgatattaggaggcggggtctttgggagataatttaagtcatgagggtttagccctcgtgaatggaattaacacccttataaaaggaaccccagaaagctctcaagccctctttttcatgtgaggatatcagaagtcagcagtctgcaactcagaagagaggcctcaccagaacctgatcatgctggcatcctgatctcagacttctagcctccagaactgctaggcacaggtgcataccaccaagacagattttttctttttttttctttttttttttttttagatatggggtcttgctatgttggccatgctggtcttgaacccctggcctcacgtgatcctcctgcctcaacctcccaaagtgctgggattacaggcaggagtcaccattcccagccaatttttgttgttgttgttgttgttgagacagagtcttactttgttgcccaggctggagtgcaatggcaatatctcagctcactgcaacctccacctcccgggttcaagcgattctcttgcctcaacctcctgagtagctgggattacagacgcccgccaccacaccttgctaatttttgtatttttagtagaaacggggtttcaccatgttggccagactggtctcggactcctggcctcaagtgatccgcccgcctcagcctctcaaagtgctgggattacaggcatgagccaccacacccagccccaatttttgttttttataagcctcccagtctatggtactttgttacagcagcttgaactgactaacatacaaaatataggttgaaagctttgggtttatttttgtttttgtatatgtttttgtttttgtatatgaatgccaaatttttccagcaccatttattattattattatattattcactcctgttgcccaggctggagtgcagtggcatgatctcggctcactgcaacctctgcctcccaggttcaagcgattctcctgcctcagtctcctgagtagctagaattacaggtgcccaccaccacacctggctaatttctgtacttttagtagagatggggtttcaccatgttgaccaggctggcctcgaactcctgacctcaggtgatccacccaccttggcttcccaaagtgctcggattacaggcatgagccaccatgcctggtctttccagcaccatttatttaaaagattatctattggtttgcctttgcatctttgtcagagtcagttaatcatgtctgtgtgtgtctatttacatactctcaaatctgttctattggtctataagtctatttctttgccactaccacattctcttcattactgtgggtttacaatatgccttgatatcatacaatgtgagttcttcaactttgttctttttttcaaaacctttttattcttctacttcttttgccttttcataacaattttaaaactgcacattcatttctacaaagattgctctgggaagtttttaacaaattattcttagtagtaccttatagtggggattaattatgaatttaatttaattttttaataaagtactatattaggtttttattgctgtgtaacaaattaacacaaacttagcttacaaacaacaaacatttattacttcacagtttctgtatgtcaggaatctagacactgctcaagctgaggcttttgctcgtggtgtcacaagactgcagtcaaggcgtcagccagggctaaggtctcatctgagatttaggattctctccccactgcacattggcagaattcttttttttgagacagagtctcactctgtcacccaggctcgagtgcagtggtgcaatctcagcttcactgcaagctctgcctcccgggttcacgccattctcctgccgcaggctcccgagtagctgggactacaggcgcccgccaccacacctggctgatttttttgtattttttagtagcgatggggtttcaccatgttagccaggatgtctcaatctcctgatctggtgatctgcccacctcggcctcccaaagtgttgggattacaggcgtgagccgctgcacctggtccagaattcacttttttaaaggtacttaatatgtcaaccttattgtttctctatatgcacatttatttgttactgaaaattgaaaaaatagcatgttggaattttcttttaatataattcaaatttttaaaaaccagaaaatctaattagttatgctctaatcaaacttctcaatgttttcttttcattctttccccacaagttaccgtgcttcaaattccagatgttgggattcatctcactgacttaggttctaaaacatatgggagccctgtgtggtggcttatgcctgtaatcccagcacatgataataattcagacttattggtgctgctttgggttcaaattaaaaagtagagctaaagtatattcgagttattcaaatacattcaaacttacacagattccttataaattactgctatcaaggtaagaaggaaaagatacaagaagaaaaagacatcactcatgataggttattattggtatacagtctatcctagcatagactgctgcataaatttgccagcaagaaagaaaagtacaagaataaagtttatgactaaatcacctcattgtcataatttcctattctagcattctcagaaggatcccatctatgatacatgtagaaactgcagccacatttgaatggttcaattcttgattcattctgaaccctcttaggcccaatatttgttagctttcgtttaagctgagaaaaatctgttgagtaacaggtatctcagttttaccatcctttctttccacaaataacgatgtcctttttcctctcctcctgtaaggcaaaccatctctgatgtcctggaaggtctttgcttttctatcttgttgttggggtgaaccttctggtggaggggaagggaatttggtacctgggtggagaatcaagttatcaaggttctttattaacgttttggagcagaagttgtgagaggcctctgaatcatcctgggaatctttctttggtgagcatttgtgaagactttgggatcaaggtgcacatttgtgatgagtcgatcaatggtctagtcatagctctaagctccttctggatctttagtcccagcagaatgtgttgctgaactctcaaattgctacaaggtaccctggaaagaactatgtagcccagaaagagcctgaaaacctaaactccaacaaatagtgatgaacaagttgactacagtttttttttaacaattttaaaattcattgcagtttgcttctccaaggccagcaggaaagtgtctctgctgcttcaaatctctacaatttctacctcggacctctagacactcttttgaaagactcacctgattaggtgaaagcaacccaaactaatctctcttgattaacttgaagttaaatgattaagagacttaattacatttgcaaaatcccttcatatttgccacataacaaaatctaatcatgggagtgacatcatagtcctgcccacactcaagaggaagggatcatacggggcatgtataccaggggctggaagtcttggatgccatgttagaattatcctaccacaagtactgttgagagtatctatatcttaagtggactttgaaggagtatatcttccaaggaatttatccatttcacttaaattgtgagtttatagcatatgacattctcttatttgccttttaatatctgcaggctttgtagtgatgtcattcttgatactgggaatttgtgtctgctctgtttttaatgatcaatctgattagagatttattaatttaattttccaagaaacaacttttagcttcattgattttctctatttttttctgattttaatgtaattgctctctgttcttatttttcttatgtacttccttctgcttgttttgggttaaatttgctcttctgttttagtgttctaaggtagaagcatagataattgatttgaaactattcttctattctaattaaaagcattcattactatatatttccttctaagcttccctcatgtgtggtgcaagaaccttacaacaacatgtttttattcatttaattatgctttttaatttcccttgagattttctctttaacccatggattatcttaaatattttgttatttcttgttattattctgttattgatttctagtttaattacactgtcatctgataatacactttgtatgacttcacttctttaaatctgttagtattcattcatgacccagtatattgtatattttggtcaaggtcccatgggtgttttgaaagattgaatttctggctgtcattagatgaagtgttaaataaataccagttggatcctgttgctttatttttgtgttcagttcttctgtgtccttgctgattttcattttagtggttccagcaattattgagagaagagtgttgaagttaccaattataattgtgttttcaagtgtttctttctattctatcagtttttgctgcctgtatcttgaagctctgtgatttagtatgtatacatttaggaattttatgtattcttggtgaattgacccttttattgttatataatatctctatttgtttctggtaattgtcttttctctaaagtttaccttattagatattaatatacttaactccagctttcatttcattagtatttattatagttttgctaattctttgacttttaacctcctatgttattgtattttaagtgagtttctttttttttttttttttttttttttgagacagagtctcgctctgttgcccaggctggagtgcagtggcacgatttcggcttactgcaagctccgtctcccgggttcacgccattctcctgcctcagcctccaaggtggctgggactacaggcacctgccaccacacccagctaattttttctgttttttagtagagagggggtttcaccatgttagccaggatggtctcgatctcctgacctcatgattcgcccgccttggcctccaaaagtgctgggattacaggcgtgagccactgcgcccagcctaatcaagtcttcttttatatctcagcctttttattgatgtatttacatcatttacatttaatgtaattatgaatgttaagatttaagatttccaatttattgtgtagaacactgcatgttccttctatttttcattcctgtcctcctttccgtttcttgaatatttttagtattccattttaatttatatatggtagagctttttgtaatgctttattaagatataattcacatactatacaattcaaaatttaaagtatacaattgagtgattttgtgtattcagtgttggacaaacgtcaccacaaatgatattagaacactttcattatcccacagagaaacccttcaccctttggctgttactcttcaaatttgtgcccaacccccagtcctaggcaactactcatctactttctgtctctatagatatgccagtgccagatatttcacataaatataattatataatatgtggtattttttgactggcttcttttgcttagcataatgttttcaaggttcatccatgttgagcatatactagaccttcattccttttgctgagtaatattccactgtagagctatacaacattttgtttaaccattcgtcagttgatgaatagcttatggatacttgcattatttccaccttttggctctcatgaataatactgcaatggatatttgtgtaccagtttttgtgtggacatatgtcttcgtttctcttgggtacatacttgggattggaattgctgggtcaaatggttacttaatgttttgaggaacttccagaatattttccaaagtgactctaccattttagattcccaccagtagtatatgaggattttgatttctccatattctcattaatacttgttattatgtatattttttattataaccatcctagtgtatgtgaagtggtatcttatattgtggtttttgttctgttacccaggctggagtgcagtggtgcaatctcagctcactgcaacctccacctcctgggtttaagtgattctcatgcctcagcctcccaagtagctggtattacaggcatgtgccaccaccacacccggctaatttttgtatttttagtagagacgggtttttgccatgttggccaggctggtcttgaactctaggcctcaagtgatccgcccacctcagcctcccaaaatgttgggattataggcgtgagccaccctgctgggtctatgttgtgtttttaaataaatctctttgtatagtttgttttcattggaggttttttatttgtttctgagtgtgtgtgtgtgtgtgtgtgtgtgtgtgtgtgtgtgtatgattgttctaggtattagaatatgtatacttattttatcacagtctgtattttccactttgagtacaacatagaagccttatcactaattaggtccctttacccttctttttgatatagttatcttaaaaatcacctctacataaactgagaaccacatcatacagcaaggttatctttgctttcaatcatcgaaacataactctaaaaattaaagaggataagccaggcatgcactgtagccccagctactcaggaggctgaggcagggaggattgctttagcccaggagttcaagaccagcctgggcaacacagtgagaccctcattaaaaaaaaaaaaaaaactaaagaggttaaaaacagtctattatgtttctcacatatttacattctgcttctcttttttcattcctgatgttctatttgtttcatgagtgttcatagttggttgttggagcacttttttgagagttgttttaaaattcttgtcatataattctaatatatctgtgtcatcacagtgtcagtgcctgttgattatcttttcttgtttaaattaatattttccaaacttttgagttgtttcataattttggattatatctttgacattttctgtattatgagactctggatcctatttaaatatcttactttagtaaacggacaatctgtcaaggtttagaatgaacattctctttcaattttgtggttcaaatttcaagttagttttcagagatcttgcagggctcttctggtttgccccacctctgggctgctcaggcccatttagaaccaaggcaatgatctaactatagttcaattctcagagcttttgctatcttgattctgaccagtttcacacatgggctgctcaaaagtgtcctgactttttgtaccaatttaaagaattacttcctccaactttgtcctctccatattcctatctcctactctctaattggaaaggggtaaaatactacctcattgctatcctttgcttaattcggggcattgatagtttgacagggctcctcccaacggtctctatagtgtccagtggggaaaagaggtgcagtttcttttattgtatgtgttttgagtagagcatagtcaaatggttcactcagcagagttacctgcctcccagtctttttactagagagagtagacttctcttgagaactttggcatctgtgcaccttggtgtttctggattataggctactgtagcccataatgggaggcaaaagcaaacaagcaaacagaaaacgcttcagggaacttaccaccaggttgtctctcaagttccaaagttcctagtccaagatgccttcccttctctgcctgtcatttattttgccttttgccctggggattttagttgtaattagcaggaggatgaggatgctatgtacttgctctatcttgtcatcttgtctagaaagggaaatcaactgtgatttttttttttttttttttttgagatggagttttactctcgttgtccaggctggagtgcaatggcacaatcttagttcactacaacctccgcctcctgggtttaagcaattctcctgcctcaacctcccgagtagctgggattacaggcgcccgccaccacgcctggctaatttttgtatttttagcagagactgggtttcaccatgttggtcaggccggtcttgaacttctgacctcaagtgatctgcccaccttggcctcccagagtgctgggattacaggcgtgagccaccgcacccagcctgtaattcatttttgtatcactcataaaacataccacaatgcctagtgtacaattggcattaattaaatatttgtttcaaaagacaagagtgagtgagggaggaacataagtagctctgtatctcaaaatgttagttcagcataatatgattgagtcatcagtttaaattctagccccacctactttcagtgtgaacatagactggttacttaacttatttgagcctcagtttcctataatatgacaatggtaatatctacttcttaggacaagtaaaaataagatgatatacttaagcatttagcacaatgtttgataataaacagcgaatatagttcctacttatattagtaataacaattatcaaatatcactatctgtttcttatccttataggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaaggtgagaagtaaaatttccttgaagagtaaatgttttgtgtgatgtctgctagttgattagtggaactatgcaatggacagataataaagaagtctcaaatgcatgactcataggttttatatattttctctaaaagctgtctttaagctgcagagagtaaaagcacagataactatcagcggctgcatttcaggttcctcaaacagtagaatttattctgtgatctaaagtttattgggaaaaaagtgatcaaatttatatatacaatgtgatgaaacaatgttaccaatctatgtatagggaaaaaataaagaccaaaaagaaatactcaaagatattaatagtggttgggtttaaatttggggaatatatatggaatttttttacttttcactgtttaaaattttttccttaatgagtattacttttactataaaaagttgaaatcccagcctgggcaacatagtgagaccccatctctacaaaaaattaaaaaattagctgggcatggtggcgcacacttgcagtcccagctacttgtggggctcaggtgggaggatcacttgagcctgggaggttgaggctgcagtgaactgagttcacatcactgtactccatcctgagtgacagggcaagaccctgtctctaaattaattaattaattaatttaatttaatttaaaaggttgaaatgtcgcttgaaatatgtggcattaagaagcataaaataaatttattttctgaatgtattttcaactttttaaaatctaaaactatgttgccaatattaatgatttcacatttttaaatgtattattaagagctcagatttttaagattaaacccatcaaacagataaaataggaagcttctacatttagttaaagacttattcacctaaaaactatttttcttccataaaattttggtccataaaatagatttccagtgcctggtatttttctttttgttattttagatttctgtattttttgaataaaaagcaattaaaatgagttagatccagcgggaactattagagttattttctatttaaaaatgtgaaccagatatagctaattaattaaggggttagaaaaatacctttcattagttgaatgcataaaaaaaggctgacattaagttatactactgaatatgctagttatatgcgcttctcagttaggtctgtcaggttattttcaaagttacttctcttgaatttggtttttattatagtaatttttttaaaaatctccctcattttcaatctcagttttaactacttctcgggtatttataacctttcacttaggcttgtcagctaatgaaattattcactcgagaaaggtaactccatttaacttgttatcataaaaaagcaaatagttcagattgggaaaagccgcaaaattaagactttgataccctttagatttttcattatgattgatttaggtgtaaaactcagcttcaaaaatgtagagtgaaggaacctagcttaacatcaagtagattatgtggagcaagtgaggatttcagttgatgatccaacagtataacatcctgtagaagtattatatgacaaagatggttgaaagaaggggaatgtacaaccagacatgttagctgtaatcttttcatcagataccatgcattgttttctttagtttttttgtttctactttgattttttaattataagtttttcatagtatcgaagaataaatagaactatgatttatgtggtggtatttacatagttggttttataacagatttcatgttctttcaagtatctgataattatgcatttccttccttactctgtgttgctgtttgtttttacatgcttgccaaaagcagtaatggatccgaattcccagaaaaggatagtaataattctttagtattctcctgtgtccaattaaatctgggtactgtgttagttcatttgtgctttatacaaagcaccagcattcagagatgaaatatagtatgcaccagtcaggaataagatagtaaatgatctacaaataattttcaaataatagttggagataatatgtcccaggcctgtaatactccttgcccccaaagagacacaagcacaaattctctttagagaaaacatcttcaccttaaacttccaagattttcccatattaaataaaccaaacgtgaactgacaatgaaagatcaccaaactcataagggaacaatctactatgaatgagagtcagcagaaacaacaaacagatttagtctatgaaaaacatcagggattggcatcattagagaaacaatataaaataaccactgatggaatgcttaaagatatgaaagaagaaatcagccaagcacagtggctcacacctgtaattttagcactttagaaaggccaggcaagaggctctcttgaggccaggagtttgagaccagccagggcaacatagagagactctatttatttaaaacaaaaaaaaattagctgggtgtagtggcccacacctgtagtcctagctccttgggaggctgaggcggaaggattgcttgagccctggagtttcagaccagcctgaacaacaaagtgagaccctgtctcaaaaaatatatattttatttaatattataattaaaagaaggaatctggcagggtgcagtggctcacacctgtaatcttaggactttgggaggccaaggtgggtggatcacttgaggccaggagtttgagaccagcctgggcaacatgacgaaaccctgtctctactaaaaacacacacacatacacacacacaaattagttgggcatggtcgtgagcacgtgtactcccagctacttgggaggctgaggtggaagggtcgcttgagcctgggaagtctgcagtgaggagagatcataccactgtatttcagcctgggggactggagtgagaccctgcctcaaaaaaaaatgtaaatacataaaaaaattttttaaaaaaacaaggaatcagaaaaataagaaaccaacaagacactttcataactaggcatcaattctggccataatggcttattttaaactaatttgcctgtcaaaaaaatctgtaaaaactgaataaaatactatatacattgtttgaaggcattgagaacaatcagcacaggcaggatctaagagactacaatcattcaaagaagagaaacacgtaaagtgagtaccacattcatcctggccttttcctttatgacattttccaaactggaatgcaaaagaatacaaccctaacaggaagcagcagccttaccaggctgaagaaactgaggcagagtttggagataatagtggctggaacttgaaagtcaaaatcctggagaggagggaattgcagagaaagaatgcaagaatctggatacaaattcctcacaagtttttaacagattcctaaactgtgcttgtatagggtggtgctctaagaaacctagtattaaacaacagctgggagactagacagctgagtagagattattttaaattatcctatattttcttttatgtttaaatctcttaatatataacacattgatttttgtatggggatccattctcattttaaagcatatggataactaattttcccaacacaacctagttcattaatttttggccatttagtatctgctctctgtcagttccaggcttttgtactacgaactccctatgcatttctgtttttttaaatgagggatcctgaatactagggagcctttgggaaatttgaaaataaaagttacatgatcagtgtattttagggggactaatatggcaactaaagctactttggaagagaaagagtggagatacatagattgctattatagttcaggccaatagagaggaattgggtttaagagatacattatggaggcagaagtgttcattcaacaagcgtttgttaaatatctactatgtaatcatgattatacaactagagagaatatgaaaaaaatgaattacgtatgttagcttatagatggatgctctcagtacccatccctattaatcgtcatttccctttgtttagtgaaccttctgatatattggatatcaaatatcctttccaagtattgtctgtcccacttaattctggtatccatgaatgcagaagtgtgctatttatgtaatcatgaacactcatgtatatgtgtataccttcattcattcaacatgtgttaaaactattatgtaacaggcatcatgttaggccttggaacacaaaggtgaacaacatgattcctgctcttaagttgcttacaaagatcatggatgaagatattaaatgataattaaagctgattgatctaccttgtaatacataagtgttttataaaatatctatagccataatagtcattgttattattgacatgagaagaccaaacattctcatacattatttattatgtttctagtttttgtgtgtgtgtgatagtgaactgtattatgttatcttttcttgggttcattagtgggaaaagctcatattcccaaagcattttgctcacatctctattagagccccattaccttatattgtaattattgcttacttgtctcttttctactaggctggagctccaggcaagtagctctttttgtttgtttttgaatctctctgaatctagtaagttctgacatgtcttggttgaatgaattttattttacttttatagaaagtcattactaatacaaatacgagaccttttgtttattggaaacatttatctactttaaaaatatatatgtttgtggaaaaacttattgaactgtgctgcttggcttagttattttggcacatgttcacttctctggaaacaaattactgttagtccaagaaactgaagaaatggtacccatgagaataaaattaatctcaatatactgaacatctgcacctaatttgtttttcatttagaaccatcagtttaatccaagaaagcaattggtcataccttttctgggcttctcacaaaagatatctaattgttagaaatgttttgctccagggaggctactatttctctgacttctactgatacatttgttaataaggataaaaaagctttagaaatattagtatatgttaatagttatgcatgtttaatcttccaggaggttatttatttggcttcaagaagcttaagactacccactttgacaaattatatcacagtaaacacaaaaattaaagaaccttctggttgtggctgcattgtcctttttttaaattcataaataattctcagttcatctatgaaaattgaatgtttattttcagttttcaaggtacgctgtttccatgttactgatttacaaaaaggagaaagaatacctctgaaacttttcaggaacacttataccaggtaacactattaggttttcttattttgcagatgcacacacaaacacaacaaacaatccacgccccagtccccttcagctctgtattccccctcagtacatatatagctctaccataactcatcaccacagtttattggagattttgtttatctaggtctcacgcccagtaaagctatttgaaggcagtgaccatgtcttatttgatttcatagttacagtcctagcatagcttctgccacttaataaagacagtaatttatttaaggaatacatgaatgaatgaatgaatgaatgaatgaatgaatgaatcagtaaatgtgaatatcaaatagatttaatatgaagggcatggccttcaagactgttgaaatttaaatgaataattatatttattccttttcactatccactccctgcccttacaattttgcaatcaggattttttaagattttctgtgagcttaatttcttaataaacaatgctcttgtatgcctcaatttcttcatctataaaatggaataatacatcctatcttctatgtagggatgatgagtccttagatataaagcattctgtttgttggagaaatttattctcaaggactacattatcaatattattgctattagtcacactacaatgtaggtgcaaacatcaaattactgtttagagatcagcagatgtcagagatagaaaggctctttgggatcttcttgtccaatttgtccttggatgaggaaactgaactctactccttttacatctcttctctttaaaaattactgtactcacattctctttgcctttgcatatgcctggaattttttttttttaattatcttaagcatagagataagaaagaacagggcctggtgccatggctcacgcctgtaatctcagcaatttgggaggatgaggcaggaggatcacctgaggtcaggaatttgagaccagcctggccaacatggtgaaaccccatctctactaaaaatacaaaacttagctgggcgtgatggtgcgtgcctataatcccagctactcaggaggctgaggcaggagaatcgcttgaacctgggaggcggaagttgcagtgagcggatattgcaccactgcactccagcctgggcaacagagtgagactccatctcaaaaaaacaaaaacaaacaaaaaacaatggagaactgagaaaacattaggtacctaatacctcgaagagatcaaactcagtatttcttatttttgcttcagaatttttaaacaaaactatagattcacttgaagtcttccatttatcttccaaaacccttctttccctgtctcctcagtctgtcttgattttgttggtttcaattcccatgcatatgtttctacctttactttatgtgtgtgtgtgtgtgtgtgtgtgtacatgtgcacatacactattatgggtaaaccatattattttgcatctttaaattaatggtattatactgtgtgacatttaccaacttgctttttcaacttaatattatgtatttgaaacttcttcatgttgaaacatgtagccctatttcataaaagattatatccagatgcctaaaagacacatgagatggtacacaacatcattactaattagaagcaaattaaaactccaatgagatactactacatgaccagtggaatgtataaagtaaaaaagtctggcaatcaatattgattgatggtgaagatatggagcaactggagctccccaacatttttgttgagaatgtatattggtacattcactctcgcaaactatctgactatatctgccaaagctacacacacacacacacacacacacacacacacacacacacatacacacatccctcatctcaattcatgctcccagccccggtaatacctaagaaaaataagtgcctctttctactagaagacatgtatgagaattacatgatagttttatttagaaaagcaaacattcctttttttaacttctatttttccataagttattgggggtaaaagtggtatttggttacatgagtaagttctctagtggagatttgtgagaacctggtacacccatcgcccgagcagtatatgccgcaccatatttgttgtcttttatcccttgcccccattccactcttccccccaagtccccaaagtccactgtatcattcttaggcctttgcatcctcatagcttagctcccacatatcagtgagaacatatgatgtttggttttccattcctgagttactttacttagaataatagtctctaatctcatccaggtcattgcaaatgctgttaattcattcctttttaaggctgagtagtattccattgtgtatatctatacaccagagtttctttatccactcgttgattgatgggcatttgggttggttccacaattttgctattgtgaattgtgctgctataaacatgtgtgagcaagtatctttttcgtatgatgacttcttttcctctgggtagataccgagtaatgggattgctggatcaaattgtagttctacttttagttccttaaggaatctccacactgttttccatagcggctgtactagtttacattcccaccagcagtgtagaagtgttccctgaacgccccatccatgccaacatctactgtttttttattctttgattatggccattcttacaggagtaaggtggtattgtgttgtggttttgatttgcatttccctgatcattagtgatgttgagcattttttcatgttttttggtcatttgtgtaacttctttataaaagcaaatattcttaatagtgcagacaacccaaatacgtaccaacaggtgaatgagtagctaaattgtgatgtattcctacaatggaacactgcatgaatgaactgctgacacgttcaaccacataagttaatttcatagacattatgttgagtggaacaagtcagacacttataaaaaatttatttgctgttcatatcaacctcaggaacaagaaaaactaatctatggtgagtcaaatcagatttgtggttacctaaaagatgggtaatatactgagaagaatatgaataagctttcaggggtgctgaaaatgttctggatcggtgtgtgtgttggttacattaaaaggtaccagtctgtatgcttaagatttatgcactttactgtatatgttatattctcaatttttaaagtattatttaaaaaatgataaaatgttcagaacttggtagacattatttgtagggaaggtaagggaggacggaaccaagaatggttcctgacctagactgttaagcactcaggtcaaatttcccccatccttagcctcaggagctatatgaaagccctgtgtctatgctcttatccaggggttcttagatgaacatgcagcagaatcacttggagaacttgttaaaacatagacgtctgggccccaccaccagtgtttttaattcagcagggctggtgtggggccagagaatgtgcttatctaacaagctcccaggtgatggtgatgatgtaggcaacacactttgagaatcactactctattctgcttataccatttgtctttgctgcattttcaatgctattggctccataacctctagatacctatcctgttttactggggactcttttgactggtattcctagctcttgatgacatgactcatagaggtaggatatactagtccaggtacaattttgagaggaagttatcgagttcagttgtgaaaaatggaattttaggcttcggtgataatgactagtatgaattgtgatagtttgcatctccaaagtaaggtcttggctggagttattagtatacatatagaaaccatagaagtagttgaagggctcaggtatggtttatagatgggaagaggactagaaatagaaaacaccaatatttaaggtttatttacagaaaataaacttacaaaggagacagtacaagataggagaagaactagatcagagtggtgttatggagccagagggacaggtttcaagcagaagaggatccatttgtttcatcttttttactatgatgctaagatttgaatagttccttttccactaaatgactcaataaatggatggatataaatatgataagaattaaaaggcttccactggatttttcagttagaaagtgaccttagcaagagcaatggtatttagtggacacacaagctagatatatatcactgttgagtaaacaggaaatgaggatatggagacagtacgagtgattgattaatggggttattgatcaggaaaagtatggacggaagaaattgtggtgggaaaatttttaataaataataatctctcccagtataaccgtcacccactttcaataaatattaattcataaacttgtttctgtagacttcaaactgttttattatatattctattatttcatccataaatatttcagtatatttataattcatatatccccacgatatcattgtaccaaaaagaaattagtgataattctgtaatattattaaatacctaatcagtgttcaaattttcctgattatatctcaaacatttttttacagttgatttattcaaatcaggacctaaacaaggtctatacattgtatttggttgataagtcttttaagtctcttgtaatctaatagatgagagatatttgaacacgtttaaatgttaaggaaaaggagacatcaaaaatttaggagaaagaatggattattgatggatcaaagtcgctggggagatgggaacagaaaggacagtcgggtctgggcacagtagctcacgcgtgtaatcccagtgctttgggaggctgaggtgggcagatcacctgaagtcagaagttcaagaccagcctggccaacatggtgaaaccccatctctaataaaaatacaaaaattagccaggtgtagtgacacacgcctgtaatcccagctgtgcgggaggctgaggcaggagaatcacttgaactcaggaagcagtggttgcagtgagccgtgatcgcgccactgtactccagcctggtcagcagagggagactccttctcaaaaaaaaaggacagacagttggaaagtttagatacacagtaggaaagtttgttcaatgaatgagtatgctatgaacttagaatgtatctgaatattcttgacaatcaattataaaatatgaaaactggaagggccttggaaattattcttattttacacatgggaaaacaaggagttctaggttttcttttgattagagggagatgttttgtccctaaagcaggggagactggataggaaaggaaaccttaggaatataggggaccactgctgctcctctcacacctccccagaccctaacacccttggttccattaaactcctaaacttgggcttcaggaacagaggaagtgagaaagctagtgtttaatgataacttgttttttcactgcataacaaggaccttgttattttctggtgctctgcagagtaaatatagcataatgaaaaagaaatggtatctggtatcagaatttataagatctatattcgagtcataattcaaagacatttggtactctgtgaccttgagcaggtagtttaactctctaagcctctgtaaaatggagataatatttctaacatacttacatcataagattgtaagtatgaaaatacattgaaatactgattgatgtgtatgccaaagaccctgaaaggcagcaaagttatacatagtgtttacaaatatatatgagtatgaaacatctgaaaaccatataaataatctcttttgcaaatataggtactttttccaattgtatttaaaagttgatgtgattaattgatgtgattaagaaaatggcatttcatttaaaattgtagctgaattcaattctcatattttttcaatgaaccaacaaatactaaatttaaacattaaggttctactgaattttttgtaggatttttttgctgttttttaactttaaaaagagttaaactttaaaagactgagagtcaacgtaataatatatgtgtataaagtgctttatttataagtaactttaattgagaataacagcaagtaggtatagccatctagtgactttaactttctttttaaaatatatgtaactcctcagccaggcatggtggctcatgtctgtaatcccaatactttgggaggctgaggcaggtggatcacctgaggtgaggagttcgagaccagcctggccaatgtggtgaaaccccatctctactaaaaatacaaaaattagctgggcgtggtggcacgtgcctataatcccagctactcgggaggctgaggcaggagaatcgcttgaacccagtgggtagaagttgcagtgagccgagatcgtgccattgcactccagctagggtgacaagagcgaaattccgtctcaaaaaaaaattttatatatatatatatccttatacatttaaccctcagagcaacatctttttattctttaattggaaacattagatttgagttgaagaaacattatcatatacttcaaccattaatgtttctgtacccagcttctaccctttccggctctgtcatttgctcaaacaaatctgtcttatttaaatcaaaagagttgcatataggcacttttgataaagagtctttaaccttgaaattttattgatttcgacttttgtttttaaattatttttattgatggtttccttttttttttttttttttcctttcaagagagagtctcgctctgtcacccaggctggagtgcagcagcacgatctcggctcactgcaacgtctgcctcctgggttcaagcgattctcctgcctcagtctccgaagtaacagggattacaggggcctgccaccacgcctggataatttttgtatttttagtagagatgggtttcaccatgttggtcaggctggtcttgaactcctgacctcaagcaatccacctgcctcagcctcccaaagtgctgggattacaggcgtgagccaccgcgcccggccttattgatggttttccttgtcaaaacattatttaatcaaaacagatgaaagcatgtagggagagatttcttttacaaacatattttgtgcttctttgttttatattatagggtacagaaatgacttatttgttgttgttgttttcatgatgcacaatgtgacctaatttacctaggcttactcttttctcagttctcgtacttctgtgtttctctgattcattgatatattgaccacttgttcatttcagaattttctctggactttgatactgcagtaacttatttttctgctactcctttgatagttcattgttttctttattaactcctttcctttaactcccatttctgccccaagataaaagtctttctatatattctacctttcagaggtctcatctacttctataagtttcggctattttccctcaaatatttgtctctagccctagcctctccccttattccagacttatatttccagctatcttctagaaatctctacctggatatcttcccaaaatctcaatttcagcatatctgaaacaagaccttaccttttaacctgtaatcagtcccgtcatctgatttttaaaaacaatttattgaggtgaaatacacatagcataaaattaaccctttttttgtggggggagatagagtctcactttgtcacccaggctggagtgcagtggtgtgatcagggctcactgcagcttcaacctcctggattcaagtgatcctcctgcctcagcccccaagtagctgggactataggcacgtaccactacgcccagctaatttttgtattttttatagagacaggggtttcgccttattgcctgggctggtctcaaactcctgagctcaagctatcagcccgccttggcccaccaaaatgttaggattacaggcatgagccaccgcacccagacaaaataaccactttaaagtgagcaattcagagaaattttgtacattcgttatgttgtgcaaccactacctctatctagttccaaagcatttccatcactctcaagtaaaaccacttatccattaaacagtttgtctccattgccctctctccctagcccctggcaaccaccagtatgcattctgtttctatggatttatagatatttcatgtaaaaaggaatcatatatgacctttgtttcatgcacgtctgtgtaaagagaccaccaaacaggctttgtgtgagcaacaaggctatttatttcacctgggtgcaggcgggctgagtctgaaaagagtcagtgaaggaagatggggtggagctgttttataagatttgggtaggtaaaggaaaattacagtcaaaggggggttgttctctggcgggcaggagtgggggtcacaaggtgctcagtaggggagcttttgagccaggatgagccaggagaaggaatttcacaagataatgtcatcagttaaggcaagaataggccattttcatttcttttgtggtggaatgtcatcagttaaggcaggaaccggccatctggatgtgtacgtgtaggtcacaggagatatgatggcttagcttgggctcagaggcctgacattcctgtcttcttatattaataagaaaaataaaacaaaatagtggtgaagtgttgggacagcgaaaattttgggggatggtacggagagataatgggcgatgtttcttagggctgcttcgagcggaattaggggcggtgtgggaacctagaatgggagagattaagctgaaggaagattttgtggtaaggggtgatattgtgggactgttaggagaaacgttcgtcatttagaattactggtgatggcctagatacggttttgtatgaattgaaaaactaaatggaataagagaaggagaaaaacaggtattaaaggactaagaattgggaggacctaggacatttaattagagagtgcctaaggaggttcagcatagttctgccagcaaagattatttatttacttcaagagttaagagtggcagtttggggatagctccaggagatatcagctgtgatggcttggagaaacagtgtaaaccagcagtgtaaacaagagcagggcatgtgtgagtagttgagaacagtgaataggagtatgattagacagaagatagtagggatgacaagttttttggggcacagtccaagttggtcttggaatgatactggggcctaataaaaaggagcatctatacaggagcttaaatgagctgtaccttgtaacattctgaggacaggcctgaattctgagaagggaaagtggtaaaagtattgtctagtcctttttaagttggtggctgagcttggtgaggtgtgtttttaaaagaccgttagtccattctacctttcctgaagactgaggaccgtaagggaaataaaggtttcactgaataccaagagcctgaaaaaatgcttggctgatttgactaataaaggccggtctgctatcagactgtatagaggtgggaaggccaaaccgaggaattatgtctaacagaagggaaaaaatgaccgcggtggccttctcagaccctgtaggaaaggcctctacccatccagtgaaagcgtctacctagactaagaggtattttagttttctgactcggggcacgtgagtaaagtcaacttgccagtcctgggcaggggcaaatctccgagcttgatatgtaggaaagggaggaggcctgaacaatccctgaggggtagtagaatagcaaatggaacactgagaagtgatttctttgaggatagatttccaggatggaaaggaaatgagaggttctaagagacgggctagcggcttgtaacctacatggaagaggttatgaaatgacgacagaatagaatgggcctgtgaggctggaaggagatattttccttggtctaagaaccatttgccttctgtgggaagagattgataggtggaagtttcagtgggggagtaggtgggagtgactgacgtgaaggagaaaaactggctgtgagggacagaagttggaatgctagctgcttgtctagccacctaatcagcgtaagcgtcgcctagagcaatgggatctgatgccttttgatgccccttgcagtgaatgactctagcttcctttggaagttaagcggcgttgagaagcgtttttattaaagagggattaatgatagaggacccttgtttagtgaggaaacttcttgcatggtggtgcacgatatgaaaggcatatttagagtcagtataaatattgacgcatagtccttttgcaagagtgagggcttgggttaaggcaactagttcggcttgctgagaggtagtggaggggggcagagcggtagcctcaatgatagatgtggaagatactatagcatagcctgcctttgctggtgagtggcatttaggcctggtggaactgccatcaataaaccaaatgtgattagggtgaggaacaggaaagaaggaaatacggggaaatggggtgaatgtcaggtggatcagagagatacagtcatgagggtcaggtgtggtatccagaataatgtgggaggccgggttgaagtccgtgccaggaacaatggtaattgtgggagactcaacaaagagtgaatatagctgaaggagccagggagcagagagtatatgcatcaggtatgaggaagaaaatagattttggaagttatgagaactgtagagagtcagttgagcatactttgtgatttttagggcctttaaaagtattaaggcagcggcagccgctgcatgcagacatgagggttgggttaaaacagtaaggtccagttgtttggacagaaaggctataggacgtggtcccagctcttgtgtaagaattctgaccttactaaccatgcctaggaaggaaaggagttgttgttttgtagaagggattggggtttgggagattagccggagacgataatcagggagagcacgtgtgtttttatgagaattatgctgagataggtaacagatgaggaagaaatttgggcttgactgaagtaatgggggctgtctgtgaagccttgcagcagtacagcctaagtaatttgctgagcctgatgggtgtcagggtcagtacaagtgaaagcgaagagaggctgggatgaagggtgcaaaggaatagcaaacaaagcatgtttgagatctagaacagaataatgggttgtggagggaggtattgaggataggagagtatatgggtttggcaccacggggtagataggcaaaacaatttggttgataaggcgcagatcctgaactaacctgtaagccttgtctggttttaggacaggtaaaatgggggaattgtaaggggagtttataggctttaaaaggccatgctgtagcaggcgagtaatagcaggctttaatccttttgaagcgtgctgtgggatgggatattgacattgagcagggtaagggtgattaggttttaatgggatggtaaggggtgcaggatcggtcactaaggagggagtaggggtgtcttatacttgtgggttaagatggggagatacaaggggaggatgtgaaggaggctttgaactgggggaaaaggcagcgatgaggtgtggctgtagcccaggaatagtcagggaagcagataatttagttaaagtgtcggcctaataagggaactgggcaggtggggataactaaaaaggagtgcttaaaagagtattgtctaagttggcaccagagttggggagttttaagaggtttagaagcctggccgtcagtacctgcaacagttatggaggcaagggaaacaggcccttgaaaagaaggtaatgtggagtgggtagcttccatatcgattaagaaggggacggacttaccttccactgtgagagttacctgaagctcggcgtccgtgatggtttagggggcttccgaggcgatcgggcagtgtcagtcttcagctgctaagccgagaagatctgggaaggagtcactcagagagccttgggccagagttctaggggctctgggagtggctgccaggtgagttgaacagtctgattttcagtggggtcctacacagatgggacacggcttaggaggaatcctgggctgcgggcattccttgtcccggtggccagatgtccggcacttgtagcaagcttcttggggaggaggttctggaggaactcctggctgctgtggttcaggtgtttggaagttcttgtgtgctggtgatgtggctgggatatgtctcacagtggaggcaaggaattgcaacttttttctattattgtacaccttgaaggcgaggttaattaagtcctgttgtggggtttcagggccggaatttaatttttggagctttatttaaagtcaggagctgactgggtaatcaaatgtatattgagaataagatggccttttgaccttttagggtctagggctgtaaagcgtctcagggttgctgccaaacgagccatgaactgggctgggtttttcatatttgatgaaaaagagcctaaaggctaactgatttgggagaggtcggataaagaaaaaggagcattaaccttgactatgcctttagctccagccactttcctaagaggaaattgctgggcaggtaggggagggctagtcgcggaacaaaactgtaagccagactgggtgtgaggaggggagatgatagaaggattatagggtggaggagctgaggctgaggaagaattgggacttagctcggcctggcgacaagcagcctggggaggaggggaaaggtcagatgggtctgtagaaaaggaagactggaaagactcagcgacgcttggggttgggactgaggggacagccaggagggaaagaaggaggattggggaggaatcacattgggaacagagactagggagggaacaacgtgtagaagaatgcctggacgtcaggcacctcagaccatttgcctattttacaacaagaattatctagatcttgtaggatggaaaaatcgaaagtgccgttttctgtctatttggaaccactgttgagtttgtattggggtcaagcggcattgtagaagaaaataagttgtttaggttttaggtcaagtgtgagttgaagaggttttaagttcttgagaacacaggctaagggagaagaaggaggaatggagggtggaaggttgcccatagtgaaggaagcaagcccagagaacagagtagagacacggagggaaggggtttgggggttcttaccttccagaaaagcaggaaaggggtcggggcatggagatataaggggttggggtgcagagataagaggtcagggcacagaaataagggatcagggcgcagagataagaggttggggcgtggaaataagggatggggtgcagagataagaagtcagggcatggaaataagggattggggtgcaaagataagaggtcagggcatggaattaagggatcggggcacagagataagaggttggggcatggaaataagggatcagggggttcttgccccctagaaaagtggtacttgccactaagggtgaaggagaaggggttggggggttcttgcccccctgaaaaagcagagaaggggtagagacacagagagaaggagttgggaggttcttgccccccagaaaagcagtacttgctgctaagggtgaaggaccaaggcaggcgtccccgtgtggtcagacacctctgaaacgtgggtgagtaatcaggcagtcgtccccacgtgattaaacaccaagggaagactgtcttccctagtctgtgaccagcgccggagttttgggtccacggataaaacgcgtctcctgtctctaccagaaaaggaaaggaactgaacttaagagaagggagagattgaagggtggtaccaagattgaaaggagaaagtggttgagggatagtgagagaggttggagaagagattaagaagaggcggcttacctgatttaaaattggtgagatgttccttgggctggtgggtctgaggacccgaggtcgtaggtggatctttttcacggagcaaagagcaggaggacaggggattgatctcccaagggaggtccccccgatccgagtcacagcaccaaatttcatgcgcatctgtgtaaagagaccaacaagcaggctttgtgtgagcagcaaggctgtttatttcacctgggtgcaggcgggctgagtctgaaaagagagtcagtgaaggaagatggggtggggccgttttgtaagatttgggtaggtaaaggaaaattacagtcaaaggggggttgttctctggcaggagtgggggtcacaaggtgctcagtaggggagcttttgagccaggatgagccaggagaaggaatttcacaagataatgtcatcagttaaggcaagaacaggccattttcatttcttttgtggtggaatgtcatcagttaaggcaggaaccagccatctggatgtgtacgtgcaggtcacaggagatatgatggcttagcttgggctcagaggcctgacactttgtgtctggctttttttcacttaggataatgtttttgaggttcatccaagctgtcacatgtatcagtacttcattcatttttatggttgaataatattttcttttataaaaccagtgacactatatttaattattaaattttttaaatgagtctagagtttaaaagacagtttgttaggtgaaattaagtgatttagaaaggaaagagaaaataacagaggtagtatattagaataagcttctagttgacaatatatagctaacatatggatgaataatattttctgttgtgtgtatataccgcaatttatttattccttcatccaagtgctgtttccactattgtgaatagtgcttccgtcaacgtaggtgtacatatacttgtttgagtacctgttttcaattccttcatttgattgtccttcatcaacttatggtactgtattcttttagtcactggagtttaaaaactgcatggcatgtagtaggtgctaaatatatgttggttgaatggatttattaaattaatgtgttgaattgttatcattctcttctttcccctttacctcttctgtctaatcacatgttaattcaattatagacttaactctgccacaaactgtataacattgggcaaaacacaactatatgcttagttttatatgcttagtcttctgtagacctctataggccctctacatactcagtcttctgtaaaatgactttcttgaaccacaaacataaagtcaaagacaacctgggaaatacatcttcacttacaacagagggcaaatatgaattgctccttggaattggtaagcaacctagagaaaaatcagcagtcagtttacattaaaagaaattcaaatgaccctcaagcatatgaaaatatgttcaaatatacgtataaaagtcatgcagattaaaactgtgctaaaatattttttctcacctattgcctcattgtgttggtgaggctgtggataaataagttttttcatactctgctcctgggatagttatctaaattgcaaatgcatataccctttgaccaggcaattccatttctggtaatttatcctaaaaataagcctgcacaagtgaaaaatgatatatatagaaggttttttatggcagcaatatttacaaaaacaaggttggaagcaacccaaatgcccatcaaaaggaatctggtttaaaaaatatggtacatttatacaatggaaaactagggaactgtgaaaagaatgacgatggtgtctattaaaatgaaaataccttcaagatgtattgttaagtgaataagagatgggttaaaaataagagtatgtaaaattaagactataaattgctaagaaaatttaaaaaataaacaaggccaggtgtcatggcttacacctgtaatcccagtaatttgggaggccaaaacagggggattgcttgaagccagaagtttgagaccagtctgggcaacaaagcaagaccctgtctctacaaaaaaaaaaaaaaaaaaaaatttagccggccatggcaacgtgcacctgtaatcccagcttctcaggaggttaagtccaggagtttgaggctgtagtgagctatgattgtgccactaccctctagcctggacaacagagtgagaccgtgtctctaaaaaaaacagaaataaaaaaccaaaaaggttaagaatataaaaactttctaaagacatataagaaactaataaaataatttatccagagtgagggtagaggaaggaatgatgcagactagagcagaagtaggagaaagcttttattatgtacctctttatattattttttgaaccatctgaatgcattttatgcaaaaattttaaggtaaaagtaaattattttaaaaatgatggcagcaaaaaggttaatagaaatagacatgtttgagcaagactgggaaatggcagaaaattccaagggaaagagatagacataaggtaacttcaagtttacaaaggatataatgccataggcaacaagcaccagacaaattactctagtgcaaagaaaagtaattaaactgtgcagcaacatttaaacagctgaagcataagtaaaatattagcacaggagaagaggcagtagaagaattagattttatgtttaacacattaaaatgaaaagattttaattaaagctgttatttaaagctacaaaaacattttaaatgaagaatatatattgtaaatcacatccattctttatatattctcgacctctacttcagtctttctataaaaccaacacatgtacattccatccatgtcaagaaaagtcattttttatcttagtgacttacatggtgcaacatatgtatgaaaacaactttagatctgggatttgactgtgttatgtaaatgaactaatattgttaaagtgacagtagaactcccataatcttgtctgaaggtaacagactgccatgtatcaaatattgtcattgtttttcttcaactctttttgttatataggtaagacatgttcactgtagcaaaaaaaaaaaaaatgggttttgtgccattactcataccttttgctttagttagttaaacattttcagtggatactactaggcatctctgtggctgtatccactcattagtccattttaaaacaatttaataagtgcccattctaccacaagctatgtagcgaatgggtatctgaagagtaagcaagtagtgatagtttatgagtttttgactgttggtatgcttccaaaagaaggcaccaaaagacatttgtgatgcccacattacttagaaatgtagggaaatcttagtatttgaaactcttatgtcctagaatcttaagaaacctctggattgagatggtgatgttaggcagctcttgcagttgacttcaatgctagctaggctactttctccaagcagtgagaaagtcctaaagagtcttgcttcattttattccaacttctggagtttttaaaccagcattgtttgtgttcttccatatgtagaaactatctctaaacctatcctctcattttccagtttagaaggtgctttcagatatttaggatcttattagttactttcaaattagtattccaatcaaaacgagttgaaataaaaacctgtctgtcctttaacactttgattatagtttatgtacttctatttacatgggtaaaatgtatagtcactaggaataacatgtcaacacatcttgattgaaatcgccactttgaatttttctatcatgtttctagtatgaaaaaaaacttcatttagcttcatagtagcttcatagcagttggaatagttgtatattatgtgttttctgtatacataaactgaactataatttgaaaaagttcttcaaggtcaccttgtcacttgcagagtgacaaattatcctgatttgctgattctcatcttagtgttcctgatactgctgcactgggagaaaatttacatactttcctaaagcttactttctcagacttcttgttcttctggccttgagtaattcccagatccagttttcctgtcaaacctccaaagaagtactgaagggtttctttctcataggtcagattcaggatttgaacccaaagcttctttctttaaatacactgttttttctttatcatacctctcaaacatagtagagcagccttgaagattttgttttaaaatctacatggctgtggaattttgttttaaatatgattatgtttcctacaatcatcttcattttctaatcatcttcatctcttctctgactcccatttttaccaagtcatgaaaatacaagcatctgctttccatgaatagatcagagatctcacaagcctagattcccatggaaaccaatcaaaaactaaaaggaaaagaaagagtatatattgaatttcgatgaaacctacagcttgtttttcattagactcatgctggtttcttttaaactctgggcacagggccagcaaatatttttatggctggtaaaaagggacttcaaatccatttactttcatttaaccgtttaaaaattaattttgtatataacatcaattctaaagaaaatttgagcattaattttctaattaccttatgtcatagggccattatttgtttatgtaatttcctcttcttgttttttctcctacccatagtttatgactcataaaaggatgagagggaatcaggatgattattattcctatagtgtgaatattgtcaacacttgggcacgacatttttcctatgaccaatcataggaccaataaaggaggtctctttgtacctcctttagctgttaagctttcacaaggtgcaaatgatcatttacaaatgtgacaacagatgataactaaaatgccaaagtgagggggattaagagaaccagagaggggatggctggggaggacaggttgtaattttaaattaagcaatcaaaatagtattcagtgagacaggttgtaattttaaattaagcaatcaaaatagtattcagtgagatggtgacatgtgaagcaagacttaaaggaggtgagaactttagccatgtgaacacctgagggaagagcattcattccaggcagaagaaacagtcagaacaaaggccttcagatgggagcatgcctagaatttttgcaaaataacaagaaaattagtataaattagtcttcatgcctttaatcccagcactttgggagaccaaggcgggagggtcacttgagcccaagagtttgagaccagcctggtcaacatagggagactccatctctacaaaaaaatttttaaaaattcgccaggcatggtggtgcatgcctgtggtcctagccactcaggaggctgagatgggagtatcacttgagtccaggaggttgaggctgcagtaagccataatcacaccactgcattccagcctggacaacagagtgagaccctgtctaaaaaaataataataaatatatatataccttataatgaatgagcaaaaggaaagcgctaagagatgaagaaagagaaagaatggtggcctgatcctgtagggccttataggccattgtcaagaatatgttttcactctgaatgagatgaggagggtttgaggaaagacgtgacatggtctgacttatgtatttataaaagaatcattctggccaagtgaagacattttcctccagttttagtactatctattccttcacccattcctcatataatatgctttcaagtttccttctcatcctgatcattttcaccagatatgcacatatttgtctaaattcccttgaaaatgtgatacctacaacagaatacaatgccagtctgatgagctcagagtgttacatgactataactgttgacattttagcaacaaaatacagctgattcatatttaagatttttcaaataaaaactctaaatctgctttatacttacaactgcctaaactacgtcctatattaatatggccgtggttgttggacccaaaggcagcatcttattgtatccatattttgaactttcccagacatacttaggtaaaattgaccattgtatcctttgttcctccagtaccttgtgtactcaaccactgttataccaccttttacactgaaatatatttatttgtttacatgttttatttctccacagatgatgaacatcttaatatgtaagagtgtcttagtcatcttatttccaatatctagtagtacttaacgacactcaatcaatgcttgctgaattgaattgggttcatcatgtaacctacccaggtcctcttgattcttgagtcggccattcagtatagttgtcatctctcccacttatgagtcaccaagattctcatcctaatctttgatattaaaatagatactgcttatagaaaaccttaatcattgaaacactagtactaaaataaacttcactaatttaaaaagttgttttattcatttattatacttgtctaaattatgtcgtcagtattaactcagcctcttgaaaaattttgtataatctatcagaatccacttgctcaccattccaattctgatgggtatgtcattcatttattcattcattcatttgttcaacagataaatttttagtatttaatatgtatcaggcattacactatatctcaaagtattttaaattcaacctttgtctaaatatgtggtctttcagattttataatagtaaaattaacatttcaccaatataactactcattttcaggcaatttattagacatatactcatagtttatcttaaacaattacagatttcagaagatatggtttgggtccttttattcaagtctttcctgtcactttgtcagtcatctcttttcaagccattttcttttaaggaatttgggctgaaatattagactgtactttgaagtaatgactgtaaacttcatgtatgtaactttggttatttcagtgttgtacagattgttaactaattgtgtgtgtgtgtgtgtgtgtgtgtgtacaggtgcacacaggtgcatgctttaaattgttatttaattggattataatgcttacacatattgtaaaatgttaaacataccaagaaggtttgcagtgaagaatctcggtgtaaggaaaactttctatctgcaagtcaaaatatagaagtgataggaaaaagactaataaatatggctacatagtgataagaaagactttttccttccagaaaatgtggcaagcaaagttaaaaaaaaaaaaagacaaattggaaacaatatttgcaaattatatcattatcaaaggtttaatactcctcatatataaggtggagaagaaaaagaccaatgatcctataaaaatgagtaagagtatatctagatagttcacagaaaaggaaatggcccttcaatatatgaaaatatgctcaatattgttcgtcataaaagaaatacaaattaaaatcacaaagagataacatgcttcatgtctcagattggcaaaactccaaaagtttgacaacatgttctgatggcaaaactgtagggaaatgagcattcacatatccctgaaggaaatggaaatggtttccttagcctgttttgtgttgcaataacagaataccacagactgggtaatttataaggaaggaaatttatttctcccaattctggagactgggaagtccaatatcaagttatcagcatctgctgagggacttcaagctgtgtcattccacagtggaaagcagaaggacaaaagagggcaagaacaagtgagggaaaagggggaccaaactcacttatatcaggaacctactcccatgaaaacagcagtaatccattcataagggcagagccccaatggcctaatcacctgttagggatcccacctcgatactgtcataacgatgattaaatttcaacatgaattttggagggacattcaaaccatagcattggtataacgcttatggagggaaacataacaatatccagcaaaattaaccagaatatgcatttacctttgatctgtcacttctgggaatctattctatacatatgtggtaaaaacaagaaatgtatacacagggttatttaattgcagcattatttgtagtagagaaagcttgaaagcaaatgcactttttttgttgtttttgtttttgagacaggatctcactctgttacccagactggagtgcagtggcacaatcatggctcactgcaatctcgacatttttgggcttagtgaatcatcccaccttaggctcctgagtagctgggattataggtgtgtgccaccacaaccgactaattttttttttttttttttttttttttttgtagagatgggttttcaccaagttgcccacactagtctcaaacttgggctcaagccatctgccctcttcagcctcccaaagtgctgggattacaggtgtgtccaccgtgccctgcctgcaaatgtacttttagagagctggctacataaaaagagtatattcacacaatggaatgctatgcatctgtaagaagtaatgagaaatgtttttatataacattataaaatgatctggaatgaaaaaagcaagcgcagaatattgtgtatgatattctctattttatatataactatgaagtgacctccaggtttattgttaagagaaaaaagtaaggtgctaaagagcatgtgtaaccttttttccaggaaagaggagaaaaatattttcttatatttttaaaagatagaagagtaaatgaaaaatgaatgaagactcttacctaaagggagaaggagataatgtagaggacacagggatcgaagctagtcttatctgagtatatcttgttctatagttttgattttggaacttcgtaaattatttccataattataaagtttaagtgtctacagcctggatgcagtggctcacgcctgtaatcccagcactttgggaggtcaaggtgggcggatcacttgaggtcaggagttcaagaccagcctggccaacatggtgaaaccccatctctactaaaaatacaaaaattagcagccaggcctggtggcacagtaatcctagctactcgggaggctgaggcacaagaattgcttgaacccgggaggcagaggttgcagagagccgagatagtgccattgcactccagcctgggcaacagagtgagactccatctcaaaaaaaaaaaaaagaaaatgagcagtccttaaagattgatagacaaataaaacaaagacacctgtgtattaagttggtagcttaactgcagagagaattattcaagtgaatttattattttttatttttattttttatattttgagatggagtctcgctctttcacccagggtggagtgtagtggtacaatcttggctcactgcatcctccacctcccaggatcaagtgattctcctgcctgcacctccctagtagctgggattacaggcacgcaccaccatgcccagctaattttttgtatttttagtagagatggggttttaccatgttggccaggctggtctcaaactcctgacctcaagtgatccacccaccttggcctcccaaagtgctgggattataggcgtcagccactgggcccagcccaagtgactttaaaacatagtaaatttgactctgcagtcctggtaggaaacatcctaaggacaaagacagctacaaagaaatcctaaaatgtgttcagtaaacatactgttagtaataatactgttactgttatcttgacacaacacaaataagtggatcactatataaaggtaagatgaagcaagtgaatatgtcaatttcattagtaaccaagattttcaataagaagtatacaaatataaactattgatatatgtgtctgctaaaaatttatatttctgaatttcatagcactagctactgaaaaagcctagaagtaatgactaaccccatgaaggatcacctccatcacccagattgtgtctctcaataccactaaaaggaatcagaactccttagagaagtggctgcttagaaattgggacaagtaatatatgaaatgagcctggctcatctggtcatgctggatggcaagatatctaacaaagcctactggagtcatgtcaaagggccacagaagccgtgttaaaggagcttccaaagatggacaatttgagtagcaaaaatacagttgcttcaatggaaacaaacatgttaaaactccatgagttaggaatactttttttttttttttttttttgagacagggtctcactctgtctctcagtctggagtgcagtggtgcggtctcggctcactgctacctctgtctcctgggttcaagcaattctccagcctaagcctcccaagtagctgggtttaaaagcatgagtcactgcacctggctattttttttgtatttttggtagagatggggttttgccatgttgcccaaagtggtctctaattcctgacctcaaatgatctgcctgcctcagcctcccaaggtgctagtgtatttaaaatacagttgtttttatgtgtttcagtttaacttcccctccttcccatccttattgatttaactttttcaaaagttgaaactacatgaaaagataggtttacaagtttcagtcacttccatgtcctgtctgtctcattttccctgtcttttgaggacaatcaactatattgatttctggtttacccttcatatgtttcatatatgtatgtttccttgttgcctctttttcttctaatatatgctcttgtgcttcagatagtattaagatttttaaaccagataaaaaaggaagaaaaaagcagtaaaagtttacatgttccttgactctagattctgtgactagaaatggaccttataaaccactcaaactaatatatatgtatatatacatatatatatatacacacacacacatatatatatagggatattcattcatcattgtttataatggcaaaatacaggtaaattattcattgttaaatataatctatttttcatacagtggaatactttttagccactttaaaaaattaatctatatgtactatcatggaaagatctccagggtatactgttaactgaaaaaaaagctagctgcagaagaatatgtatagtagaaacctgtttttataaataaataatttttaaaataaccacagttatacatatgtatcatatagattgcaaaaatttaaagaaatagtaaaaatttcttttttttctttttttttttttttgaggcagagtctcacactgttgcccaggctggagtgcagtggcacaatctcggctcactgcaagctccgcctcctgggttcacgccattctcctgcctcagcctcccaagtagctgggactacaggcgcctgccaccacgcctggctaattttttttgtatttttagtagagacggggtttcaccgtgttagccaggatggtctcgatctcctggcctcgtgatccgcccgcctcggcctcccaaagtgctgggattacagcgtgagccaccgtgcccggccaagaaatagcagaaatgtcttatagtggtattatgagaaaactcatagtttaaattataggaaaacattttcacaagaggcatgcattattttagtctgaaaaaagttcaaaaacagactttttaaaaattctaaattttattttgagccagactttcctgccacccttcaatggtgacaattccttgcaattcctgcagttccttacatgttttattttctttgaaatttaactgagtttcagatctttggcttcaaagaggagactaaatcctgttttccttcatttcccaaatcatttttcattatctcctacaacaaaatgctaccttttctgacacttttatggtctccttttaaatgtttctaatgcagaagaagcttacttgttctcaccacccatttgttaaatttattttcatatctcttagtatttcttaatgtggtgtatatcacagaacatttgtcactcaataagggcatagcatatccaatttttcattccagtttttattattctgccatctgtattgcttttatttgggaagtttcctatttgtaaagaatgatagtttttctttcctcttagtagatctatcttgtttatattctcatgtttagtgaagacctcataggatatattttagctgatcaggggaattctattatctcttttctgtagcataaatattacattccattcttaaaatattgatttgattggtaatgcaaaaagctttagcactccagaaaaaaatatattttcatttataactttcaatgacagagttcttattacacttcaattctctaagtatattgaataaagagtagagaattgttcttggagttggacctatattgattctagtccctgctcatttatttattagctctgtgacatttatctctttaattctgagtttcctcatctgaaaatgagaataataatgatacctatattaccacattcctatgagaatgaaatgaactggtgcccacaaacttcttacttagctcagttcctggcaccaaaatagtgcccagtgaatattaactattataattatcatctagtccatgctctggactaaatactttggggaatacaaaggtgagcaaagttaactctgatggagtagatgagctgtatttatgctatagtttgaatatttgtcccctccaaatcccgcgttgaaatttgatccccagtggttggaagaggggcctaatgggaggtgtttgggtcatgggagcagatctctcatgaatggcttggtgccagaggtaatgagtgaattctcgctctattagttcatgtgatagctggttgtttagaagagcctggcatccttccccgttctctctctccctctctctctcttgcctgctgtctaccatgtgacatagctgctgctccttcaccatcccccatgattagaagcttcctgaggtccttattagaagcagatactggcaccatgcatttagtagagcctgcagaaccataagccaaataaacctgttttttaaataaattgcccagcctccggtattcctttataaaaatacaaatggactaagacaatctacaaagaattcaagtataaggtagaatgcatatgtgctagagaagaatacaaacaaaatggtatggaaagatagaggaagggaatattcaatgagaagttttagggaaggtttcatgaaggagagagaatttgaactagatattgaaaaatcagaattaattttcaaaggcttggagataaatagtatattctgcagagataaccaagtaaatgacatacagatagtcaatggctctgagtggctctactagctacatctttttatgttaataggttttttacttttttcagagaaaattatatccagcatttttaatctttagactaataacaccaggtagacacaaagctattcctggaacattgctttattatagataggaattccataaccaattacctcctatttgctagaacacactaacacaaatacataaaaaatacagactaaactataatagaaggcagttttctctggtgtttgtagcacctctcttctactaatttaaaatatcttcatcactgaggatgcctcctattaaaatgttatatctgagttatactaataactatgaaattaccaggtgtctctgcttgagtagttggaattaatttttttgcctcataactctggagacttctcagaaagtgtagctaaaggtttattcatcaaaatccccttctaatgaatcgactctgatgattctgctgttgtcagaatggatgttctaggaagttgtcatcacacttgaccgtaatgaaaatgctgccctggaccatctccccaaactatgtgtcctcagtattgtgggaagaacccacttcatgatttctaaccagggtagcctctggaagtacaaatgattgctgtaaaattatgaacagagcagcatcaggctttgctctgatgtatcttatgaagcctttctacttccaaatgaagactatgaagagaaccttgaaacaatgcccttctgggagctcattcagcaagcatattctgagggcatattctgttccactctctacgcatggaggattcttgtggtgaggaagacattcttcattggttttaaagagctcaccatttagcacagtcagccgctgagacaggactgctagataactacagaggttatgcattgcaccatttgtacacctcgtacaaccctatgaggtagccctcagggttcaaatggaatgcatctatattttgaatacagagtgatatataataacaagaaatcctggatgtctaattgactgtcttcccaaacagcatagcagattacctttttagtctcatcatttatgtgcagattatgaaacacatttattagtcaatagagtcccttcctgcatttatacattctcctcataactcagttgttctacttcacttccataaggctgacttgcaagtctgaatttatagttgtgttctctttcctaaatttagttcagttatctccctccataatttacatttaaatatcccactgtaacctaaaacatagcttcctttgttaatttccccgttgttacgaagaaaagtattattcctcagtaatttgggctcaaaatattaccctaatctttgactccttctgtcttcctcagtcccaagacacatcaaaggctgatcaaagttagccgggcatggtggtgggcacctgtaaccccagctactcaggaggctgaggcaggagactcacttgaacccgggaggcggaggttgcagtgagctgagatcacaccactacactccagcctgggtgacagagtgagactctgtctcaaaaaaaaaaaaaaaaaaaaaagctctgttgatcttgtttgtcaatcatcccacatttattgttttcttcccattccctttactaccatttagtctaggcagttgtcttcttatgacaaaaatttcataaattggctgggcatggtgtaatcccagcacgcctgtaatcccagcactttgggaggccgagttggggggatcacctgcaataaggagtttcagaccagtctggccaacatggtgaaactctatctgtaccaaaaatacaaaaattagctgggtgtggtggtgggcacctgtaatcccagctattcgggagactgaggcaagataatcgcttaaactcaggagacgagatcgcaccactgcactccagcccagcctggacgacagagcaagacttccatctcaaaaaaaaaaaaaaaaaaaaaaaaaaaacctcataaattgagtgttgtgctccaaaagaatttgaatatgatctactttaattttgtcagtctgccagaagtgggccttataattcgttccttaggagaactcacgaaaggtaggaaattgaggaaatttgggtgttaggaaggttttgaagttagtttacaaagaacataattggagccccagtgactaagaccataatgctgttgagtggctggccagatggatggatggatggatggatggatggatgggtgggtggatgaacatcaattttctagaccttggggcagaaggttaggattggattgcaggagcaagacagaaaactgaattacattatctggtcaggcttcgcttaggttgatttaactcttgctaatctcactaatgagttagacttaaatcttgccttgattagagtcaaggtaagccccaaaactgaaggaaggagagcataccctacagatagagaacttcaactgggaaaattggaaggtcacaaggaccccagaagataattatcaatcccattcattgtttgtcaactaaaaaaacttcaaactaaaacctccagagtaataaacagttagacttcctgcaaggagcatctcacacagaagatagagcctggaagaaaaggctgggaactgacatgaagcaccatgtaggccacaaaaaggagccggaaataatagactaaatggtataataataagtaacgggctggtagcacaatcaactagagttcagaaatgcagtctatgctctaactgatttcctttcctgaaatatttcatatttgcttgggtggctctatagtcatttgggtccatcatggaaatttgtatcattaatacacattttctgttaatacgaataacataaaagtggcttagatgacaagcacatctattattttacacatcaagcagtcttacataacaagaggtaatatccagggttgattaactcagtggctcaatgatattagcaaggacctgggtttttaaatctttattctccgctgtaatcaggatgttggcttatactcttaagctagctttccttggagttaatttcaaggtggctgcctaaatttcaggcattgcatatagaccacaatatctagaagcagaaaaatcaaatacccgtatcttgtttatcttttcaacatggaaaatcttctcagaagccctgtggcagatgctctttccattcctttgattcccaggcctaatcctatcccttggcaaggaaaatgaaaacttcctgattgctatgtcattcaaagtcaccttggcgggcaccagtaatcccagctactcaggaggctgaggcagagaattgcttgaacctgggaggcggaggttgcagtgagccgagatcatgccactgcactccagcctgggtgacagagcaagactccatctcaaaaaaaaaaaaagtcaccttctgagtttggcaaggacccagccttctctgaaggacatatctacttaaaaggagaccaaccaatatcagggttctgttggcctaaaagcctagaagaggatgggcatatatattagccaggcaatccatggtgtcagccacaatgtctgttggacacttacagagccttgtgaacctaactactttcaaaagcaatggccataggctgtaggtcaccttcatggaattccatctagtggcattgccctttagctctaggctacaagaaaaccagctctacagactctttcttgccactggggtgaccctaacttttaccctaacttgatgttctttctatttttttttttttttttttagcaaatgtgcatatttcctcccaaatgctcccaaatgaggaaacagtcaaatcacttagctgttccagtaacaaacgcgggcaccacctcacatgttgttaccccacaaacttaactgagaagtgtagtgataaaaagcaatcatctagtctctgaattcagaatttaaaaagcaatgatctgaaaattgaaagaattcatttaataacaagatatttattgagcacctactaatcataaggtactgctctatatatgtgggatatagcagtgaacaaaacaaaacaaaaatccctgacttcaaagatcttacattttgttggtgggaaacaaaccaataaacaagcgaatacatttttaaagtatatattatatcagatggggatacatgctatggaaaaaaaataagacaggtgagggtgatagggagtgtagggatttgcaaatataaatagggtgatcagggtagacctcacttaagaaagtaatatttaagcaaatacttaaagattatgaaggaacaaacctttctgggagagaatatgccaagtgcaaggtccagaaatgggcacgtgctttgtatttacaagaaacagttagcaaggaggccactgtggctctagtcaagtaaggatgagttcagagatcacagaaggcctgtatgctatttaatgattctacttttacgctgcacaagagggtatggttattgaagtgtttgagcacagaaaatatgatctagcttatattttgaaaggttcattctaactgctgtgttgaggatggactgtcaaaggatgaaagcagaagagagactaattaggaagctgagagttgatgttggcttggaccagaatggtagtggcagaggtggttagaagtccaattttatttttttctaatttgtttattttaattgacaaaaattgtatatatttatgtgtacaacatgatgttttgaaatgtgtatacattctggattgactaaattaattatgaggtagtacatatgttaattatatataactacctcatatttatacatggtgtcaacacttaaaatctactctcttagcaattttcaagcacataatacattgttattaactctagtcaccgtgttgtagccaatattaaatatatcttgaattttctgcaaattatagatgtgaaaggaagagtcaatgactttgacactaagttttttttttaagcctcattttttaaaatgttttcttaaggagaacttcaaacatattcaaaaatagaatagtaaaatgaccctccatgtatcatcactcagcttcagtaattaccaggtcatgctaatcttatttcctgtattccttcattaacttctcctcttcccatgttaaagcaaatctcagatattgcagggatatcattatatcaatatgtatttctaagaggaaatgaccttttaaaatgtaatcatgatagtacttttcaaaaaatgtaacaagaatcacttaatatcatagtatcataaaatggccaattgatgttccaattaccattgtctcataaatgtcataaatgtttttgtttatttacacatgtttgaattggattccaaataagagctatatattgtgattggctgatatgtcaagtcttttttaatctatagtttcaccctccatctctctttgtttcttttggctttttctttttttttttttttttacaactttttggctattgtggcttaacccctgccctaacttgatgtcttagtctagactgattgcctcagtaagatgattctcccttcaggtgtgataaacctattcctcagtcctatgtatttcctgtaaattagctgttggatctaaagacttgatctgattattgttcaattttttttttcttttttaaatttctcatttttatgggtatttagtaggtatatgtatttatggggtacatgtaatgttttgatacaggcatacaatgtgtcatagtcatatcagggtaagtggggtatttatcacctcaagcatttatcattttttgttagaattactgttcaatttttggcaaactgttttattattatggtacattcattcttaggagggacataatgtttcactgtgtctgtttttatgatgttaacaattagtggtgctcagtgcctagagcccattgttcattaggagttgcaaaatgctgatactttaattctaccatctatcctacagttattagctggaataattcattaaagagaaacttccccatatctactattagattactcaatggtacagttcatataggaaaggaaggatgaatgcttgattctccctctttatttaccaatttttaaaataatgaattggtttcctggcatcctcctaggataatcaattaattttttttcatttttaatatcattatgaacaaggcctagaattttttagtatcattttaacatatttactatatcaatccattgaagttattatccttaattagtattcaaattactctgtttttggcctgtgggaggcctgtcaagtagacttcttgatccatttgacatgagcctagtatttgatagcttacttgctatctgctatgtccaaatattccagattcatttctatattttttgttttagacctggaatcagctatttctccaatagctttacttttagtaggaaaaagtatttggagaacacaatctaggatctagggtgctcactgctaccaggttggtgattgtttctaggcttttatagtggacagagcttgcggatttttttaagcaataaaaatatttcatcacttcctattctaattctgggctaaaaggttttaaacttaacctcttcttacatctctactccttttgctcacccagtcaagaatgatagaatatcacattgtctagatgaaaaacctgagatgcaagagcttgagtaatttatcattaaatggcagaaccagggttcaaatatgtatctgtttgactctaaagtctgtgcttaaagtcatctttagaaaatttgtgtttagccagagctcctttgggaagcctaggcaggatgaggggttgagcccaggagttcaagaccagccctggcaacataggaagaccccatctctacaaacaacaacaacaaaacaaaacaaaaactagccaggcatggtggtacatgcctgttgtcccagctactcaagaagctgaggtggaaggaccacttgagcctgggaggtcagggctgctgggagccgtgctcccaccactgtactctagcctgggcaagagaatgagaccttgtttaagaaaaaaaagaagccacagatcccttgctgcaaggcgtagcatttttagcagaactgccaggtagagaattcaattcaactaacacacactgagcacctattaatatttttatacaaagtcctgttcacctgtatgatactggtgtctattaacaaatttgatttgttgatttatctacaaacctagatttatccagaatgcaaccacttttctcaacattccctttaccaccactttggtcctagccaccatcatgttgggttagattattgtagtaaccttgcttggataattataatagtgtcctaactggtctcctggtttctgctcttgccccctgcagtctatgcccaacatatcaaccagaatgatcctttaaaacttaagtcaaagcatgtcagtcctctgctccagaccctttaaaggattttccagttgagcgcagtggcttacaccagcactttgggaaaccaaggcaggcagatcacttgaggttaggagttcaagaccagcctggccaacatggcgaaaccccatctctactaaaaatacaaaatttacccagatacggtggtgtgtgcctgtagtcccagctacaccagaggctggggtacaagaatcacttgaacctgggagttggagtttgcagtgagccaagatcactgcactccagcctgggtggcagagggagactctatctcaaaaaaaaaaaaagattttccatctcagagtaaaagactaagtatttcctgtgatctatcaagccttttatttcatgttctgaattctgttgtttgtatgaccttatttctaatcttccacatatttcctccacatacaccactctgacctcagtgctgttcctctagtaggtgagtcaagctctcaccacaggtttttgcatttgttcttccctctcctaggaatgctgttccagtaggaatctctgtgttgaactcccttgctttcattagtttcttattcaagtcactgtctcagtgaacccttttctggcaatcctatctaatacccacctcacctcacacattgtattctccctactctgctttatgtcttttcttagcacttaacactatctaaaatactatatattttacttatttatcttgcttattgtcttttgccccactataatataaactccctgaagttggggttttatttttggtctgtttattcactaatttatccccattgcctagaactagtagttggtgctcaaaaaatatttgttgaatgaatgagtgtacttctaaagttatagctttaataattctcccaggtgatccacgatttcttacatgatgcatatattgtgggcaaaaaacatactatgagattccagttgtctaatattagaatatttttaaaggaagaataatcctgttttgctatctttctttttcttatacaatccttcctccccaccccagcgactcctgcttgtacttcatagaatatttcctctcttggaactagatatttctttctcttttctttctttttttttcttctggttaaatagccacagactgtccatttgagctgactcttgctggaaagtgagtcagtgcagcctagtggagagcagaggctggagcatttgcatctccagaatgtttgtattgacaaatggcagtcagttattgacatttttatcccttggtgatacttcaattggcttatctttgctggtcaaatgccttaattgttctggcctttaattcagtcaaagttggagctagagcagaggggaaagagaaggagccagactaacagaacatcaagcttgagctgggaggctgctggcaacgatcagcctgtcataatgttatgatttgttcatttttataccatttattagcctttacttgttgtgccatttggcctccagggcagataaagtgctgtctaatttggtaggtttgcttctgtcagagcagcctcgacagggaaggtgttagctgcagtgacaaataatcaatagctgtcgttgtcatgaggaacgtgagcagttgggcctttcatctggaggattagaggtctaattggattgagaatagggagggtgggctgttgggtaaccctgtcagccttgtgaagctgtcaaatatcggccttattcatggtgaagggaataaggaaccttgtgctttcagaactgaggagaaaggcatgtgaaagccctttatacaaaggaatagctcctgaagttgattcagctaacatatgcttccttttaaacttaattaaatatccctttagataataaatctatggaactttaaatgacatttttaaggttggatgtgtaatatacacacacattcacatataacgctatacaaatccaggttggttcttttgtctttgctgatgccagaagataaaccacttgaatggaggtgaaaaatgaaactttatgagagaaattgcataagttgtcatctcattgtcagaattaacaagtgataagcatttttaatactattaatagaaaaaataagtgagacattaaactgatagattagttaataatgaagtatggatatgtgacagttatttttctcccctggtcatttagaaatgtggtttcctataaaacaaatctttcatttattccaacctgaactaatccaaaaaatgaagaattatgcattggctaaattacttcttcaaaggaatgcctaattttttcttccttagcaagtgacaggattgcatttaagtgatatcaatggtatcatgtccaactcagtcccaaaatgtttttgtatatccctacatacttacgctgtactcctttacatttatggtataatgccatcatttggagtatgaatggagaaggtatttgagaaaaatgagttagctcgttctctaatctatggagctcttaatactacctctgcaaggccaagtaaatgactttaaattccactaaatttcatagaaattgagcaaatttaataatgataaatgttaaacacaattttataaaaaaagtataaacttctttatgagtccattctctatgtacaaattaaattcagtgcattgctgttgtccaaaagcaggtataattttaaaaaatgtttttacaatgtggtaggtactaagagcatttgtaagcatcctctatacagtatatctttatgaaagccctgaataaaggtgagttgacagtaatgccaagagtatgtgaataggcatttctaacttatggattatatacttagtccatttctataaacccatggtcccttttctatagtcattcaaagcccagctaaccaatttgaaataacttcaaaaaatactccaaaagaactaaatgtgtgtacaaaagacactagatggatgaacctggttatctcattgggcccttcaaaccctgaggtccatactatttattaccattacaaatgtttcattaagttcttcctgatcagtgctggtttgaaaattctatgattttactcacttgtgtaatccacagtgaaggtcagcaaaattctcaatactactgactaagaatttagaattatggttatctaaagaacttgctttgcttgatctaaactagaaatatttaaaatttcaaacaattatttgtgattacagaaatttctcagatttcatgcagttcttctagagctctatctgtggaagtatagttgtgagtacatttatacttaagcagaattactcataggaaatggtaaggtcagccaaacacaatggctcacatctataatcccagcactctgggagaccaaggccagaggatcagttgagcccaggagtttgagaccagcctcagcaacatagtgagaccctgtctgtacaaaaaaaaaaaaaaaaaatttaaattagcagtcatgttggttcacagctgtggtcccagctacttgggaggctgagagggaggattgcttgagcctaggaggttgaggctgcagcaagctgtaatcacaccactgccctccagcttgggtgacagagcaagattctgtctcaaaaaaaaaataaaataaaaaaggaaatggtaagatcagatttgatatccttgcaaaagaagttcaaagtttaaataggtttaaataggtttgtgtttggggttttgatcagaacatactttctatgacctataaacaaaattgttgctcttgaggttagatgagaatattttgttgctttgtaactccttataatccttattattcactcaacaaatatttgtgcaaaagccactgtgctaagttatggaaatacaaccatgacagggactatcctgccctcagagaagttcatagtttaatggggacaacagacaagctaaatgggtaatgaaaatgtagtattcctgtgttaaatgctaggaaaggagtaagcctaggtatatcataggaaaatgtaagagaggcatctaagccatcctggggtgttgtggtgaagaatggcttccttcaatagatagcaactatgctaagtggagaggagaaaagagagaggaagcccattcccaaggagtattccctccattcccttggagtattctcaaggagggaaagaatatgtacagtcacatgccacataatgacattttgtttaacttcagaccacatatacaatggtggtcccatgagccgtcacacccagcctgttttttatctttcatagaatatttttactgtattttttctatgtttagatacgtttagacacatgaatacttaccattgtgttatatttacctagagtattcaatatagtaatatactgtacaggtttgtagtctaggagcatcaggttataccatatagcctaggtgtgtaataagttataacatctaggtttgtgtatactatgatgttcacactatgacaaaatcacctaatgatacattttgcagaacatattcccattgttaagcaacatatgactatagctcaatatgtatgtattattgactatgaggtagaaaacgtggagagatgatattggataagtaaagtgggatcagaccatgaagtgtctgtcctacatggaggacaataaataaatttgaatatttactgaagagttagatttaaaacttgaatattatttaaattggactaaatgaaagggatttgcaactaactcaccactgcccttctgatcaccaaattcatatacctttcctacttcctcatacctcttgacaaaattggtacattttaccttctttatgattttctccatgcatctctttcttttctctgatgtatatcaagtatatcattggcaaaagcattggactgatataaatcagaagacctagattcatgacttaggctctgcttctttctaacggtgattttaggcaagttttaagtttaaatactctggacttctgtttcctattttttaaatttgtggcaatacttaggttcttacaggagttaaataaattaatatatttgaaaggactctgtaaaacctttgattatgttaagggacacatagtctaaagagtcctgacttagatcacaaaatgataaggcccttgagcatgtaaaaaaaaaaatgtattcaagcagattgaagttaaaattaagaaatgtcaaccaaaacacttaggtaacagttctaagaataacattggacccttacttatgaatcttagcccttattatcccataattattcatgaacaaatttacccctgttattctatgagcttctagaatacagaatcctatcaaatttatctttatatcttcctacaatgccttgcacaaaataggtgctaaataaataccttcaaggaatgaaacaatgaattcttgtagagtcagaattcgttctggatacagtttaatatctaacatacttggatcattttgttttctatttttcagttttgtgaagatgtttaaaaatactactacttctctaaaatcttttatttttccaactttggaatctattaatgagatatagcatttaactcagcaagaaaggacagaagcttggtactggtctcatctacttggacaaggaaagctctaagagaagctggttacagaggttcagcaggaggggacattgagctgcacaaagattatagtttacctgtaatcaagggcagctattgttagcacaagatttaaaaacaagtagatagagagtcagataatacttgtgagtccactacaggtaggcagtggtcaacttgaaattctgtccaagagtaggagggttccaatcaccagcaagaatagagcttaagattgagtggctattcgacccagtgagtcagattattagttcaatagagtgaattggctgcatgggggaaaatatgaaagcccagtgataatcactagatttgaaatcactagataccaagtcccaggttataatagttggatggatggctcaaggtgtgtgctttcttagtggtcagtgcagggctaccattgtcttagaataacttagttagaaggatgaagatgattgagatggcctaagtacttctcacatcatcaagattgatacagcagtactcaaccatctagaaagccttttaaagtagcaatggcttttgaaaatggtgtagtagctcctattggatcagccctccagtagataacatttataaactctgaacaaaatataaaaacaactatctggaggaattgaagagtgaccaagtaggcagaaattgcattgtaatcagcccttggaagaccgtaagaagaggatagcactgggtgagtttccacttttataacagggcctactcagttcttcaaagaggatgaaaactgagtagaaatctgcattcttactttttgaagaatcaaaggacagcatttggggcaatggctgtaagtcagaagagatgtttcaggctgggtgcagtggctcacacctgtaatcccagcactttgggaggccaaggcaggtggatcacttgaggtagggagttcgagactagcctggccaacatggtgaaaccccgtctctactaaaaatacaaaaaattagctgggcatggtggtgcatgcctataatcccagctactcaggaggctgagacaggagaatcgcttgaacccgggaggcagaggttgcggtgagccaagatcatgtccttgcactccagcctgggagacagagtgagacttcatctcaaaaaagaagaaaaatgaaaaacagaagagattttccagaacagagaaattcatataagggaaggcctaacctctacatataaactgccaaaatctctgactaacccctaacctaaacatagatggggaaaaattcaggcagccaagctaaggctaaaataactcatcagcgatttagctgctgcctgcctatgcaggaaaaacataatttagagtttgggttcagccaaggtatctgcctgctaaaacaaaaaatgaatagtcttcagcataacataacagaatccagaatctttacaacacatcattttcagtgtctaagatattctcaaatattgctagacatgaggacaaacagtaaactgtgttccatactcatgagaaaaagtaacaatggagaacaactatctttgttgttccagattttaatgagcagacaaggaatttaaagcaggtcttttaactctgcttaaggatgcaaagaaaaatatgttcgtaatgaataaacagataggatgtcttgcagaaaaatagaaactctataaaaagaactaatggaaattctagaactgaaaactacaatatctaaagattcactagaagggcttatcagcagattggagatgaagagtcagtgaacttaaagatagatcaatagaaattaaccaatctttaaaaaaaaaaagaagcgaatatactaagaaaaaagtgagtctcagtgatttgtaggacaatattgaaagaccaaactgtttgtaattacaaagataggagagagagaatggggcagaaaaataattaagaaaatgatggccaaaaattgcccaaacttggtgaaagacatacatttaaatattcaagaaacgtaatgaactccaataagataaatacaaagaaaatcttggccaggcatggtagctcatgcctgtaatcctgcactttgggaggctgaggcaggcagaccacctgaggtcaggagttggagatcagcctggctaacatggtgaaaccccatctctactaaaaatacaaaattagctgggcatggtggtgcgtgcctgtaatcccagctactcgggaggctgaggcaggagaatcacttgaacccaggaggaggaggttgcagtgagccagaatcatgccactgcactccagcctgggcgacagagtgagatgctgtctccgaaaaaaagaaaatctcacctgaaaataccataatcaaattgctgaaaaccaaagatgaagagaaactcttaaaagcagccaaagggctgaactgagctggttgccttctgttactgtgggagaactcacttcatcccaacttcttcatactttcacttctggagctcatattcctctgacatcttccagaaaaacagtcttaaagccttagccttttttacagtccagctcttaaattttttcctcccctttttcaataataacatgagtgtgcatccagcttgtccccaaaacctgccttgctctgaagcatccaactgtaaagactctttgccaatgtctgtgatttgtgggcccaaaacaaactatccatccttgcatatatcttctgctgagatgcctcacacagagtctggacagctctaattctttcacgagtcccaaaggcagacaactcacttctgcagagaagagcaccgcaaaaaaggaagacaaagtcctggtcaagaaacagatgaccagaactgtgttctcttccacccagctgtgtgtactcagtgatagatttcagagacagaaatacctcagcctccagcagatgcaagaactttacagcatcctgaatcttagctacaaacaggttaagacttggttccagaaccagagaataaaatataagaggtggcagaaaaacagctgcccaaagaatagcaatggtgtgactccaaaggcctgagcacctacctaccccagcctctattcttcctgcctccaaggatgcttggcgaacatgtctgggaacctttcaatgcagagcaaccagacctgtagcagttcggcctggggcaaccagacctggaacatccagtcctagaacagccattcctgaacactcagacctggtgcacccaatcctggaacaatcaggcctggaacaatcccttctatagctgtggagaggaatctctgcaagtcctgcatgcggttccagcaaattcttctctcagtgacttggaggctgccttggaaactgctgaagaaagctacaatggaatacagcagaccactaggtattttagtactccacaaaccatagatttattcctaaactattccaagaacatgcagcctgaagatatgtaaagatgagtgaaactgatattactcaatttcagtctgggcactggctgaatccttcctctcccctcctgcctccctcataggattttacttgtttggaagctacatgttctgccttcatatctttgtttcctttatgcctatcaagtcgattttgtggagggtggggtatgattggagccaaatcagagagttttctttttttcctatgggatctttctggagaaaaaaggttttaataaccttggctgctaaggacaacatgatagaagctgtctctggctatagataagtagatataatactagtttgaatatctttaggatttagaacctagcgtcaagaataggaagtaaaagtacaaattgatgtggtgaaggtatagtcccattttctgggattgggggtctttgcttatttttatttttatttatttatttagagacggagtctcgcactgctgcctgggctagagtgcagtggtgcgatctcagctcactgcagcctccaccttccgggttgatgtgattctcctgcctcagcctcccaagtagctaggattacaggcacataccaccacacccagctattttgttgtatttttaatagacactgggtttcactatgttggccagactggtcttgaactcctgaccttgtgatccgcccgcctcagcctcccaaagtgctaggattacaccatgagccaccgtgcctggccttacttactgttaaaaacccaattattaaggtgaaggattaagctgtaacatacttcactgatttcatcagcccctttggctctgtgttttactatagcccctaattggttggttatgctaatatttatagacagcggtcttgtatttgctacatcacaatgacatcagtactagtttgcctggtttaagtacaaatgaataaaacaaccatatcacctttaaaaaaaaaaaaaagcagccaaagaaaaagacatgatgatgccctaaccaagggaaaccgtgaggcactgtgccatgagcaacggtgcattccggtccagatactacgcttttcccacaatctttgcaacccacagatcaggagattcccttgggtgcctacaccaccagggccctgggtttcaagcaaaaaaccgggcggccatttgggcagacaccaagctacctgtgggagtttttcttcataccccagtggtgcctgggaatgtcagcgagagagcaccattctctcccctggaaagggggctgaagtcagggagccaagtggtctagctcagcagatcccactcccacggagcccagcaagctaagatccactgactcgaaattcttgctgccatcacagcagtctgaagtcgacctgggacactctagcttggtggggggaggggcgtcccccattactgaggcttcagtaggcagttttcccctcacagtgtaaacaaagccaccaggaagctcaaactgggtggagctcaccacaattcagcaaagctactgcagccagactgcctctctagattcctcctctcttggcagggcatctctgaaagaaaggcagaagccccagtcaggggcttatagataaaactcccatctgcctgggacagagcacctgagggaaggggcagctgtggatgcatcttcagcagacttaaatgttcctgcctgctggctctgaagagagcagcagatctcccaacacagcgctcgagctctgctaagggaaagactgcctcttcaagtgggtccctgattccggtgcctcctgactgggagacacctcccagcaggggccgacagacacctcatacaggacagctctggcttgcatctggcaggtgcccctctggaacgaagcttccagaggaaggaacaggcagcaatctttgctgttctgcagtctttgctgcagatacctaggcaaacagggtctggagtggactttcatcaaactccagcaaacctgtagaataggggcctgactattagaaggaaaactaacaaaaataaaagaataacatcaacatcaacaaaaaggatgtgcacactgaaaccccatccaaaggtcaccaacatagaagaccaaaggtagataaatccatgaagatgaggaaaaaccaatgcaaaaagcctgaaaattccaaaaaccagaacacctcttcttctgcaaaggatcacaactcctcaccagcaagggaacaaaactggacagagaatgagtttgatgaattgacagaagtaggcttcagaaggtgggcaataataaactcctctgagctttttctgtaaaggagcatgttctaacccaatgcaagaaagctaagaaccttgaaaaaaggttagaggaattgctaactagaataaccagtttagagaagaacataaataacctgatggagctaaaaaaacacagcaggagaactttgtgaagcacacgcaagtatcaatagctgaatcaatcaaatcgaagaaagaatatcagagactgaagatcaacttaatgaaataaagtgtgaagacaagattagagaaaaaaagaatgaaaaggaatgcacaaagactccaagaaatataggactatgtgaaaagaccaaatctatgtttgattggtgtacctgaaagtgacggggagaatggaaccaaattggaaaacactcttcaggatattatccgggagaactttccccacctagcaagagaccaacattcaaattcaggaaatactgagaacaccactaggatactcctcaagaagaggaactccaagaaacataatcgtcagattcaccaagagtgaaatgaagggaaaaatgttaagggcagccagagagaaaggtcaggttacccacaagggaagcccatcagactaacggtggatctctctacagaaaccctacaagccagaagagagtgagggtcaatattcaacattcttgaagaaaagaattttcaacacagaatttcatatccagccaaactaagcttcataagcgaaggagaaataaaatcctttacagagaagcaaatgcagagagattttgtcaccaccaggcctggcttacaagagttcctgaaggaggcactaactatggaaaggaaaaactggttgcagccactgcaaaaacataccaaattgtaaagaccatcgacactgtgaagaaactgcatcaacgaataggcaaaataaccaggtagcatcacaatgacaggatcaaattcacagataacgatattaaccttaaatgtaaatggtctaaatgccccaattaaaagacacagactggcaaattggataaagagtcaagacccattggtgtgctgtaattcaggagacccatctcacgtgcaaagacacacacaggctgaaaataaagggatagaggaatatttaccaagcaaatggaaagcaaaaaaaaaaagcaggggttgcaatcctagtctctgataaaacagactttaaaccaacaaagatcaaaaaagacaaacaagggcattacataatggtaaaggaatcaatgcaacaagaagagctaaatatcctaaatatatatgcacccaatacagaaccacccagattcataaagcaagttctcagagacctacaaagagacttaggctcccacacaataataataggagacttgaacaccccactgtcaatattagaaagatcaatgcaacagaaaattaacaagaatattcaggacttgaactcagctctggaccaaggagacctaataaacatctacagaactctccaccccatatcaacagaatatacattcttctcagtaccacattgcacttattctaaaattgaccacataattggaagtaaaacactcctcagcaaatgcaaaagaatggaaatcgtaacagtctctcagaccacagtgcaatcaaattggaactcaggattaagaaactcactcagaaccacacaactacatggaaactgaacaacctgctcctgaatgactactgggtaaataatgaaattaaggtagaaataaataagttccttgaaaccaataagagcaaagacacaacgtgctagaatctctgggacacagctaaagcagtgtttagagggaaatttatagcactaaatgcccacaggagaaagtgggaaagatctaaaatcgacaccctaacatcacaattaaaagaactagagaagcaagagcaaacaaattcagaagacaagaaataactaagatcagagcagaactaaaggagatagagacacgaaaaacccttcaaaaaatcaagaatccaggagctggtttttttttaaaagattaacaacaggtagaccaccacccagactaataaagaagaaaagagaaaagaataaaatagacacaataaaaaatgataaaggggatataaccactgatcccacagaaatacagactaccatcagagaataccagaaacacctctacgcaaataaactagaaaatctagaagaaattggtaaattcctggacacatacaccctcctaagactaaaccaggaagaagtcgaatccctgaatagaccaataacaagttctgaaattgaggcagtaattaatagcctagcaacctccaaaaacccaggaccagacagattcacagttgaattctaccagaggtacagaaaggagctggtaccattccttctgaaaccattccaatcaatagaaaaagagggactcctccctacctcattttatgaggccagcatcatcctgacaccaaaacctggcagagacacaacaaaaaaagaaaatttcaggccaatatccctgatgaacattgatgtgaaaatcctcaataaaatactggctaactgaatccagcagcacatcaaaaagcttatccaccatgatcaagtcagcttcacccctgggatgcaaggctggttcaacatacacaaatcaataaacataatccatcacataaacagaaccaatgacaaaaccacatgattatctcaatagatgcagaaaaggccttcaataaaattcaacaccccttcatgctaaaaactctcaaaaaactaggtaatgatggaatgtatctcaaaataataagacctacttatgacaaacccacagccaatgtcatactgaatgggcaaaaactggaagcattccctttgaaaactggcacatgacaaggatgccctctctcaccactcctgtattggaagttctggccagggcaatcaggcaaaagaaagaaataaagggtattcaaataggaagagaggaagccaaattgtttctgtttgcagatgacatgattgtatatttagaaaatcccatcatctcaacccaaaatctccttaagctgataagcaacttcagcaaagtctcgggatacaaaatcaatgtgcaaaactcccaagcattcctatacaccaataatagacaaacagctaaatcatgagtgaactcctattcacaattgctacaaagagaataaaatacctaggaatacaactatcaagtgatgtgaaagacctcttcaaggagagctataaaccactgctcaaagaaataagagatgacacaaacaaatagaaaaacattccatactcatagataggaagaatcaatatgatgaaaatggccatactgcccaaagcaatttatagattcagtgctatccccatcaagctaccattgactttcttcacagaattagaaaaaactactttaaatttcgtatggaaccaaaaaagagcccatatagccaagacaatcctaagcaaaaagaacaaagctggagacatcatgctacctgacttcgaactacactacaagcctacagtaaccaaaacagcatgattctggtaccaaaacagagatatagaccaatggaacagaatagaggcctcagaaataacccaacacatctacaaccatctaatctttgacaaacctgacaaaaacaagcaatggggaaaggattccctatttaataaatggtgttgggaaaatggctagccatatgcagaaaactgaaactggaccccttccttacaccttatacaaaaattaactcaagatggattaaagacttaaacgtaagacctaaaaccataaaaacgctagaagaaaacctagacaataccattcaggacagaggcatgggcaaagatttcatgactaaaacaccaaaagcaatggcaacaaaagccaaaattgacaagtgggatctaattaaactaaagagctttggcacagcaaaagacactatcagcagagtgaacaggcaacctataaaatgggaggaaatgtttgcaatctatccatctgacaaagggctaatatccagaatgtacaaggaacttaaacttacaagaaaaaaacaaccccatcaaaaagtgggcgaagtatataaacagacacgtctcaaaaaacagacactgtcttcaaaagacgacattattgcggccaacaaacacatgaaaaaaagctcatcatcactagtcattagagaaatgcaaattaaaaccacaacgagataccaccatctcatgccagttagaatggcgatcattaaaaagtcaggaaacaacaggtgctggagaggatgtggagaaataggaatgcttttacactattggtggagtgtaaattagttcaacctttgtgaagacagtgtggcgattcctcaaggatctagaaccagaaatactatttaacccagtaatcccattactggatatatgcccaaaggattataaatcattctacgataaagacacatgcacacatatgtttattgcagcactattcacaataagacttggaaccaacccaaatgcccatcagtgatagactggataaagaaaatgtggcacatatacaccatggaatactatgcagccataaaaaggatgagttcatgtcctttccagggacatggattaaactggaaaccatcattctcagcaaactaacacaggaacagaaaaccaaacaccgcatgttctcactcataaatgggagttgaacaatgagaacacatggatacagggaggggaacatcacatactggggcctgccgggggatgaggggtaagaggaggcatagcattaggagaaatacctaatgtagatgacaggttgatgggtgcaacaaaccaccatggcacgtgtatacctatgtaaccaacctgcacgttctgcacatgtatctcaaaatttaaagtataattaaaaaaagaaaagacatgatccaatatagtaaagcatgaatacaggtgacaacatactcttcagtatcaataggcacatgcagacagtaaaataatcgctttaaaatgctgaaaggaaaaactgtcaatctagaattctgtatctggtaaaactatctttccagaataaaactgaaataaggacaaacaaaactaagataatttatcccaaacaaacctatattaaaagaaataatggtcgggcacagtggcttacgcctgtaatcccagcactttgggagactgaggagggcagatcacctgagctcagcatttcaagactgccctgggcaacatggtgaaacctcgtctctactaaaatacaaaacattagctgggtgtggtgatgcgcctgtagtcccagctactcgggaggctgaggcatgagaattgcttgagtccaggaggcagaggttgcagtgagccgagatcgcgccactgtactccagcctgggcaacagagtgaaactctgtttcagggaaaaaaaaaaaaaaaaaaaaaagcaccagaaaagataaataggtagctaaagataaacaattattttttcttaatttctttaaaattaatattgctatttaaagcaaaaattataaaactattatggaatttatagtaaatataggtataatacatatatatgatatctacagcataaagtatggggtggggataatgcaactatacaattgcaagggtcttgcattttgtataaagtgatacaacattaactctaaatagactttgtaaagttatggatatgaactataatacttggaggaaatactaaaataataatgcaatgaagtatcgctttttttaattcaagagaaaaaattttaaaggaattcttaaaaattgcttgagtttcacttcccaagattctaattcaattggtctgaggtagaaaccagacagtaatgctttttaaaagctcctcacctgattctaatatgtttaaaatgccagtgttgggaatgtttctagcagtgctaaatcaaagttattggatgtagttgtataagagagaagtatatgttgcatgtaacagagagtatatgttgctggaaaaccatgcagatcaccagagcactgttttacctcactgaaaagcattagttcctgtgaatccatagaccacttgcttcgtgttgatgacaaagtcctcaccattttgtaaaaaaatgaagaaaagatcattgtagtatttaacatatataggtttgtgtagtatttaacatataggtttgtgcatgtctgtgcacctatagtctgtatgtaataagtctgtcttcctgttactacagttcttgaaaatagttgggtggccttttgctacattgggaagacatatttagaataatatgacttcgtatataggctacatggtatacaaaaaaatgcatgtgggggaaagtaaggggagcactcaaagagatctttcagagcatctcaagcagagattcaataagaggcctatttaagaggtcattggaagggagatgccataattcttaaagacattgcatgcaggaaaaaacagtgattttgaatatttgccacaaatggaaaatgacaggagtagatactcaagttacaattaatttgtgatcctttgctataaagctatttcttacctgggcaattctgtgtaatgcatgccatagatttattgattgtcagttattaatgattttcctcaggcacgaaagatgtaaatagatgttggtgaaaagctaccagctgtcctttcaggaaggacagtcctttatttcctttttgagggcttacacttttttatgaaataatgttgataatagatttactttttaaaatgaacttagattgcaaaaatgtaaactttatactgtcatctttatatttgttccaataatattttttaatgattattattattgagttaaaatgtgcatacaagaatgtacagaaaaatatacaattagatatgtgtaataaatgtacctactcacatcaccaccaccacagtcaggacataaaacatttaggcaacaccagaaagttccttttttccccactttcaaccagtcaccacctccatggttaacaccattatgatttttaacacaaaagattagttttacctgttcttgaagtttttataaatagaattttttttttgctgtctacaagagaaacacttcattttgtatatgcatagaaatatatatatatatatatatatatatatatatatatatatattcattttagtagcttttatagtgcaagtggtttttggttacatggatgaattgtgtagtggtgaagtctaagattttagtgcacccatcacctgaatagtgtatgttgtacccaatatgtagctttttattcctctgcccactctcacccttcccctttctgagtccccaaagtacattatatcactctgtatgcctttgcataaccatagcttagcttccacttataagtgagaacatacagtatttgatgttccattcctgagttgcttcacttagaataatggcctcctccatccaagttgctacaaggacattatttcttcctttttatggctgagtagtatgccattgtatatatgttccacattttcttcatctgctcatcagttgatgggcacttaggttgattccatatctttgcaactgtgaattgtgctgcaatatacatatgcatgcagatgtctttttaatgacttactttcctcggggtaaatacccagtagtagaattgctggatcaaatgggtcaaatggtagatctacttttagttccttgagaaatcttcacgttgttttccatacaggttgtactaattttttttttctttgagatggagtttcactccgtcacccaggctggagtgcagtagcgcaatctcagctcactgcatccttcacctcccgggttttaaacaattctctgcctcagccccctcagtagctgggattacaggcacccaccaccacgcctggctaattttttttgtatttttagtagagacggggtttcaccatcttggccaggctgattttgaactcctgacatcatgatccacccacctcagcctcccaaagtgctgggattacaggcatgaatgaccaaccgagcccagccaggttgtactaatttacattcctgccagcagcatataaagtgttcccctttcaccccattcatgccaacatctcttgttttttgactgtttaataatggctgttctggctgggctatggtgatattatctcattgtggttttaatttgcatttcctgatgattagtgatgtttagcattttttccagatgttggccatttgtatatcttttttgagatgtctattcatgtcatttgcttactttttaatgggattatttgggttttttccttgctgatttgagtttcttgtggattctggttattagttctttgtcagatgcatagcttagaaatatgttcttccattttgtgggttgtctgtttactctgaaaattatttttttcactgagcagaagctttttatttttattaggtctcatttatttttgtttttgttaaatttgctttggggggtcttagtcataaatttttgcctagactattgtctggaagagttttccctaggttttcttcaagaatttttatggtttcaggtcttagatttcagtcattcatccatcttgagttgatttttgtatatggtgagagatagggatccagtttcttttttctacatgtgcgtatccagttttcccagcatcttttattgaatagggtgttttttccccaatttatgtttttgtatgctttgtcaaagatcagttgtaagtatttgactttatttctgggttctctattctgttccattggtctgtacatctattttcataccagtaccatgttgttttaattactatagccttgtaatataatttgaaggcaggtaattgtgatgcctccagatttgttctttttgctgaggattgctttggctgtccagactcttttttggttctatatgaattttaggattgttacttattctgtgaaaaatgatgttggtatttttatcagaattacattgaatctgtagattgctttgggcagtatggtcatttttacaatactgatgcttccagtcaatgagcgtgggatgtgtttccatttgtttgtatcatctatgatttctttttttttttttttttttgagacaaagtctcactctgtcacccaggctggagggcagtggcgtgatctcagctcaccacaacctccgcctcccaggttcaagcgattctcctgcctcagcctcctgagtagctgggattacagatgtgtgccaccacacccagctaatttttgtatttttagtacggatgaggtttcaccatgttggccaggctggtctcaaactcctaagctcaggtgatgcacagcctcccaaagtgctgggattataggcgtgagccactgcatccagcctcatctatgatttctttcagcagtgttttatagttcatcttgtagagatctttcatctttctggttaagtatattcccagttttttgttttgttttggtggtggtgttgttttgcagctatttcaaaagggatttagttcatgatttgatgctctgcatggtcactgttggtgtatagcagtgctactaatttgtgtacattgattttgtaacctgagatataattggattcatttatcaaatctaggattcttttggaggagtctttagggttttgtaggtgtacaatcatatcattggcaaagagagatagtttgaccttctcatttccaatttggatgtcctttctttctttctcgtgctgattgctctggttaggacttccagtactatgctgaatagaaatgatgaaagtgggcatccttgtcttgttccggttcttccagggaatgctttctaattttccccattcattaagatattggttgtgggtttgtcatatgtggcttccttctatacttagacggaacatacctcaaaataataatgtgttgagggtttttttataaagaaatgctagattttattgaatgctttttctgtgtctattgagatgattgtatgttttttatttttaattccatttatgtgatgaatcgtacttattgacttgcaaatgttaaagcatccctgcagccctggatgaaacccagggtgaattatctttttgatatgctgttggattcagtttgctggtattttgctgagggtttttgcatccatgttcatcagggctattggtctgtagtttctttcttttttttttttttttgtccgttagatcctttcctggtcttggtatcagggtgatactggctttgtagaatgagatagggaggattacctctttctcaatcttttggaatagtttcagtaatattgataccaatttttctttgaatatctggtagaatttggctgtgaatccatctgaccttgggcgttttttgttgttgttgttggcaatttttaaaattactgagtcaatctcattgcttgttattggtttgttcaggatttctgtttcttcctaattgaagatggggggctgtgtatttccaggaatttatccatttcctctagatttcctactttgtgtgcatagaggtgttcacagtagtctcaaatgatcttttgtatatctgtgatgtctttttgtatttctgtgttacagatattgctgtagtgtctccacgttcatttctaatggaacttatttgcatcttctttttttttttttttttttttggttaatatagctaatggtctatcaatcttgtttaccttgtcaaaaacacaggtttttgtttcattggttcttttatattgtttatgtttgtttgtttcaatttcatttgattctgctctgatctttgttatttcttttcttttgctagtttgggtttttgtttgttcttgtttctttacttccttgaagtgtgacaataggttgtcaatttgtgatctttcagactttttgatttaggcatttagtgctaaaaactttcctcttactactgcttttgctgtatctcggaggctttaataactgtgtcactattattcatttcaaagaattttttaatttccatcttgatttcattgttaactcagaaataattcaggagaaaattgtttaattttcattacttgtataattctgagaggtccttttggagttgatttctagtttttctccactatggtctgaaaagatacttgtttaccttattgatacttgattatctttgatatgattttgaattttaaaaatttagtgagacttattttgttgcctatcatgtgttctatcttggagaatgttccatttgctgataagaagtatgtgtattcttttttcttttatttatttatttgtttgtttttttttaatagacgggggtcttgccatgtcggccaggttggtcttgaactcctggtttcaagcaatctgcctgcctcaccctcccaaagtgctaggattacaggcgtgagccactgtgcccagcaaagtatggggtagaattttctgtattggttaggtccatttgttgtagagtgcagtttaagtcctgtgtttctttgttgactttctgcctggatgatctgtctagtgctgtcagtggagtgttgaagtcccccactattattgtgtttctgtccaactctgggagctccagagttaggtgcatatatatttaggattgtaatatcttcttgttggattgatccttttatcactatataatgactttctttgtctttttttcttttaaccattgttgctttaaagtctgttttgttaacatcagaatagctactcttgcctgcttttggtttccatttgcttggaatatctgtttccaccctttaccttgagtctgtaagaatctttacatgttaagtgagtctcttgaatacagcagatatttggtttgtaatttttcaaccattctgtcagtggaggatatagaccatttacatttaacgttaatattgagatgtgaagtactatttcagtcatcattgttgactgttaacctactttgttttcttcatgtgttattgttttataggctctgagttttatgctttcaagatgttctattctggtgcatattgaccttttgtttcaagatttagagctccttttagtatttcttgtagagctggtctagtagtgacaaattctctcagtatttgctcatccgaaaaaaaactttttttctccttcatttatgaaacttagttttgctggatacaaaattcttggctgacaattattctgttgaaggaggctaaagataggaccctaatcctttctggcttgtaaagtttctgctgagaaggctgttgttggtctaataagttttcctttataggttacctgatgcttttgtcttactgctcttagaattctttccttcatgttgattttagataccctgataattatatgccttggtgatgtcctttttgttttcttttttttttcttctgagacagagtctcactctgttacccaggctggaatgcagtggcatgatcatggctcactgcagccttgacctcctgggctcaagcaatcctcccaccttagcctcctgagtagctgggactataggcatatgccaccacatcaggctaattttttaattttttatagagatgggttctctctatgttgcccaagctggtctcaaactcctggtctcaagtagtcctcccacctcggcctcccgaagtggtattacaggcattagctactgggtccagctggtgatatcctttttgtaatgaatctcccaggagttctttcagtttctcgtgtttggttatctaaatctctagcaaggtcagggaagttctccttaattattccctcagataagttttccaaattttttgtttgtcttctccctcaggaacactagtgattctttggtttggcaattttacataatcccatatgttttggagactttattcatttcttttaattatattttctttactcttgtctgattgggttaattcaaaagctttgtctccaagctctgaaatttttcttctactagttctagtctattgttaaaactttcctgtgcattttttaattctctaaatgtgtctttcattttcaaaagttctgattggtttttctttaaaatatccatctctagaaaatttatcactcatatcctgaattatttttttaacttcactatgttggttttcacctttctcttgcatctccttgagtagcttaacaatcaaccttttgggttctttatctggtatttcaaagatttcatcttggtttggatccattgctggagagttagtgtgatcttttgtgggtactgtagaaccctgttttgtcatattgtcagaattatttttctggttccttctcacttgggtagactatttcttctagtatttttgaatttatttttcattcaactgtgttttttaatttttttattcccccttaaggatgtaactttaatgtttacagtttattatagcccaatttggctcttgatgatttccggtgtgaagactctgagttccttggttatagagaatctttgtctgatggctttctcagatgctgtttgtagtagcaaggtgcttggtgtgtgagcaggttcactgtcttaagttttccatctggctcacagggtagaccgcagcccaccatttctttcagagggtctgtgatttctgtcagttttcctgttaagttcctgtgttgcttcttgaacaaaagttcacagtatgactctctacacactcttttgtctttccaagtaggggaggcatgctaacaatgctttcagtccaccatcttggggaaaaaagagtgtgtgtgtgtgtgtgtgtgtgtgtgtgtgtgtgtaaatggaataatgcagtatgtattcttctgtgtctaggatctttcactcaatatttttgagatttatccatattgttgcacatatcatagcttattctttctctgttgctgaattatattctgttgcacaaatatatcataatttgtttatacattcatgggatgatggacatttgggttggttacagtctttagctattatgagagaatcttatgaataaactgaaaaaattaacactcttgtacaagtctttttgtggacatttgtactcatcaaataaatacctaaaagtgcaatgatctttaatagtgcctgcatattttttgctttagtagatactgcctaatggttttccaaaatgttgctaccactttacactctgaccaacaacacagtatgtgagagtttcagatgccatatatcttgggcaatatttcgttttgtcagtccttttactttgagcatttctagtgtgtttctcatttttgttttaatttgcatttacctaatgactgatgaagttgagtaattttcatatgcttaataataatttatatattttcttttgtgaagttgtgtgctcaagtcctttacccatttttttctgtattatttttagatgctactacaataagacactaaccaaagtttttaaataagatttcagattagattacctatgataccaatgtcttttttttttttttttctgatacaggattttactctgtcacccacactgaagtgcagtggtagaagcatagctcactgcagccttgaactcctgagttaagcattcctcccacctcagcctcctgagtagctggtactacaggcatgtgccaccatacccagctaatttttaaaatttttttgtagagatggggtgtcgctatgttgcccaggctggtcttatactgctggccatgaacaattctcccaccttggctgcccaaagtgctgggattacatgcatcagtcattgcgcccagtcagcaatatattttgattgattttttaaatctcttttgcacagattctttataaaaattttgcaaaaatatacataacatgaaatttgccattttaaccatttttgagtatactattcagtggcattaagcacattcacagcattgtgccaccatccccactattccttctgcgtatttagtattttcttgaatgtaattgatatgtaacaaattacatatatctcagatgtgtaatttgataagttgtaccatatttacacatcttcaaaagtttcctcatgaccatttgttatcctttcttcaaaccactctctgcctccaccctccctccccaagcaaccagtgatctgttttctgtcacaacagattgatttgcattttcaagaattttatgtaagtgaaatcatataaaactattctttttgcctagcttctttcactcagtataattattttgaaattcattcatgttattattgcatataccaatgatttatatattatcattgttcagtattattctattgtatggatatattacaaattgttctcaagctcctggtctcaagtgatcctcctgactcagcctcctaaagtgctgggattgcaggcatgaacaaggtaaaagtttcaagtttacaggcgtaagcaacagcacctagccttggatacactacagattgtttaaccatttgcctgttggtgaacatttgggttgttttctgttttgggctattactaatgaagatggtaagaacattcatctgtaagcatatgctttcatttctcttgggtaaatcattataaatgtaatggctgggtcatatagcaggtgtacgtttaacttttaagaaaatggtgaacagttttccaaagtgcttgtactattttactttcccactgatagtgaatgaaagttctatttcctccataccctcactttcttatgaggatactttgtatagtcagtctttttcatttgagccattctaaataaagccatttattccatttaggtttgtagtggtattaatttgcatttctctaatgacaaatgatgctgagatcttttcgtgtgcttgtcatttgtaggtctttgatctttttgcattgatcttgtttctgcaaacttgctaaagttcttcattcattctattagtcgtttcatagattttttagtctcctacataaacaatcgtcttatatataaattaaaatgagggttttttttttcaaatctttatgcccttctttcctcccttctttcctttcttccttcttttctttttttcagccttatttaactggctaacacctccattacaaatttaaatagaagtgattagagtagacatccttgccttatttctgatcttaggaagaaagcatgtagtatttcaccactaaacatgaaattaacttcaatttttaaaagatgtccttgagctaaagaatacaggaataacaaatgtagggggaagctactacctctgaggcttagggagagtatccaagggaggagcaaacttggaagctgagattcaggcctggtaggaatgagtgtggctgtgcccctggttggtgaagttcactggaatgccaagggccagagctagagagctggggctgatgagcagaaagttgcccactggggtagtggtgaaacttactggaatgtgagacccactgagtctcctatagacctccgacatctgcatcataggagcaaaaagagcacattggaaccagtgtgaagagccccttcctctgctattatttgtagtgtccctgctgcgcctgctacagataaagtcaaatattgtggcaactgcaaaggagaaattttcacagggtctagtctcacaaaacatggtaaagaagctgatttggagctgagaggcaaaaaactgataaatgatacactgattgaggaaactttcttttgattctagttcgctgagaatttaaaccaagagttggtgttgaatattgtcaaatgccttttctacatctattggaattatcatatagttgttgttctttatttattttgctcattatatcaattgtttaaaaaaatatatagagatggagtctcactgtgttgcccaggctacacttgaactcctaggctcaagcaatactcccacctcagcctctcgagtagctgggactacaggcacacaccccaccacacgcaacacatcaattgatttttttttttgagacgggagtctcgctttgttgctcaagctggagtgcagtgatgtgatctcggctcactgcagcctccaccttccaggttcaagcaattctcctggctcagcctcctgagtagttgggactacagctccgcaccaccacacctggctaatttttgtatttttagtagatacagcattccaccatgttggccaggctagtctcgaactcctaacctcaagtgatctgccctccttggcctcccaaaatgctgggattacaggcgtgagccaccacacctggccacatcaattgattttaaaatgtgaaaccaaccttgcacttctgggattaagtcctactttttatgtattgctcaatttaatttgctaatacattaaggatttttgcaacagtgttaaaaggaatattggtctatagtttagttgttttttttcttcttataatgtctttgtcaggttttcctatcaggatttgcagacttcataaaataagctgggaaactgtcttatcttcttctattatttataaagttgagtaagactggtaagattggaattatttatttcttaacttttttgtagaatttaccagtgaaaccatctagtcttgctggagttttttcttttcgatttggtaggaaggtgttttggcaacaaacctactttcttttatagatttagacttttcagattttatttcttcttacctccattttagtatgctgtctttttcaatgatttctccaaggcccctcaggaagaaatttagaacaaaaagtgatggtcagaattcagtcctcaattctcctttgtctgaggcctgtgtgatagctgttggcatttttcgtctggtgggagtttctgataaacaactcaagaacatatgttaagatgttatcttttagtttccatgggacatcagaataccttgtgactctggcttgcttcggaaactgtttttactaccttcttgcttatcaggttgctcatttacttttcaaggctagctgggtgcctggactttcccttgaagggactcaaaatggttcctttatttccatgctgaggggggcccagcaggtccctgaaaggggtcgctgttctatctcaatctttttctagcttcttatgctggaatcttaggtcaatgattttatataatcattattatgataaaattattataaaatattatatataatatataaatatattatttataattacctaattgtatacatagttttcttaaatacatataattatttaagcctgtgaaattttcctaaccactgctttagctgcaactcacaagttttgctatgttgcattttcttcaagtttgaaattctgaggggagaaaacacacttcacctgtttgggtttttttctgctctctcactcgacacaaaatcaacacagaagacttcagtgaccaaatatatggagacctctccaccagcaagcaagcagtcagttctgtagcagacacccagctggatatcccctaattcaattctaacactatctacccagagatggtatcagataccacagattgaagtctcagtgtccagactgcctcatgcttcagacaccagttacaagtcaaggccccctgaacttctgaccaaaccagcttcaagttggggttcctacaactccctgtctagtttcaattactttgctagagtggctcacataactcagggaaacatgtttactagtttattacaaaggatatattaaaagatacaaataaacagctggttgaagagatacatggtctgggtaccatagctcatgcctacaatcccagcactttgggaggttgaggcgagaggatcccttgatcccaggagttcaagaccagcctgggcaacattgcaaaacactgactctatcaaaataaataaataaaatagaaaaaagaaaagataagctgcataatgcaaggtatagaagggtcccaagcacaggagcttctgtctctgtggagtggggtgcaccaccctcccagcatatggatgaatttcttgttcaccttcctataagcctccacatattcagctatcctgtaccccatccttttgggccttttatggagacttcattggataggcatgattaacaaccatgtagaaatgtgattgggccaaaaaggtgtgatctaattgtaatagattgagggggaaacccattaaggcctgtctgttcagattcatcttggcctctctgcagcattccttcctccagggtatggggcaaagctcttttgaaacagaggtcttgtaacctacagtcagacaaggtaggtcagagaatttctttatggccagaggcagaggaagagtagagtatatttttagtttctaagggcctgccttggggagaaaaaggatcaggtgaaaggaaagcagaaggtcagagagagagattgttttctgaggcctgtttctgaggcctaaagcacccaacattttaacaaaagactgtaactaggtctgtgggagttaagagccagaaaccgtggacaaaaatctatgtctatatctatatcactgtcaaaatcagataattaaaatttatacaacattatcctcagaccctattattatcccaataatatccttaggtattaagttcagaatcacacattgcctttgtcaaacctatttagtgtccttcaatctagaaaagtttcttaatctttcctcaactttaatggtgttgacacatttgaagattgagggctagaatttttttttttttttttttttttttttttttttttttttttttttttttttggagacagtttcactcttcttgtgcaggctggagtgcaacggtgcgatcttggctcaccgcaacctctgtctcccgagttcaagcgattctcctgcctccaaagtagctgggattacaggcatgcaccaccaggtcccgctaattttgtatttgtaatagagacggggtttctccatgttggtcaggctggtctcgaactcctgacttcaggtgatccgccctcctcagcctcccaaagtactgggattacagacatgaagatgtgagccaccgtcgcctggcatttttttttttggagacagactcttgctctgtcgccaggctggagtgcagtggcatgatctcggctcactgcaacctccatctctggggttcaagcaattcttctgcctcagcctcccgtgtagctgggactacgggcatgcaccaccacgcctagctaatttttgtatttttaatagagacagggtttcaccatgttggccaggatggtctcaatctcctgaactcatgatccgcctgcctcagcctcccaaagtgctgggattacaggtgtgagccaccatgcctggccctggctacatattttatataatgtccctcaatttgggtttgttaggtatcttctcatgattagatttgtgttgtccacattcgcagagacgtcataggagtaatgctgtgttcttcctattgaatcctattatgtgtcacaaaattttgatgtttttcatcactaattacattcacttgctcacttaattaaggtacttgtaggctttttatctttataatcagtaaatattttgagggacagtactttgaaactatgtaaatgtcttattgtttactttatctgctactaatgtagccactccaactttcttatcactcatttcaggcaaatgtttttctattattactttcaacctatctgtgtctttatatttaaagtgtatctcttgtagacaacataagcatctcttatagactttcttttttatctagtctgacaatatctgcattttaattgaaacattagtccatttacatttaatgaattcttgatatggttgattttaagtttttcatcttattatttttattttgagccatctgttattgctcctttcaatctgttttctttttctcttttgcattaatcaaatttttaatttttcattttagttcttcaattggctctttacctatacctatgtattatttttaagaggttgctttagggtttacagtatgcatctttcacttaccgcattggaatattatactatgcctcagaaaacttaactatatcattttattgttttctggtagccatcggttccgatgagaagtacaccatcatccctgttgttcctatgtgtataatggtggtggttgtttttctgacttctttcagtgttttcttttttagctttggttttcaatagtttccctatcatgtgcatagaggtagttttctttatattaaccatgctttggattcactgagtttcttggatataaaagttgatatttttaccaaatttaaatcatttctcaaatactgttatctgttccattctctcttcttctgtgacaccaattacacataacattagacttttctatattgtcctacaggtcattgaggttctattgatttttgaaacattttttccttgtcttcaaatttaattatttctgttgatctaaactgaaatttattggcttgttcttctattttttagtctactattaagtccatgctatgatttttacatttcagatatagtactttccaattctggaacttccaattgtttctttttatgtaatttttctctgctgagattccctcatttgtttggtaattatgaccatctttttctgttaagtctttgaccatatttataaagctattgtaaattccttgtgtgctaattccaacatctgggttatcttaagatatctttattttggtttttttctcttgaaattgagtcctgtttttctgtttgtttgcatatggagtaattttttatagcatactcagaattgtggatgataccttgtagggactcttgattctgttatcttcctctaaagaatgttgactttttgttttgtaaaagttaaagctgactaattacactgaacttgttgagtgtctcggtttttcccttagtctagttgaatctattagaccaggtccacagtcctggtacatagtctatacttttaaggcatggcccttctgagatttcagtgggaagtctgaaatatgtactaagacctctaactaagtggaactcaaactccaaattctacccctatgccttgggtagtagctgaaatctctgatcagcttttcaactttccttttgtgggtttctgcagacatcttggagtctcccatacattgtcaattcagggatcagccaaggattttaagggagtctatatgcatatatggggcttcccctttttggctcttttacccatctcttttattccatcattttaatcttatttaccacatctaatgtctaaccaactgaagtagcctaccaatcttcctgattcaagtctttcccctctttaaaccattcttcacactgcggccagatttcattcactcatttactcatgtaacaaatagtcaatgagcactttcctaaaagacaatactgtcaagcagtcaagctactgcagctgctaggctggcttgccacatagattcagctgttaaaaagaccataagtccaaattgatttagacagtttattgcttatggcacagcaggtagcatgagcttcatgtctgcattggttctccttgcccccaagtcccataagggtggtatggaggcaggtccacgtagatgctgcaaaggcagagggtcagtgtcacacctgaggaaacttgaactttaaaaacctccaatcttacatcaaggctgtgagcaaacctgcctatcctttgccaccaaatgaaacattatctttattatcctggttagcaaacaaatctgtcctctaacctgaagggaggtaccatttttagcttccaaagcaactagttatgcagacgtctttgaaaagatagtccaaattaccagatatgcagaaacatgatggacaattgcttccaaacaagtacaaggagaaagcaaaccacttaggtcaagttttgagaatgatttcagagatatcagaaatgtgtccatctgctccccaaccccagttatcattctcctttccatctgcaaagataaaagaatctcaaccacttgctaattatagacataaatttccacaaaaggttttaaatatttcatcccacaacaagatataagactggaagccagaattaccttggaagtgttgggctagcactcctttacactaaactggaaaggtatagtctgcaaaagcaggcattacctgtttataattagcaatttatgtatactttaaacagctatccaaaggaattgagttaggtttaatcagaagagtaagagactagagacatgcactatggttctagctgcaagggccttacacccaagataaggagaatgggcgcatatacttaaagagggcataatcttacaagccagtgttagtatgctgagtgtcccatacaagcaagtctggccatagtgcttctcatattcagaggcgggtacagtcattagggggtgcttttatagaacatttcagtttccattattcttctgactgggtgttgaaaagcagttattacaatagtttttttttttttattttgacttcctgatgcatctgcagatgtgcactgaacttaatactgtagtcacaatggtgactttacatcattcagggagtcattccttaagcctagctagagtccttccacttactttataagtacataattccctgtattaaaatctttcctgcctaaaatacctaaatggcttctgtttcctgtactgaacctgcctaatacatggaggaattgaaatttcaggtggatcttaaagatatggtcaacttttgacatagaatgagaacccagagagaacttcaggcagagggaatagagtgagcaaagattaaaaggcagaaatggccatggcattttttagaaacattgaggaaactgattacagaagagaatgatagagtttcctgttatacaaatttctttatttcctatcaaatcctaaatgttttcatctctttttcttttccacttccttttcttctttctctcttccctctcctttctttccgcatatcacttgtctatcgctttaaccttccatgtcacacagtagcattcatagacattgcttacttattttgggggccttcagaattaaagaagttgctgcacctccaaagttttgttctttccactgaatattccactattaggtcagcaggctcattcttgaacttggctctattactaagcagtctcattcataaatttagtctccttagactaactagatttattgtgggctatcagaaatcctccccagatgtgcatgactgcacttggaagctttgagctttacagccctgtttactgccacctgattctaaccagagcaatatctcttatccattggcagaaaagagttaaggatgtgatagggaatttgagttagtggtaggcatgaaagtaatgtgatgggcttgtagaggatgagtgcaaggcatgttggaggcaataacatagatatttcaccatagctctcagcaaattatatctcctaaggtacaaagcataaagtccaacatacatttgatgtttagcatctatagtatttggtgagccattgtgaagcacataccagttacttttgataaagtagcttgaaagaactcttgatttttttttaaatgcttgcttcaaacataccctgtaattttgttttcctgccccatttactgttactcattctcaatcttttatattgcctattactcagtagctcgacttcttgttgttaataactgtagtctcgggtaactttttctttgtctttgtgaacatttttttctcaagtttattttatccaggctaggtatttaacagctctgtgtttcttataaaaagaaatacaaattataaaagctaaaatgaaccttgaaaaacatttactgcagcatttcccaaagcttcctttttttttttttttttttgaaacagagtctcactctatcatctaggctggagtgcagtggcatgatctaggctcactgtaaactctgcctccccagttcaagcgattctcctgcctcagccttccaagtagctgggattacaggcatgcgccaccatgcgtggctaatttttgtatttttagtagagacaggtttttaccatgttggccagattggtctcgaactcctgacctcaggtgatccgcccgcctcagcctcccaaagtgctgggcacgcccagccccaaatcttctttcttaaagtaatattcacatgtaatgttgtgtaaaaaaatgggtcccatggtcagataagtgtaggaactactgcatgtttctccttgaaaatttagcatgtataagcattctagaagctctgagaagttgcacagtgaagaaacccattaattttttaagtccaaaatttctcataatcatttgatcccaatgctttttttttccagcataaactaacagcatttaaggaaacagtgatctgtaaaacactttggtaaataaaatactagtttataacttaaatgaatttcctcatttcacaattgaggaaactgaggcccagaaagttgttttattcatcacaattaaaaacaatgccttacacaaagaaggtactaaataattgtttggtaaattgaatgatatatttatgtttagataactagttagagccaggactaaaacccagctgtcctgacaagttagacctatagcatttaataaggataatgcagttcacttctattcactgctatttaagctgatgataaaaacattttataattgctattaaaaaagcatcatatgctggtttaaaaggcaaactaaagaagttgaatagttggctgatgttttaaatcgacttagaccacaggtatctatctctttagtttttaacagtgtcaaatattggtctcttgatattgttcagagcactctgggttttgaaaaaacagttcaagtatgtgcaaaggcatctgaaaggggaattttctgaagctttttctactcccatgattctcacaaaattcttcaattcattctagtctagaaagtaatggatcttccataaagatgtgctaatcccaaggtgatcacaaaaaaaaagattttcccacctctgaacaggtttcttttgttgttgttgttgttttgctacttttttttaagtatgcttagcatgttataccaaaaataatgtttcttttttatataaaatattgtactatatatataagaaatacctcagaatttctgtttttaaggactccattttggcatgatattttttggtcattacctacttagctatgtcatattttaatatcaccaaagaaaatatcttaaaatgaaattcttgaattgcgcttgacctttccggttgacagtcagcttaaattatatagtatctcccattatctcacaacagatgtcatctcttaggaatgcttcctttcattgaagacactgtgacaataggaaagggatgtggggtgaaaaaaaagtcacgtatcttttgtttatctgcaaaagtctgtgcatagtttttattgctgaaaataaacatgtatcatgattggtgtatgggggttcacattagtatcagaagtttttatggccactctgctggtgacctagtatattgtgctgttttctcaactgcctttgtaaacacagtagccttaatagatcattttgaaagaagctgccatcctgctgcatctgttggtagcctttctcaggtttctgacatatccttaatctgatgctcagccttgtcatttggatcaatagtaaactagataagatgtcttctacttgcaaggctatggctataaaatgtatttgaaaaataaattcactttttatgtccatgccacaaacctggggagtactaatttgtcattctctctccatctgtctgtaaacagtcagttaaattggttattgatgagaagaaggtgaattatacttgaaacaagagtaatatagaaataaacttcatagtaaatgtcttagattcctacaaaaaggtgacatattttagctgttgtcttaactttaatctctagaataatgagcaatttgttttatattttctattccaaatcatcaataataattataattaattataattataaattatactttacaaaccactcacatatagtattcaatcttgataatctctataactatccattttacaatttgtaaagcatttatttattcaaaaaatgtttatgtagtgcctactataaatgaggcactgtgctaggcactacaaattctctatacaaaacaaaattgtgatgatagaacatgttagaattgtagcattttaatgttagaaggaatcctagaaatcatctactactaacttctcattttacaggaaactagatcttagacagtttgtgaatcatgctcaaccagctatttagtgactttttttctattataggatataaacagataatcttttaaaagtaaacccatagtttaatctttttgaatgtatatttcctcatctaagtagtgagaatacttctggttttcacaacaagaatactgtgaatattaagtaaggcatgagtagggagcattttgaaatttaaatataatctgaggataagaaacaactccttgtagacaagaggaaaagagtatgtaaaaatgtaaactgcgattacctcaggtttaagaggtgcaggctgatcactgttttcttctttatactttatttttgacattcctttaatggacatgttattacttttataacaaaaattttaagttttttttctttttttctaactttatgttttgatataatctcaaatttacagaaaagtttcaagaacagtacaaataattttcatatactctcaaattcctcaaatgtgcacattttgacacgtgtgctttatccttctctctactttgccttgatatatgggaatgtgtagatattgccttctgaatcatttggagtaagttgcaggtgtgatactcctttgcccctaaatttcagtgcatagtttctaaaaacaaggacattctcttacatagccacagctcaattatcacaatcaggcagttaacataaataatattatctcatccaaaaatcttacttagattttgcccattgtcccaacaatgtcatctatttaaaaaaaaaaaaatccaggatcaggcactccattcaatcatttatgtctttttagtcttcattaatctgcaacagtttttcagtcttttgtgtatgtatgtgtgtacttcatgatattcacatgttgtaagtatacaggccagttaaattgtacagtagccttcctttttaatttgtctgatatttccttataattagattcagattatgcacttttggtaagaataccacaggagtgatgttgtattcctctcagtgcctcatatcaggaagcatgtgtcatcaatttgtcccagtaatggtgttaattttggattattcacttgaataaaggagctcctgccaggttcctctgctgtgacgtcactattttttccattgtaactataaataataagtatcttgtgggagctaatttgaaactatataaatatcctggaaccgtccaacccactctattgttagcatcgtttgaccactcacacctgagttggttgttatgatgatggctgccacatgaaagagttatttatttattcattcattttttattttttgtttatttatttatttttcaggcagagtctcactctgtcacccaggctggaatgcagtggcactatcttggctcactgcaactgctgcctcctggattcaagcgattctcatgactcagcctcccaagtagctgggaatacaggcgtgcaccaccatgcctgctaatttttgtttttttagtagagatggggtttcgtcgtgttggccaggctaatctcaaactcctgacctcaggtgattcacctgcctcattctcccaaagtgctgggattataggtgtgacccactgtgcacagctgcacaagttatttttaaaaccactgcttatttaagatatacagttagatgtatacttagatgaaaactatgcaaatcctctctctttttaaacaaaaaaactaaaaaggattagaagagttttcacagaaatgctagcagagcttgtgttaggcttagggtaataaaattgttggtaaccttttttcttactttgttttcccaatttttaatagtttttcaaaattttcaatatatgtaaagcataaaatttctaatttttgaatgtgtttctaaaatttatgtttgtttatttccatttggtccacaaagggcttgagggagatactaaaatattgatttcagaattgtagtgtgcttgcacttgaaagaatagttagattacagttaaaacatagctataacaaacaggacatctaccctggcataaactacagattgacacaactaaaatagtctttaatctgcaaatctttattcctcacttcagccaccaagctgtagcattatgctttctcaactcggttgcttctcttagtttcaaataaaaaggtctaaaatggtggcagacagatgaagagcagtatagagttcagggattgacttgcagatggaggtatgttttgatataattttttaaagatggctaaatttgaaactagaagatacaattttgaattcaagcactcactgtgaggatttaggctaccattttgaaaatggataatagttactaagtcagattactagttatggtcagcatttgattaaaccctttaatgcatggtctgaatgaggttcattaaaggttttttagtataatcgaatttacttacacatttgtctgtatatttgtcttttcccaccatctaagaaatcccatccatagtgtggaactgaagtagagaaggcaaaagatggattcaatcagttgtttgaaacaggtcccccaaaggcacacatcttcgcagagtaggtgaattgatttttctaaactgcatgctaggatcaataaaactaaggtacattgttggaaaactaaagatggagcctacaagacttggggtgcttcaaaggaaccaggagttaaacaaaatttgttgcatttagcttctgagtttaatattaaaatatgatgttttaataactttgcttgcagtgtcactgagaaggctggtcagggtcagtaagaagaacaggctacacagattatcatggacatcaaacaatgagaacattaggagcaaatgaaagctgttttgtttacagatactacttttatgatgagaggagagcaatgatggtatctgagaaagaaaccaatatttgttgagtactcgctgtgcactggtcacttttttttcttttttaccaatgggaaatctgaggctttgagaagtaacttgctcacagttattaataatatagccaatgaagtgcccagatctgactggttccaaaatccattctcattttattacaccgtactgcctccccatggagtagcatttttggatcccctaaagcgaacatcaatatgctaggaaaatgaattacttgtgcagtattgggaaaaaggaaatggatgtaaaaactgttaccctgtggttaaggaaaataaaaattattagaaattaagtcattgttgagtcagttagaataaaaaacatttagttttgaagtagctatagggagcaggtcttctgccttttagaattagaatcatagagtcaaaggacattaagctgggtgggctttagatcagaatccaccctccttatttttcatgtgggaggaaacagaggctaggaaaaattcagtgatttgcctttgggtgtgggagtgttctggctgagacctctctcatgtccctcccttacttaaatccttcagtactggccgggtgcagtggctcatgcctgtaatcccagcactttgggaggccaaggcgggaggatcacaaggtcaggagatcgagaccatcctggctaacacagtgaaaccctgtctctactaaaaatacaaaaaattagccgggcgtggtggtgggcgcctgtagtcccagctactcaggaggctgaggcagaagaatggcatgaacctggaaggcagagcttgcagtgagccgagatcgcgccactgcactccagcctgggcaacagaacgagactccgtctcaaaaaaaaaaaaaaaaaaaaaaaaaatccttcagtactgcttcagaagactgaaaggaaaagcccaaactccttgaccctgcacttttcgtcatcgagttcttgcttatcttttgggcttcagtgtcctgtgtctccagttctactctatcctcagacatactgtgtttttaaagctttcattctagtcacctctttttcatcctccacacacaatgccgtcgcacattcagcttccttcctactttaagctggcttaattgcatatactttcaacatgcagctcaggcactgttttctccaataagcttctactgacccctcaaggctgggttaggtgcccctctacagagttcttactaccgtgtgtccttacctctatcatagaactgatctcattgtatgacagcagtgaatagcattgcatatggtttcactttctattacggtcaaagggagggatagtgtgggggttattggagcatgtaataagtggatccaagagacatgatatacacaacttactaatgttggcttcagaatatgcatataggaggagcttatggggacaaattgattggaaggagtgggagtaagatttgaagctgtctttatatagcactttacataaaattcagaaaatacttattgccctccatatcaaagaaattgggagcaggaacaagatggagacattgaggagtgtcaaagtgttagtaatcctaagttaagatcctgttcaactgccatctctttcatgaagtcattctgttctaaccccttcccctcttcacaaggacatcttggggaagtcacaaggaatgacttttaagtacatcatctatcctgtctttgtgttctgtttttgtatcctttttgtgcatttacccttccttgcttataattttgcattgcatacaagcgtacatctgtataaagcttccccaactcttagcatggagtctgatacagagtaattacatcaaaaataaccattgaatgttgaatgaatggtttaattaggtcagtgcttctcaatcccggttgcatttttgaatcacctaccgaaaatttaagaaatattaattccaaagtcccagaaattctgattttgttgatctaggatgggaacagactttttttttaagctcctaaggattgagaactcctagattaggttctttgtttcaacagtggttctcaaagtttaggattctagaccagcagcagcagcacttcccagaaacttgctacaaaatgcagattcttggcccctacaccagtgaatgacaaactctgcgggagggcctatgtgttttcaagccctccagacgatcttgatgcatgctagagtttgagaacttcttttgctagagtttaagacaaaaaaaaaatgttgtccttaaataaaataccaactgtgagaaaccaaatatactttataatcatcctaaaaggttgtaccaatttaaagcaccactctaaataaatcagagtacctcacaagcacaacagaattatccttgtggaaataagcatcccagcattttataacttttttcaatatttatttttggttagtttcctatatataaaaggctctccaatgaaggcattaattttcataataatctaaataaaataggctatattagtcaggaagagcacctgaaaaatctggcattggataaggaagcctcagagtcaagaatacctttccataatttcctctcatagagaaaagcctttttttgacagtaacattttctccttctctcatttgtgctgtttgactccgtgccacttgatagctctgtctattcctatggaaaccaagttagtggatggagccaaggcttggagaaggcattggggggaaatattagaagagttcagccttagagcaactaaagatgttgcctttccctcagtcaaatcctctttgagagccagaactatttcaagccagagagatgttcttggctgatgtattgtctagctgctctgccagatggatgaacatcttaaacttggaaaatagcaaataaagctcctattctgtctttggagcacattcttagcctttgcttacagaattgtcaaataactaaaaaatatatttttaaagatttgcttaagatggcaggttagtgatgtggttctcatcatatttgttaagtacttagaaattttagcaataaaacacagaattaagccttgacaatcagaagtttaagtaaagaggaagaatgtcggtcagtggaaaaagcaatgcagatttcattttatttctgtagctcagtgaatttatgtctttcatgagttgattgctgtaactgtttgcttccctataaaatcactttaaagactaagcaaccagagtacaaacagacatctaaatcaactgaaataagaaaattatctaagcatacaagaaggcattctcctttctaatccatttctgctctacattttatatggcactggtagctaactcatgattgcattgtactgagccatttatgtggatatttatattatgtttatatttcaagaagggtgtagagattcatatttccaatttatattctttgatttatgtcagaaaattaatgtcttctgagaaaacagttgagacaactattaatatagatgcctcataaatctatatcttgaatctagccatctcttctaatgttcaggtctatatgtatctgcccctccccaacaaccttttctttttgctagacctctctgcatagattcccttcaggtgcctcaaactccactttagaaaaaaaaaacagaactcaaaaatttttatccctaaccctatttttttctcccatctcttcagttgttggtaacaccctctatctggtagccattcaggaatcttcttatgtatttcactgatctcttcccttatttccatttagctctcaacatttctattgtgggttgctgtaataacccccttactgctctgcttgcctaaagattttttcccctcaaatcagtgcttcacataacctccagtgtcttttctaaaaacacaaatccagtcatgtcatttccttcttaaatcttctctttttcctgtcttagtttgcttggccttctataacaaaaatactttagactggatggctggaacaacagacatttatttctcacagttctggaggctggagagtccaagatcaaggcaccagcagattctgtgtctggtgagggcctgcttcctggttcatagatggctgtcttcttgctgtatcctcacatgacagaagggagtgaaagagctctctgaggtctctttttaggggtactaatcccatttatgagctccaccctcgtgatgtaatcatcttccaaatgtcccatatcctaataccaagacattggcgttagaatttcaacacatgaattgggggggtttgggggttggggggacatatattcagtctgtagcactcctttttaccaatatgatcaactttaggctccttatcataacatattagactatccattttataacccctgctcacctctctgatcttacttttcacttcctcttacagtgcatttcttttcttttttctttttttttaattagagaaagggtctcactatgtggctcaggctggtttctaactcctgggctcgagtgatctgcccaccttggcctcccaaagtgctgggatacaggcatgagccaccattcctggcccttacaatgcatttcatattacaatgatattgaattatttgcggagtttgagatgagattttaccctaaatataagctaagaagttagtctgttactgtttcatggatgctaacaatagatacgagactccgcagtcagagacaaagtagtttactactcacaacacagcaaaaagaatgagcaccacgtctatgcttcccttgcccccagagaacatgtggaagttgcagaggctgcacacagtgggttttcatcacaactgaggaacaccgaacttcaggaatctaccacttttatagtaagcacttagtaagcccagaggaagacattacctcatctctccagttgcttgttgcaaacacaaccctgaaaaattacctaagtaaagagtggccaagactttgcattcttggcatacccagtaagaacgtttaggaatgcttcaggcccatggtagattgactcttccaacaacccatccctcagcccagcattgtcttgacatgagtatgccactacatcagctacttttatttatcttaccaagagagactaggaccatcgctttaatttgtctcatacagcacttacttaacaagactccaagtagcaggataaaaacatcctgtaatattggtatcaactatgtccctcagtatcttggactaaatcaactgtgaataagccccagaggagaaagtagatcttactttatacagctaggatgtaatctaagtctggtctgttatctattttgacccatgcaagggagtttagactgacatgctaatctttggcctcgttgcagatagttacaggaggcgctagattacaggggccaaaaagcaacccccaagctcaaaggtggaatacaccatggcctactctttcctacatacaaacatgtagcctaaagaggctgaaataaagagtcactttatttcaggatttgtcattaaacttggatcaaccattacattgatttgtctaagccacatgggcagtatcactaagtagttgttacttcagttgccatgcatggcataatccaaagctgctcacatgtcagaagaagcatatggatttgtgtacatcagattaaaataaggttgtgccagtccctttgcttccatgtatacaacggggtccacattcaggagctgtcattgatggtatcaagcacagcaaaagaattaagaaccaccaatgcccatgtgaatttttctgtttcatagcaagcacatggtcagagataaaacagacgcaggtcagatggctggcctcagctgctgtttgattcaggtagctcactatatatttgttttgccaggatgcacttgcggatccagaggacaaagaaagtattaattgtcctccccatccctgtacttcctgaggtctcatgtgtttccttcctaggggctgaagttgttgctttccttctttggccacatagttaatgtgtcccattccagtagatataacttcgccttttctccaatcatcccctacttgtgcctgtagcttatagaagggtaagtacatatgggacaaatttagaaacctattatgtcttccattttggcctatatggaccactatagaatgactcagtgagcagggcactcaatcagatggtcattatggatatttatgatctgggaccttatcagttgaacaaaatgaatccaggtgggtaaacccaaattaagcttgaatctctaagcccccttttggctggctgccacccaagggatatatgaaacaaaccatcctgagattgcttttgggaaaaagaaagaagcaagataaccagggttgggccaggcagaatcccaaattttcaaaacagatgtatataatcccccactccttttgtcctgattatttcccaggaggctacaaggatgaaatgaaccctttctgaaggtggccacagttagtaagcaaactgcttcatacaggagtgtggaccaggaggaggtaagagaggtggagccagaaacatttttgagttgattttcaagaaggcctttccaagctctcaacaattccagatacctgaggatggtaggaagcatggaatgtccattaagtacctaactattggctcattgttaggcatatcatggtcagactatagaaggtctaggaaccccaaaacatggtcctcagtgctatagcttgaataggctaatcagattggagcagcaactccatatggtggagcagcaacaccataacctgaaaaatgtctatggtggaaaggcacgaggtgagcccaagaggaggtgacagaggtccctgctgggaaggggcaagggcaatcctccatgtaatgtggactccttcaccacaagaaaaggaggccaactgggcaagatacataagtctggtatgcagtggtatcttctgcatgaaaaacataccttttactttgtatccattctattgtggtgggttcattgccttatctagtgcagtgatggatcctagtggcaaatcccagtgaccaggcaatacagacttgttcagcgacttgatttcagtcggtcttatcagagagcaggcccttactgttactgtgggtatctatgtgagtgacccaaagtgtctgattggcagccacaatttgtttgtagtttgtggccccaaacaggaatatctttaatttaccaactgtagtcttccaagtggcagaccaggtgactacagtactgttagcagaccaagaatcagtaaaaatacggctagtctttgggagtattgcctaaggtaagggtgatggcttttcatttcagcccattgggctaactggtcattaccactcagtctcctggagctgtcattgaggttggacagctactgccccctactggacaccatcgggttttaacttagccaaagcatcagcaaaccaggccaaggcatttaagggaccattaagccagcagctttgcttcagacagtggccacctgtatacccagtgctttgtcctcaatgtcaaataagtcaggctaaagcaggaatcagatacatagaacagttgactctgtcctattaggcaaggttttgcattcacattcacttttgagcacctgctcactcatgtctcaaccaaatgaacttctaatgttttcaatccacctaaagatccatgtcaaatagcaaaatcttcattgttctctccatttatttctgttttggagatttcttggccctgcagccgcaaccacatggtctttcagcttgctgcccccgtggtcatgtaccattccttcttttgcctgcccagaggaaggtgagcaaaaacaaaggcactatttgggtggcttgctttaatcccacctctcaccattcagactcattaacagagagaatactggggtcactcgccccttaaccttgcccaccacctgggcatgatctcagggggtcttctcacccttgaacctaaggatacctgagaatgggcctctagggttcttgtccttactcttcaagaaaactatgtctctccagctgggtgcagtggctcatgcctgtaatcccagaacgttgagaggccgaggtgagtagatcacttgaggtcaggagtttgtgaccagcctggccaacatggtgaaaccccgtctctaccaaaaatataaaaattagccaggcatgggggcacacacctataatcccagctacttgggaggctgaggcacaagaattgcttgaacccgggaggcagaggttgcagtgagccaagatcgcgccactgcactccagcctgggcgacagagtgagactctgtctcaaaaaaataaaaggaagaaagaaaggaaaactatgtctctgtcagtatcctatcatcttttactgtcttgtcagttctggcatttaattaaccctatttacaaggtaataagttagctgcagatgctggcagaagacacaagactcccatcagagacgaaaagcgtcattactaatggcatagctaggagctaggagtacttatctgtttgcatgagtttccctcccctccaaggattatgggggcaatatggaggactcagatgggcccagcacacagtgggtttgcatgacatctgaagagtgctagattttgggaatctccagcttttagtaaatagagtagtaagcaagcctgcttgttctttgccctggtgggtgacattacctcgtcactcaagattgctcactgcaaaccccactctggaaaatggtcccagtaaagtggagtcaagcttttgcattcttggcatacccagtaagtacattcagggacattcaaggcccagggcagattgcctctcccaacactattgtggtatttccaaaactcatttgtgtctgcaaccactacagaaaagtttgatataatgaaattactgatatttgcgacctatatacttcctagggatagtaattctttttacaaattaatacagtaaatgccttgagagtttataaatacataattatatagctataattataattaataaatcatgtttctatttttccatttcaattttaagtaatgtattttgggtatataatatatttaggatttaaaatgaactatgacagagtacctactttacatttgtgtgtgctattataaatatagttatctttctaggccaaaattttataccaatttgtaaatgaacaaaaaaatatagtgaacatttatatatatatagtgagcaattgtttttctctccaagtacagtgacagaaaatataagcactggggacacagaacaagaatgcaaagaaattaattggaaaacatgtaggtcccaaagtattggttttgggaaaacatctggcctcttcagtactccagtggggagaagggccaccgtaggcagttttagtcaagtcttgggcattgaagtctgttaaagtaatcgtctcagctgaagaggaagcaaatagcaaaggccccagggagacagatatagaaaatatggtagccattttggggaaaaaatgtagaggtaggatccagaatattttgaggatcagctgccaattatctataagttaatcataaaggcacttactgggaacaaacagcagtcctgtagaatatgatttcagaatagggttcaggaagatgcctccttccttttcactgattgaaaggtggtcatatttgtgcaaaaggcaagaaaattcttagaattttggaatattctttgcctcactatgaggctacagctttataggaagctgtttatctagagaaatggcagaagcaggacaccatccaagcctcaggtcaggaagctactcactagctcactgttaataattgtgacatccctaatatcactgaagacagggctccaggagatctgtgtaggagcagattgttataatggactaggagctgggtggaagatgctctatgggtcaacaaggagaaaaaaggaaaacaaagcaaacaaatgaaaaacaaaaatgaacctgcagacagaaatttcaaaatatttgaagaaatctaatgctaacaaagcaaacaatattattcagattacgaattcattcctagtgggagagcataaataaagcaaaaaaataagccacacagagaagatatttgcaaaaccaaccaagaattagtatccagaatacataaagaactcctatagatcagtaagaaaaaaaaacaaatagccaagttcagaaatgagttacaacacaagaaggctatttacaaaagaaacaaatatccagcaaacatataaaaacattccacctcaattcgggaaatgcacattaaaacacagctgtaggccaggcacagtggtgcacgcctgtagccccaactacttgagaggctgaggtggtaggatcacttgagcccaggagttgagtccagcctgggcaagctatagcaagaccccttctattaaaaaacaaaacaaaaaactgtaaccgtcagattggcaaaaattagcaagtcagacaaaacccagtgtggtgaggatgtggagaaacaggaactcatacattactgttatgaatgttaacttggagtagctattttagagagcaatctcaaaccagaagtttcagaaattcttatgtacttaccaggagatatgtatgagaatattcattacaatattgggtaatcttgaaaaatgagaaacatgctaaatatccctctagagaagaataaatatattattttcatatgacagcatacttattccagtgaaaatgtatgaacccaggcaacttgaataaatctgaaaaatactgctttgagtaaaaaatgacacgattcatgcaagaccatttgtacaaagattgaaaacatgtaaaacaatactatgtcgtttatggatatatatatatatatatgtttgtatgaaatagaagcataaaaacattcattggaatgataaacacccaattcaggatagtagtctccaaagagggagagaaggtaatggaattggggacacaaaggaagtattaactttatctgttaggttttattacttaaaaaatgaaaaatccaaagcaaaatatcaaagtatttttctcaaaatctccatatcattgttattaccattaaatagctatgtgctttttttttaaaaaaaggagttcatcttaagagaactggacagacacaaatataaagttaaaaatcacattttgacctaatttgtttcccagattcctttcaagtgctgttctctgggtcagagaacttttaattctctttcacccttttcatacatttggagaaaatctaagtgtcataatctttatgtgacagatgaaagaagctcttggtgttaattacaggaagatttagaggaaaattatgaccacctaatgaaaaacgaaaaaaaatttattcactgtttcagagatattgggaaatgttttcacatttcagaagcatgatggacctgatcatagcagagtaatgtccttttaaatgactaaatcaagaccttcctgtaacttcagctcccttacttctgcttacctaccatcagagttttcttaagtatatatcctcttttgatctattatctccttcgctcttatactatttcctacccactccaaaattataaaagcagaccctaaaacaaaccgtcctccaaacaggatcagtttctgtatagctctaacaggttatactaaatgattaacttccaggccaggcacagtggctcacgcctgtaatcccagcactttgggaggctgaggcaggcggatcacctgaggtcaggagtttgagaccagcctggccaacatggtgaaacctgatttaccaggcttggtggcaggcacctgtaatctcagctattcaggaagctagggcaggagaattgcttgaaccctgaaggcagaggttgcagtgagctgagattgtgctactgcactctagctgggcaacagagcaagactctgtcccaaaaaaaaaaaaaatagattaacttccaaatcctccaaaaagtatttgcattataagaatattctcaaaaacataagaactcctcagttcaagaaataccgaggaagtatttagactttctgtaatgagaaggttttacaggaagcaaagtagcctataacatgggtccaaagggtcacacaaccttcagagggttgtcaaattagcttactgcctcaaactagtatcttcctctgttccattgatactagaaatattctcctgattttagcacttaaagttctctgtcccttctgctcattcccaaagattgaatttgcatacaggacaattttttttttttttttgagacagggtcttctctgatacccaggccggggtgcaggggcacaatcatggcttactgcagttttgacctcctgggctgaagtgatcttcccactccggcctcccagagtgctaggattacaggtgtgagccactgtgcccagccagttgcttgtttaggagaacaaacaggttggccttggtccaagtaaattatattgtttctagtccagccttcatagataatatctgatgggtctctgtcatttgaaataggagatgctggcctcctccccaaggtacctgctaaattcctattgtctatgcctttgttggtcctatatcatcattatctgtaggcagaatatagacatctttctcagtgaaaaaaaaaaatcagacaaaccactactgtaattccccattatccacggttttgctttctgtgatttcatttactgtggtcaaccatgatctaaaaatactaaggtattttgagagagagagaccacattcacataacttttcatacactatattattataattgttctattttattattagttattgttaatcttttactgtgcctaatttataaattaaactttaccatagatatgtgtgtatatgaaaaaaatagtatatatagagggtttggtgctatctgcagtttcagatattcactggggatcttggaatgtatccccaggagataaagggggactactctatttataacattctaactatttttacttttaccttttcctaatcttggttcttaatcactagctgaactgtgtatattacaatcagatctttctgtctgcatgccctttatcttgggccattcttggttctatctgaccatctatgttttgttgaatactacacactggaaaactatttataataataaaaacatctactgagcatttgctttgttcactgttctaagaacttttacaaatatcatttgtctcatttcatatgcataataacttcaggtaccattattacccctgttttatatatgagaaaatagaggcacaggaggataatttatttaatctgtgaaaatgtttgatgatacttctgtgagaaacaaagatgaaattatgtcaaagagctttgtaatacgtaaaacaaagtacgagcattgtactgttatctgcttcataacaaggctcaatgaatatttgttgaatgaatgaatgagtaaatatcattactgagttgcactgtgtcttgtgagggtagagtcctcagaataatgtaaagtgtaaatatgccaagcactgtgtctatagctcagtagttacccccaccaacatatactagtttccttcttctccttcccttttcctctaatttccaatcgaaatgactgtctgattgaatatctttaaaggtcatgatgaattactctgtaatatttgaagtgttatgttcagaaaggtcaaactttatttttcggtatgaagtgtcacacagatttgtttttcctgggcaaactttttttttttttttttccccaaagaaaagatggcaagaaatttagagcagggtgccctcttgaggaaattttagcatcttccttctcaagaactgacatcaaatgaaatgacaagtccagataaatgatgtacactattaatgaagctcagaaaaatgaaacattaaaaagtaagaataaccaaataccaggtatttgagaattaagattcttaactgttatgatctaatatagcaactgtaaataagaatttttatcatttatttatttatttatttttaatttttttttttgagacagagtctcactgtgtcacccaggctggagtgcagtggtgcaatctcagcttactggagcctccgcttcctgggttcaaggattttcatgcctcaccctcccgagtagctggaaccacagcttgcaccaccatgcccggctgattttttttgtatttttagtagacacaaagtttcactatattggccagcctggtctcgaactcctgacctcaagtgatctgcccatctcggccacccaaagtgctagaattacaggcatgagccaccactcccaggcttgtaaataagaatttttaaatgaaaacaaaaacctctagaagatatttcatttcttcttatttactcatttcttcaagtaatatttattaggcacctattctgtgccaggaactatgctgagcacagggatcaataaaacatggtctctgctttcatggagcttacagtttgtgagggagctcacactgaagagaaacaaacaaatatatatgtaattgcaaactgagaaaagtactatgagagaaatgaataggtactagaataaagaataacaagtaagttctatttagggtcatcaagggaaacctctctgagaggaaatatccagcagagtccgttggcttttccacctattccaagtcttcccatctaatatagacagtctacagatcctctttcctagccatggtctttcttatcttctcttatctctgcccctgtggtggactgagtcaatcctatctctgcccctgtgggcaagcagttagttctcattcgtccttctgcacctcactgtcactctagtaaccttgccttacagcagggatgtccaatcttttggcttccctgggccacactggaagaagaagaattgtcttcggccatacataaaatagcactaacaataactgatgagcaaaaaaaacaaaacaaaaaaaaacacgcaaaaaaatctcataatgttttaagaaagtttaagaattttgttgggccacattcaaagccatcctgggccacgtgcaagccaggtgccgcggtgtggacaagcttgctgtagagctgcacattcttcacagtaggtggtctgcttgattaaaaaatgtattccttactaatattgatagtccctcataggagaacatcaatgcattatcatgctaaaagggcccacttctaacaaggttaaggatgacaaatggacaaataatcctgcctgccattatcctctgaatagggagagataaataggcacgaagtaggctgagaacctgatcaggcaatactgtttggtcacactgaccttgaaatatctgaggtaccaagcacatagaaacctccaactggaagtaaaaatgaggaaatagatctgagaaaagagcccagaagaacaatttttagagtcttattttgttcaaagctgccatgttacacagacttactatgtaatggttggcctggctcattaacactcttgctgtggcccttgtaactaagcttctttctctttttttttttgaaatggagtccggctctgtcacccaggttagagtgcagtggtgcgatctctgctcactgcaacctctgcctcccgggttcaagcaagtctctgcctcagcctcccgagtaactgggattacaggcgcctgccaccacgcctggctaatttttgtatttttagtagagacggggtttcaccatgttggccaggctggtctagaactcctgacctcgtgatccccccacctcagcctcccaaagtgctgggattacaggcatgagccaccgcacccggcctgcttctttcttgaggtgggttgattctaccagactggaggatttaactgacttggagagtactgcctgcaagtgggtgggcctaccatgacttctgagttggcatttaggtgaccgtttgagtctgggatccaaacttggtttttttgtttttttttttttgagacggagtctcactctgtcgcccagcctggagtgcagtggcacgatctcggctcactgcaagctccgcctcccaggttcacgccattctgctgcctcagcctcccgagtaaatgggactacaggcgcccaccaccacgcccggctaatttttcgtagagatggggtttcaccgtgctggccaggatggtctcaatctcctgacctcgtgatccacccgcctcggcctcccaaagtgctggggttgcagatgtgagccaccacgcccggccctgggatccaaactttgaataagctgcctctaccttagttgtacccataaatagctttctttaagaaaactaatcatccataccttattaaccagaggtcctgaacaaaacgtttaactactttgaatctcagtttcctcacctgtaaattgggatttaacatctctgcttatttcgcattattacactttgagtataaataataggtactatgttggtcaaaatgtgctgaaactaatacacctacacattgctgctgttagatagcaatttggaaaatacaccaaacactgtaaaatgtgcaaacgtctttgacccaacaatttggttcctgataatttattcttgtgaaaaaattaagaaaaaaaatgtgaaaaaagatgtacagtgaagcatttactacaaaaaaaatattagaaacattctagatatctaacaataatagactggttaaataaaacatgttgttttatttgcaataaaatattggccagccactatgtaaattatattcatgtagaaagttcttggaaggaaacatgaaaaaataaaacaattgatagtatagtggaattacaagcatttttccttattaatttctctggatgttattactctaggagaataattaacatacttaaaacattttaaaattaaaaaaaattttgaccccatagtacatttttttcttatcatctcttgttttttatttagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaaggtaatggatactcaaaatcaaagactaataagaccagaaagcaaatgcttccttttatgatgtgaaatttcaaggaagaaggcctgaattaccacatatatacatggtagaacaattccaaatctccatacatctcagggaagtatttcacttaaattctgtcattttatcctctcagcaaccatgtgtgttaggtagtatcatctttttacagatggaaaaactgaagctcaggaagattaaaagtttgcccaagatgcaagtggcagaactagaattcaaatctagtcctgtcggccgggcgcattggctcatgcctgtaatcccagcactttgggaggccgaggcaagtggatcagctgagttcaggggttcaagactggcctggccaacatagtgaaacctcatctctactaaaactacaaaaattagccgggcatgttggcatgcgcttgtaatcccagctactcgggaagctgaggcatgagaatcgcttgaaactgggaggcagaggtttcagtgagcccagatagtgccactgaactccagcctgggtgacagagtgagactgtctcaaaaaaaaaaaaaaaaaaaaaaaaatcagtcctgtcttaactccaaaacccaatatttgacagggagtcataatagttactataggtggttagactcatgatggccaaatgcccatggcaatgtcctaaatgcttagtggtttagtggcctacgctttggtatcagccttcctgggtttcaacccagaatccactacttaacttgttctgtgtccttgagcaaattgcttaactcctctgtgcctcaatttttgtatgtatggaaaaaggttaataggattactgttaggttcagcatagtattacatttcagtaaatagaatcagaacaagtataacataggaaaagaaaggaattacgtgttgtttattgaagatgtggttataggtaattagtaagtgctattatacttgtggctttttaaaaatctgcagttgttagtaagcaaaagtagtaagttaaatagtgagtgttcatattaaatgcctataggtacaccttgaaggaataccatgtatgtcagtttctaaagtttttaatgtgacagatgagcttggttcctgctcattaaattatctaattgtagattggattgctgacaatgctactcacgagggctaatatatatttaaacagttcttacattttttcttaataattatcctaatagggaagccagtcttatagaattatgttgacgagaacagcagaagagattttaaagcaacttcaacaagttcaagatgatcattttcaacttttatctgaaataaagtgtgaacattgtcaaaatcaaaatggagttgtttctgtttaaaacaacaacaacaaaacctgacagagccagggaaggccatgaagagaggattcttgtgcttgtaagcctgattaaaaaaaaaaaaaatcacagactgtgcaaaaaccacagccttgcacaaaggccatcataaccttacacaaaaattacttcttcaaagacatttgcccagcaactgcctgtccaaccttgcactggcattatctttgttatcgatctttgtagccaaggatcatcatttgaaaacaattacgtaatcctgctcatttttcttttaaaaacttttgtcttcctttacttgagtacacatagtttagcaatgccctactaccagataccaaataaacattattttctttctttctttttttttttttttttgagacagagtctcactctatcacccaggctggcgtgcagtggtgtgatcttggctcactgaaacctccacctcccaggttcaagcgattctcatgcttcagcctcccaagtagctgggattacaggcatgcgccaccaggcccaactaatttttgtatttttagtagagacggggtttcaccatgttgaccaggctggtctcgaactcctgacctcaagtgatccacccgcctcgatctcccaaagtgccgggattacaggcatgagccactgcgcccagccaaacattattttcttttagagagactctgttatttaggttgactaaagcaagtgctgctgtattttcaaaatgtatcttttcatcaataactgggtctaataatttatcctctaaaattatatttaaattaaaatttgtctactgatacatggaatgggttccagatgcatgaatttcctatgcatgtatttttttatagatattaaaattcgaaacatcctgtcaagttcttaaggtccttggtgataaccagatgtgcattatcaagatcatcacttactttgttgatgattatttataaatgactgggccgctttctctttctcagtgttatcagtaccggatgaactaaataactgtcatgcctaagaggtcagattctggagtcagactgcctgggttaaaatctcagttcagccacttacttcctttgtgtcccagagcagattacttaggttccgtgtgctgtttcctcatcaatcacatgcaaatttaaaaacatacttgtctcccagagatagtaagatgactgcatgcaattaaatagacaatagtctcccttgttcaaaggaaatatattccaacacctccaatggacacttgaaactgcggatagtgtcaaacccaattcccgtcaataggaacacatttctgttcatatcttctacccacaaatttagtactttttccgtcttaactaagcacttatcaggcactatggccataatttttgcagtttggtatgcaacagcaaaaccagcatgagtttcttcttccttctttacagtttcacagatagatttgttcttacggtagagcttagcaaactcaacaaacaattttttcttattaagttgagagctttcaccttttcacttaaaggaaacacttcatagctgctctttggcatatctgaatcaccagtatcaataattttgagctttggggccattaagtaaaagaaggatgacttgaacacaagcactgtgaatctaatattgtgacaatgaatgggataactgagttggctgctaggtgactaactggcagggaatgtctacggtggggatatgctgaacaaaggaaggatttgtgtcccaggtaggatggggtgggatgaagcactatttcaacatgttatttagaatggcacacaatttaaaacttatgaattgtttatttctggaatgttctatttaatatatttagacttcggttgaacacagagacctgaaatcatgaaaagtgaaaacaaagatacagggcaactactgtataaaactcttataacagtgcctgtcccacaataaaagattggggaaagttagttgttactgttgttatttcgagaacctctcgattttgcagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggtgagttgaatggtactgctagacctgaatggccttgaaatttttttattatgaattatttaatatatacaaaagtgtatatttgacgtacaagcaaattattaagcaaaagaatacaacagacatatggactcatcccccaagaagtagaacatttcagtaccactatttaagaccacatagaggtttcctatgtcccagtttttaaacgcattcattccccctacgccgtgctcattcctgtaccccagcaactacttccctgaatcctgaatttatatttatttccttactttgtttcatacttgtttttattaaacagtgaatagatataagtatcagtaaaatacatgtaaagtataaataataatgaaacaacaaatactcatatactcaatatcaagtttaagaaaaagtatattaccattacctttgaagtcctctgagtggagtacctctcagtctcattctattctctcctttcacagaggcaacaactgtcttcaatcttgtgttatcattcccctgatttccattaccacatttatttgtatccttaaacaatatattgctcagtatttaaaggttttgaatttgatatacaaggaattatattgcatgtttttgtttttgttttgttttgtttttttgcagtgccctattctttctcgctcaaccttatgctgtttattttattttattttattttgagacagagtcttgctctgtcacccaggctgtagtacagtggcatgatctcggcttactgcagcctccacctcccaggtttaagcaattctcctgcctcagcgtcccgggtagctgggactgcaggcgtgcgccaccgtgcctggctaatttccgtatttttagtagagaccgggtttcaccatgttggcaaggatggtctcgacctcttgacctcgtgatctacctgcctcagcctcccaaagtgctgggattacaggcgtgagccaacgtgtccgaccactggtgattttatctatgttgctgcatgtagccatgatatattaattcttactgctatataggattccatcttacgaataagccacacagtattcattctgttattgacagatactttgtttccagttttttgttatttacaaacagtgctgcattgacatttttgaacatatctaggatatatatttaactggttgttataggtgtataggaatgcagttgatatttttgatcattgattacatatctaactaattcgctaaactccttatttgtttcgaatatttatcagtagattctttgaggttttctaatccctctgtcccagcttctaatttacatgctatgatagtccaatagttagtcatatttgtttttaacacacaaattagactttaaagtattattttttaatcgttttttacaacctctgatactaaaagtattattttgtatatgcaatgcttagctctgcattttttttgtatctcaaattttccttctaaagttattattttacatcctgaaatatagttcttagattttttttattattatactgtaagttctgggatacaggtgcaaaacgttcaggtttgttacataggtatacatgtgccatggtggtttgctgcacccatcaacctgtcatctacattaggtatttctcctaatgctatccctccccttgccccccaccccccaacaggccccactgtgtgatgttcccctccctgtgtccatgtgttctcattgttcaactcccacttatgagaacatgtggtgtttggttttctgttcttgtgttaattttcggagaatgatggtttccagcttcaaccatctccctgcaaagaacatgaactcattcttttttatggctgcatagtattccatggtgtatatgtgccacattttctttatccagtctatcattgatgggcatttgggttggttccatgactttgctattgtaaataatactgcaataaacatatgtgtgcatgtgtctttatagtagaatgatttataatcctctggatatatacccagtaagaggattcctgggtcaaatggtatttctggttctagatccttgaggagtcaccgcactgtcttccacaatggttgtactaatttacactccaccaacagtgtaaaagcattcctatttctccacatcttctccagcatctgttgtttcctgactttttaatgatcaccattctaactggcatgagatggtggtatctcattgtggttttgattttcatttctctaatgaccagtgatgatgagctttttttcatatgttttttggccacataaatgtcttcttttgagaagtgtctgttcgtatcctttgcccactttttaatgagttttttttttcttttaaatttgtttaagttccttgtagattctggatattagccctttgtcagatggatagattgcaaaatattttctcccattctgtaggttgcctgttcacgctgatgatagtttcttttgctgtgccaaagctctttagtttcattagatcccatttgtccattttggcttttgttgccattgcttttggtgttttagtcatgaagtctttgcccatgcctatgtcctgaatggtatcgcctaggttttcttctagcatttttatgattttaggtcttacgtttaagtctttaatccatcttgagttaattttttgtataaggtgtaaggaaggggtccagtttcagctttctgcatatggccagccagttttccaaacaacatttaggaaatagggaatcctttccccattgcttgtttttgtcagctttgtcatagatcagatgattgtagatgtgtgacattatttctgaggcctctgttctgttccattggtctatatatctgttttggtacaagtaccatgctgttttgtttactgtagccttgtattatagtttgaagtcaggtagcttgatacctccagctttcttctttttgcttaggattgtcttggctatacaggctctttttttgttccataggaaatttaaagtagtttttttctaattatgtgaagaaagtcaatggtagcttgatggaaatagcattgaatttatatattactttgggcagtatggccattttcatgatattgattctccctgtccatgagtgtggaatgtttttccatttgtttgtgtcctctcttatgtccttgaacagtggtttatagttctccttcagggaactacaatgtgaagaagtccttcacatcccttgtaagttgtattcctaggtattttatttctctttgtagcaattgtgaatgggagttcactcatgatttgctctttgtttttctgtttttggtgtataggaatgcttgggagttttgcacattgattttgtatcctgagactttgctgaagctgcttatcagcttaaggagtttctgggctgagacgatggggttatctaaatacacaatcatgtcatctgcaaacagagacaatttgacttcctctcttcctgtttgaataccttttatttctttctcttacctgattgccctggccagacttccaatactatgttgaataggagtggtgagagagggtatccttgtcttgtgccagttttaaaagggaatgcttccagttttgccaattcattatgatattggctgtgggtttgccataaatagctcttattatttttagatatgttccatcaatacctaatttattgagtggttttagcatgaagcggtgttgaatgttatcaaaggccttttctgcatctattgagataatcatgtggtttttgtcattggttctgtttatgtgatggattacatttattgatttgcatatgttgaatcagccttgcatcccagggatgaagctgacttgatcatggtggataagctttttgatgtgctactggtttcggtttaccagtattttattgaggattttcgcattgatgttcatcagggatattggcctgcaattttctatttttcttgtgtctctgctaggttttggtgtcaggatgatgctggcctcataaaatgagttagggaggattccctctttttctattgtttggaatagtttcagaaggaatggtaccagctcctctttgtacctctggtagaatttggctgtgaatccatctggtcctggacttttattggttggtaggctattaattactgcctcaatttcagaacttgttattggtctattcagggatttgacttcttcctggtttagtcctgggagggtgtatgtgtccaggaatttatccatttcttgtagattttccagtttatttgcatggaagtgtttatagtattctctgatggtagtttgtatttctgtggggtcagtggtgatatcccctatatcattttttattgtgtctatttaattctctgttttcttctttattagtctggctagtggtctattttgttagtcttttcaaaaaaccagctcctggattcactgatttttttgaaggatttctcatgtttctgtctccttcagtactgctctgatcttagttatctcttgtcttctgttaggtttttaatttgtttgctcttgattctctacttgttttaattgtgatgttagggtgtcaattttagatctttcctactttgtcctgtgggcatttagtgctgtaaatttccctctaaccactgctttagctgtgtcccgcagattctggtacgttgtgtctttgttctcattggtttcaaagaacttatttatttctgcttttatttcattatttgctcagtagtcattcaggagcaggttgttcagtttccatgtagttgtgcggttttgagtgagtttcttaatcctgagttctaatttgattgcactgtggtctaagagactgtctgttatgatttccattcttttacatttgctgaggaggttttacttccaattacgtggtcaattttagagtaagttctatgtggtactgagaagaatatatattctgttgatttggggtggagagttctgtagatgtttattaggtccacttgatccatagctgagttcaagtcctgaatatccttcttaattttctgttgtgttgatccatctaatattgacagtggggtgttaaagtatcccactattattgtgtgggagtgtaagtctctttgtaggtctcaaagaacttgctttatgaatctgggtgctcctgtattgggtgcatatatatttaggatagttcgctcttcttgttatattgatccttttacctttaaggaattcccttctttgtcttttttgatctttgttggtttaaagtctgttttatcagagactaggattgcaacccctgctttttttttttctttccatttgcttggtaaatcttcctccatccgtttattttgagcctgtgtgtgtctttgcacatgagatgggtctcttgaattcagcacgctggtgggtcttgactctttatccaatttgccagcctttgtcttttaattgaggcatttagcccatttacatttatggttaatattgttatgtgtgaatttgatcctgttatcatgatgctagctggttattttgtacgctagttgatagtttcttcatagtatggttggtctttatatattggtatctctttgcagtggctggtaccagtttttccttcccatatttagtggttcctacaggaactcttgtaaggcaggcctggtggtgacaaaaatccctcagcatttgcttatctgtaaaggattttatttctccttcacttatgaagcttagtttggctggatatgaaattctgagttgaaaattcttttctttaagaatgttgaatattggcccccactctcttctggcttgtagggtttctgcagagagatctgctgttaagtctgatgggtttccctttaagggtaacctgatctttctgtctggcgccccttaacatttttttcttcatttgaaccttggtgaatctgatgattatgtgtcttggggttgctcttcttgaggagcatcttaatggtgttctctgtatttcctgaatttgaatattggcctgtcttgctagattagggaagttctcctggataatatcctgaagtgtgttttccaacttggttccattctcctcatcactttcaggtacaccagcataggtttgggaaatagtcccatatttcttggaggctttgttcattccttttcattattttttctctaaccttgtcttcatgctttatttcattaagttgatcttcagtctctgatatcctttcctccacttgatcgatccggctgttgatacttgtgtatgcttcacgaagttctcgtgctgtgttttttagctccatcaggtcatttatgttcttctataaactggttattctagttagcagttcctgtaatcttttatcaaggttcttagcttccttgcattgggttataacatgctcctttagcttggaggattttattacccaccttctgaagtcttcttctgtcaattcatcaaactcattctctgtccatttttgttcccttgctggcaaggacttgtgatcttttggaggagaagaggcattctggtttttggaattttcagcatttttgcacaggttttccctcatcttcatggatttatctacctttgatctttgatgctgatgacctttggatgggatttttgtgtgggtgtcctttttgttgatgttgatattattgctttctgtttgttagttttccttctaatagtcaggcctctcttctaggggcctgctggagtttgctggaagtccacttcagaccctgtttgcgtgggtatcaccagcagaggctacggaacagtaaagattgctgcctgttctttcctctggatgctttgtcccagatgggcaactgctagattccagctggggctctcctgtatgaggtgtctgccgacccctgctgggaggtgtctcccagtgaggaggcacaggagtcagggacccacttggggaggcagtctttcccttagcagagctcaagcactctgttgggagatctgctgctttcttcagagctggcaggcaggaacatttaagtctgctgaagctgtgcccacagccactccttccccaggtgctctgtcctagggagatgggagttttatctataagcccctgacaggaactgctgcctttctttcagagatgccctgcccagagaggaagaatctagaaaggcagtctggctatagcggctttgctgcgctgtggtgggctccgctcagttcaaacttcttggaggctttgtttacactgtgaggggaaaaccgcctactcaagcctcagtaatggtgacacccctccccccaccacgctcaggcatcccaggttgacttcagactgctgtgctggcagcgagaatttcaagctagtggatcttagctttctgggctccagggaggtgggacccactgagcaaaaccacttggctccctggcttcagccccctttccagtggagtgaacggttttgtttccctggggttccaggtgccactggggtacaaaaaagaactcctgaagctagctcagtgtctgcccaaacggccacccagttttgcgcttgaaacctagggccctggtgctgtaggcaccctagggaatctcctagtctgaaggttctaaaaaccgtgaaaaaagtgtagtatctgggccagataccgtccctgccggcactgtgcatcacggcttcccttgactaggggagggagttccctgatcctttgtgtttcccaggtgaggcgatgccctaccctgcttctgctcaccgtctgtgggctgcacccactgtctaaccagtcccaatgagatgaactgggcacctcagttggaaatgcagaaatcactcaccttctgcattggtctcactgggagctgcagaccagagctgttcctatttggccatcttgctgagttgtcctcttgactccctttagtatagatctttcggtggtcaactctctctggttttttgtttgtttggttttagtttttttgggacagagccttgggctgtctcccaggctggagtgcagtgatgtgatctcagctcactgcaacctctgcatcctgggttcaagtgattctcctgcttcatcctcctgagtagctgggactacaggcacatgccaccacgcacagctaatttttatatttttagtagagacggggtttcaccatgttggccagactggttttgaactcttggcctcaagtgatccacctacgtcagcctcccaaagtgctgggattacaggcatgagccaccacccccagccaactctcctttttaattgttaagaatgtatgcctcttgaaaaaaaaatgattatcctgtgtacacagtcctaggaatctatttttctcagctctttcagcatattattttgctactttctgccttttattattgctcttaaggagtctgttattggtctgtcattcctttatacatgatgtatcttttctctcaggctgcttttacattttgctctttgtttggcattctacagttttactacagtgtgtctaggtgtggcctttttaaaaaatcctgtttggtatacattctgattattgcatctcagttctgccaaacatatatagctgttatctttaaatatcacctctccttcattccctttactcttgcctttagggtctccaattatatatcttttaaggctttttatctaatcctccatgtcttttaacttctcttttatattctcatctccttgtctctttctgttgcgtcctaggtaatgacatcagatctgtcttcgagtttactaagtttttcttcaaataagtccaacctgttgtttaccctatccattgaactgttaatctttgtgatgacatttttcacttctaaaagttctatttggttctttttcaaatctgcctggtaattttgataatgcttgctataaagatccagtagaaaaattaattaacattgtgaactcactaataaacacatgattaaaaaatctcaaccccattcataaatgaactacaagttaaaatagcagtgaaatgtctttcataaccataagggaaaaatgcagtaagcttgataataccaaatgattaatttctgccagcatgtagggaaataaaaacttttacatattgtcatgggagtgttaattggtaagaccatttggagagtgatgtgacaatacctgtttgaagatatccttcaccccagcagttccccttctagctgtctagcctatggaaaaatctcacacatgtgctacaagggatatgtaaaggaaacattaattgcagcattgtctgtaatagtgaaaaaaaatgggaatagcctaaatgttcctcagtaggaaaatagataactatattgtggtttattcaagcacctcaataattgaactattaccaacatagatatccaaggtatagtgttgagagaaagaattgccaaaggatacatgtccgttgccataatgtaaacatttgaaaacacacatacaaaatttatatattgtttatggatacatacatatatacaaaagtataaaaacatacatctttagttgaatgataacagaaacaaaagcatatcaggcaaaatgttgacacctttttaatctagataatcagtatgtaatggttatattattttctgtactttttataattaaatatgaaaataattttttaaagatttagactttgtaccttttccatgatttatcacttgtgctgagagataatgtagaggtcttatttcgaaaattcctcagttaattcctgtgccaggctgggcacagtgactcacaccataatcccagcattttgggaggctgaggtaggagaattgcttgagcctaggaattcaagaccagcctgagaaacatggcaataccccatctctacaaaaaacacaaaaattagccaggtgtggtgggatgtgcctgtagtcccagctacttgggaagctgaggcaggattgcttgagcccaggagtttgaggctgcagtgagctgtgatcatgccactgtactccaacctgggtgacagaacaagaccctgtctctaaaaaagaaagaaagaaaaaaatacttacaccaaatgtaatttattgaggattccatgtatgtctgaagtctctggttccttcaaatcaggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggtacgtgactcaaaggatcaacagtaaaaggaacttcatgagtataggaatatttctgtgccttcccttccactgtttactcccaactcctagttaattattttgatttctaactgatatgttgcattgttttataaactaaattatagtaatataaatttattttatgttaaatattagttttaatttcaacatcatatcttcactttaaatttttgttataaaagtaattcacatttagtgacaacatgtgaatgtaacataaacctcttttcacattcagcgcctatatttttggggaggagggctttaattttatgtttatgctaatactatgatatttgagtttttttctttatattttcctgaaatgccttttacttaacctttttgaagatcacttttatagatgagagagtgtatatatgtgtatgttttatgtgtatgttggggttttttgtgtgtggagtcaatctgagagtctttctctttcaatgaaggagttttacccattaatagtcattgttataagataaataatcaggtctttttttttcctgctatctttctattcttagtgttttcagcttaacgttttgttttgttttgtttcctgtttcctttgctttctgctctttggtatatggattagatttgatgttgttatttgattttgaattgcctaatgttttaggagggtttaggagtggctacttttaaatttatcaaaaactttttaaagcctgaatcagagtcaagagcaaaaatgcatctattgattcccacctatttaagacaaaaaatttagcacagatactcatcactcttttagtacttgttaatgtaatctgagatttccccctaattattataatcttgatcttagtttttaaattacacattatcttttttttaaatgatgtttatatgtgcactcacttttatcgccagatttagaattattattcagatttcatcttacatccctttttatttttcttctggattctgggcttacttggcaaatttgtctccatgtaactaaattgactttttgttctataagttttgctttctttctgcctcctatatagattgtattttgggttctatttttatttccttgtcttacctatatttctttttatctcatttcatttccttttaacttccttccattactttttcatttcactctgttttcttcttagaataccctgtttctgtttcatagaagccatctctttttgcactaagtcgaggataccagttgcctgaaattttcctctggatccttctctagatcattttcagaggtatgctgcttatcttcctgacagtgtttctttttcactttcctatagtatgtttttttgtagtccttactgaatttttccctttatttctcaaacaaaatgatatgtgtttagagtaactatgtggcaaagattgtctttaatcccacatttgtgttatggagaactccatcttagaccacctctggagagcagatagatgaacacaatttccactcaaattacttttctctgcttggcttttatgcagtatatccttgctctgctaatggggcatcttcttcattctccaatatctgaaagcaatagagtgtatgaaatttcaggtttcctacgtatgctactaccaggtttattcattttttaatattttctacagctcttcacttgtggagatcacatcctccagaatgcactacattgtcttcatcgctgccttatcatgcctgcccacttgttttctgagatttgaaatcactgcctagatgttataaaatataaatataataaaagattgtggaaaggagaatatagggatgggaagcctcagagatagaagaggttgtgttatagtttgtccacctgaatagaagagaacagttatgcagttctgtttggttgggcaacggaaccttgagagtaggagcagtgaaggctaagagggcttggctctaaagcaccttcccctcctttgctttaggcagctttataaagtgaagccaggaaatgcaatgaggtgatacctaatatagttttttctcagcctggcaattatacttaattcattcctacctgattgaagcattaagtttttagtaagttttcattctgttctacctcatattaatatgttagtgagaagttagaagaggctgcattgggggctgctgttcagaaaccgttgtgaatgctgtattatgttagtgatttttcttatctttttcatttaaatagattataaattaattaacatcctttataagtgataattacctttttgtgtcttttctcaggccatgcacagattgtccatctccttttagaaagaaataagtctggaactatcccatctgacagccaaggagccacacctttgcactatgctgctcagagtaactttgctgtaagtaaaacaagacaatgctcttttttcttagtgaaaattgttatttttatataattgtagattcatatgtagttgtaggaaataatacaacaagattgcatgtacccttcacctagttcactctgtttttatttatttatttatttatttttccaataagctttttgcactcctacacctaattcactctaatgataacatccaatacaatatcataaacaggaaattgacattgatacaatccctgatcttattcagctttgcccagatttacttagactcatttgtctgtttttatgtagcaattatcttttaacaatggttcatgctgttcactctgtgatgcaagtgatagcctgaggtttttttaagttgttagtcacatctgaagttttatacagattttattttaatgttaagcataacattttactttactgtaagaatacttcatctttatattacttttatagcactaagaacatcttagtgttcagccacgtgtaattgtccttaaagcagtgtggcaaggctttggaactagaacaatctcggctagaatcttgtctgtgcagtttgctaaactgtattaccttacacaagtttcttaatcttagtttcttcatatgtaagatgaggataattataccttttcttccaggattgttgtaaagattagagaaaatttatgacaagtgcctgctgtataccttagcatagagcaggtactcaagaaatagaatgtgctctcattactactagtgttgataattatgtatattatacgtctgagaatgcaaaaacgaattatttccaaaaatactgaatagtattcatagttcttcccctctactttctcatccattatgtccccagtccaccctgcaacatgatagtgtctaggctacttcagcttcctgagtatgaatgaccatcaagaaccagattcatccaaggatgcacatgttaaaacagattttgctgccttctacatgggtatgcatagtgaaacccttcgtttcatcaaattataataatactatcaggccggacacagtagctcacacctgtaatcccagcactttgggaggcagagatgggcggatcacctaaggtctggagttcgagaacagcctggccaacatggtggaaaccccgtttctactaaaaatacaaaaattagccgggcgaagtggctggcgcctgtagtctcagctacttgggaagctgaggcagaagaatcacttgaacctaggaggcggaggttgcaatgagccaggatagcgccactatactccagcctgggcgacagagcaagacttcatctcaaaaataaataaataaataaataatactatcatcaagcgtagtataatttcatctttgtgacctctccaaatgctctattaaatactcagatctctaaaatatcttatcttcacacacttcctactctggtatccagaacaactattcctataatccttgcttcttgtattcctaataacttattcaatttaccacctagagttttgacaaatcattatctattatcacctaacaaagcagtattttaggagaagctttttcttattacaaatagataggaaattaacctgaccgagtctagtcaatctatggaaatcacagctcaacccataaatcaacacaaggctattagataagtcatgttatcccctgtttacagaaaacaaaacaaaacaaaacaaggttccatgagattaaatgacttgctcatggtcttgaacccaaaatttagactccaaatttaatatatatatacagacaccaataattaaataggtgtgctaatggaaacaagaaagaatggtagaacattattctttataatgactcaataatataataatataataattgtattcaaagaaatattttgttggataatctgccaattccagagttgatttttaataattatacaaattatataagctcagtttcaagtcccttgatctccttgtcctctattaactgacaagaaattacaactcgttccttgaaaaatgcagacacattcccctacacacacagagccctgtaaacattcatcattaagtaaaaacatactcagcaaagaaatgtttgcaaattagtaaaagaaaacaaagcaaaaaatcacaaacttttacctcagtaactcaacaaatagtcttaaaagtagaaagcagtgtgtgatgctgtggaaggagtgctgtgatttaaccctggattcttcctttatctgccaccaatatttatatgaccttggaacctacatttcttcatcagtaaaataaggaactggattagatgagcccttgaattcttctttctataaaatactgagaatcaacattttatacatttttgatcagatcacagcctccagcactttttgtctgaaactcttttacctccattcaatcaaaagtttctatgatctttctaaagtttatgtgagtctgagttcagaataaagaggcaatttaaaatgctggaatattaacccccaataaaattgtcaggcactaatagaattgtcaagggtcctaattttttttgttgtttttgttttgtttttgtttttgtttgagatggagtctcactctgttgcccaggctggagtgcaatgatgcaatctcggctcactgcaacctccgtctcccgggttcaatcaattcccctgcctcaacctcccgagtagctgggactacaggcatgtgccaccatacctggctaattttttttatattttagtagagacggggtttcaccatgttggccaggatgctgtcaatctcctgaccttgtgatccacccacctcagcctcccaaagtgctgggattacaggcgtgagccactgcgcccggcccagtcctaatttttgtatgattccatagaagaaggacaattcagtaataaaggaattgctgaataaatatttgttttaatgaattcagcactgcatttctcagtaaccatcaatcagtattcaataaatgcattaaccatttcaaaaatgtttagtaactaatcacatagttccagtttgttctggatttaaggcaaaagcaaacaaacaaaaaacacagtgagagaatgcagaaccttctctggaggcatgcctgaatagatggatctcatgtaaaatgtccaagaaaacatgtattttatgggccaggtacagtggctcatgcctgtaattccagcactttgggaggccaagatggatggatcacttgaggtctggagttcaagaccagctttgccaacatggtaaaaccccatctctactaataatacaaaaattagccgggtgtgatgacactcagctacttgggaggctgaggcaggagaatcacttgaacctgggaggcagaggttgcagtgagccgagattgcaccactgcactccaacctgggcaacagagtaagactccctctcaaaaaaaaaagaaaaagaaaaaagaaaagaaggaaagaaagaaagaaagaaaaaggatggagaagagaagagaacaaggcagaaagaaagatttaaattttggtcattaataaataaaacactgaatacttctgagttttctaactctcactcaaacgatgacctataaagtttccaagcttgattgaagatgattattttccattttgaggatgttgaatgggagagttaggttatgtttatgaagtgttatggacactacaactaatttgtaaggacagaggattgttatcttcgatggaaattgtagttctgtcattaataaaaagataatttaatttgattcaaaagcaaggggaaaatgctttgcttcttaatggaattcacatattattatatgactttattaccacagaaaatactactgttttgtctccattttttaaatcaagttttcttacaggaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacaggtgagaactggtggacacattcaatttgctttcatttaggttccaaagtgtagatgttgctataaaatttgtaaaatagcaacttgaaatcattgttcctaatctaatattgtttgactttggtcttcagttttaagtttgggtttgccaggatgtcactccaaaggttttatttcttccaagtattatggcaaagattagcatgtttctaccaaatgaatggttgcatttggtttaaaaccctggttgctccttagacatgattatggggactcttctgatcatttatctttttgtaaaaaaaaaaaaacctacactttaaaactatccatatttagtagtcatgaattatattttcaaaaatttagaattttatttaaggaatgcacacatctaagtgtattctcaccagtctcctttactgtgctcttttctcagttttgaatagcattaccacatcctgaatctcccatttttagagagaacctcccatggctctaagatgcttcaaagcttcaaatcaaccttgcttgaaaaactcttactagatacttcttttaatttctttctctaatagaagaggcctttacctatgtgttggttaatgaaaggtagtttttctgcctcagtgtcaacttggaggtctcttccttgtgtactgtatcgtacttacaactcagaaacagaaggagaaatcacataccaccacaataacactgaatagaataaaaaatcagtgatgggcttctccatgttattttttttatttgtagaaacatgctagagccatttgcatctactgttatcctgaataagatttttcttggccaccaaaactactgatgcaacagtagggagagagaagggaggggagttgctttacttaaaaaaatctccctccctataccgagacaaccacagcctcaaaaaaaaatattttaagaagacaattcaattttacaataaagactttaactttcaaaagtatttctctatgaaagccttacagcagatcttaaatttctttttttttctttttgagacggagtctcactctgtcacccaggctggagtgcagtggcatgatcttggctcactgcaacctctgcctcccaggttcaagcaagtctcctgcctcagcctcccaagtagctgggactgcaggtggacgccaccacgcccagctaatttttttttctttttgtattttagtagaggcggggtttcaccatgttgcccaggctggtctcgaacttctgagctcaagcaatccacctgcctcggcctcccaaagtgctggggttacaggtgtgagccaccgtgcccggccagcagatcttaaatttcttaaggggcatagtgcagacacataggatattgactttataaatgatctgaacatttaattttttgtcagttttccattatatattcttccactttatcactagctttgattttagtttaactttttcaggtatttgaataaggcatgggcaaggatacttgcactctttgaccaaaagtatctcatatgcaccatggttgaagttcagacataaattcttctcagattcattaatttgctggtttctttcttcaatggggattttattatgtcagagatgccttcctgacatttcttttctgtgaaagtgagttcctctccgtcatccctctacagggtttttttttttccttcccattaaaaagaggtcttaccaatagcaatgtatggacattatttagatcctgacttaaataaataaactataaaaaatgttaaagccatcaggaaaatgtcaatattattgaacattatagaatttctattagtattttttaggcgtgataacagcattatggttttaccagtgattaagctattgtctctcagcttcgtgttgatccttttgtcctttctttgcaatgctgggcctgggtctctgtaaatcacatttcccctttgccacaggtgctcttttagagtccaccaatagagagcattggagggagactggaaggctggaagatggacaagggattacatctttctgtttgtgtcctgctcttgcttttgtctcattttctttttttagaaaaaaaaagttaaaaaataataataatagtaataataagatgggatctcactgtgttgcccaggctggtctcaaactcctgggctcaagcgatcctcccacctcagcttcttcccaaagtgctgagaatatcataaggcagatgaaagcatcatataatatctgtgatatttcagtgatttcacatttgaagagcataagaacccttttcccccaaatgaaaaggggggaacccttttcccccaaatgaaaatttataaaacacctaacatataaagcaagtaagggttgagtggttctgactaaatcagaagtggagcattatccactcgactgtctattccctcagctaagtatttcaggtacctctatagaaagctgttgttctgaagaacatggtttggaaaaccctgggctacatttagttttaaggtgacttctaattctgaaatgctacaattctgtggtgtggcatcaagtatgaaatatactctatagataatatcaatgtcaaatttttttaaaaaataaaatttcaattaagtaaaagataaaattaatgatcatattaaaggaaattccccatttatgactatttgaatttatttttatttatttatttatttgagacagagtctcactctcttgcccgggctggagtgcagtgacatgatctcagctcactgcaacctccacctcccgggttcaagtgattcttctgtctcagcctccctagtagctgggactacaggtgcccaccactatgctggctaagttttgtatttttagtagaggcggggtttcaccatgttggccaggctggtcttgaacatctgacctcaaatgatccacccacctcggcctcccaaagtgctgggattacaggcatgagccaccgcgcctggcctgaatttactttatttaaaaataaccttaggccgagcgtggtagctcacgcctgtaatcccagcactttgggaggccgtggcaggtggatcacctgaggtcaggagtttgagaccagtctggtcaacgtggtgaaaccccgtctctgctaacattataaaaatgagctgggtgtggtggtacacgcctataatcccagctatttgggaggctgaggcagaagaatcgtttgaacctgggaggtggaggttgcagtgacctgagattgaaccactgcactccagcctggatgacagagtgagactccatctcaaaaaataaaataaaaataaccttgaatttagctattgttactccctctttgaaaagtgctgtaagtttatatagaaacttaattttttaaaaatataactttatattatggaaatcttcaaacacattcaaaagtagacagttgtccagtgaactcaatatagctctcacccagcttcaacaattatcaatacgtggctaatcttgttttatttaaccacgattcatttcctctacttctgattgttttgaaaaaaattctagagtcatatcctttcatctgtaaatgtgaatgttctaccctgtgctgtctttcatgttatagcacttcagatatttgaagttactcacgcctgtctgaatcttgtctaggtcaaactaacattcagtcatttaggtcagtggttcccaaattcaagaatggcataagaattactagaggtgtttaaattcagattcccaggctatatggacaaagattctatgtcaaatcccgtagcaagtcctgttgactccacctccaaaatgtgttctaaatcattctgtttctcttcatctccattgcaaccaccctaatcagaccaccatcatttttcactcagtctactgccaaaatccttactggtctccctgcttatattctaatctactacaaatactttctcctcagaagagctagagtgatctgtttaaagcataaatcagataatatcactccactatataaagcccttcaaatgtcttccatcactgactgataggaccatttgtgatctggccttttctatgtttctgacttactccactgtcacttactgtgctgcaactacccttccttccttaaacatacacagtcgttcctgtcctgtactaactcttccctttgctcaaaatacgctgtctttttcatggttcaggtctcaacttaaatgtcagctcataaccaccaatcaaaagtagtccctcagtgattctacatatcaaaatagtttttattactttaattataccaattatcactatataataactttattgatggggaattgttttgtttttgttttgttttgttttgtttttgttttgttttgcttcccttcctagaatgtaaccttatctattgtattctttgctaaacacccagcattataatactacccagcccaaaaatctgcatccaggtttgctctgtggatcaccctttatgaaagagacattgttctaggccttatagagccataatacttagaactggccaaggcctctaaagtgttattgtggctaattcaaacctatagagggatggcataagccaagcattacactggagtaacatagagaggagtcagtgtacatgaaacacatttaatcaaaattactctttaaaacctctggacagcacaagagaggaggccatattccatctcagtttttctccagtgaagcaaattcctgtttcttttcttttctttttttgagatgaggtctttctattttctccagactggtctagacctattgggttcaagcagtcctcctgcctcagcctcccaagtagctgggactatagacatgtgccacctcgctgtttcttaaattgagccctggggaagtagctggcttgtagctgatattgtattaaaaatgcactcaatgcagcaagatgtgcgtgctttcagtaccactggggtacttcagccaactgaaggaacagtgcatgtaaccaatggaaggaacagtagattgatgtctccagtcacatgaccccttaggggcatatgcttattgagtgggttgttgggcagaattgtgtacatcatttaaatcattcctctttgttattgttttcttgctctcttaaagagaaaaagagaaaactaatagctgaaaagagaaaactagtagctgagaagaggataccatttcagaccaacaggatggaaaggaagaaaatagcaagaagagaaaggtagaaggaaaggagaaagtgtgagtaatacatatgaataggaaggaaggcagaatctaaaaaagcaaaaaataaattagtgaatccttaaaatggagattgcatttattcaaaatgatggggaaatcaagagaggaaaagacatataataatttaaaaggtgaagttgttattgactagttcatcactttctgttggttcccttttagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtgggctaataagagtactcctaataagtctctcttaacaggtaggaattcttgcatactctgtttaagataaagctttccttagcagaaagctgcacaagtacaaggatgaagggatgatcacacaacatggcatgaggaacctcaagttctactcctagctccacttgttgggagttgcttgatacaggaaaagtaatttcacctgcctgatcttcacttttattttatataaagggggactgattcctagccagtccaatttacaagcttattgtaaaaatctgatgtagacaacgtatgtggaagcatttccataagaataaagcattaaaggaacaattgttattgtttttcttctattcattttaataaatgcatttaaggaacaattgttttttctactcctactcattttaataaaagctatttatattagacattctcattatatttgtgcttttccaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagaggtagaaattctgtcttttctatattgtttgctccaaagaatttagagtatttcttctttgttgtaaacataagtaaaacaacagtttacaagatgaagagatcacccacaaatccatctgttaatcatgactattatttgtccatgttctcttccagtctttttctatatatataatttaacatagttataatataggctgggaataattttataacttttataaaagattacatggcatacacatgtatgcatctataaacataaatatatgattttctttttttttttaattatactttaagttctagggtacatgtgcacaacgtgcaagtttgttacatatgtatatatgtgccatgttggtgtgctgcacccattaactcatcatttatattaggaatatctcctaatgctatccctccctgcttcccccatcccacaccagcccccggtgtgtgatgttccccaccctatgtccaagtgttctcattgttcaattctcacctatgagtgagaacatgcggtatttggttttctgtccttgcgatagtttgctgagaatgatggtttccagcttcatccatgtccctacaaaggacatgaactcatcttttttttgtggctgcatagtattccatggtgtatatgtgctgtattttcttaatccagtctatcattgatgtacatttgggttggttccaagtctttgctattgtgaatagtgccgcaataaacatacgtgtgcatgtgtctttatagcagcatgatttataatcctttgggtatatgcccagtaatgggatggctgggtcaaatggtatttctagttctagatcctttaggagtcgccacactgtcttccacaatggttgaactagtttacagtcccaccaacagtgtaaaagtgttcctatttctccacatcctctccagcacctgttgtttcctgactttttaatgatcgccattctaactggtatgagatggtatctcattgtggttttgatttgcatttctctgatggccagtgatgatgagcattttttcatgtgtctgttggctgtataaatgtcttctttagagaagtgtctgttcatgtccttcgcccactttttgatggggttgtttgatttttttcttgtaaatttgtttaagttctttgtggattctggatattagccctttgtcagatgggtagattgtaaaaattttctccagtttgaaggttgcctgttcactctgatggtagtttcttttgctgtgcagaagctctttagtttaattagatcccatttgtcaattttggcttttgttgccattgcttttggtgttttaatcatgaagtccttgcccatgcctatgtcctgaatggtattgcctaggttttcttctagggtttttatggttttaggtctaacatttaagtctttaatccatcttgaattaatttttatataaggtataaggaagggatccagtttcagctttctacatgtggctagccagttttcccagcactgtttattaaatagggaatcctttccccattgcttgtttttgtcaggtttgtcaaaaatcagatgattgtagatgtgtggtattatttctgagggctctgttctgttccattggtgtatatctctgtttaggtgccagtaccatgctgttttggttactgtagccttatagtacagtttgaagtcaggtagcgtgatgcttccagctttgttcttttggcttaggattgtcttggcaatgcgggctcttttttggttccatgtgaactttaaagtagttttttccaattctgtgaagaaagtcattggtagcttgatggggatggcattgaatctataaattatgttgggcaatatggccattttcacgatattgattcttcctatccatgagcatggaatgttcttccatttgtttgtgtcctcttttatttcattgagcagtggtttgtagttctccttgaagaggtccttcacatcccttgtaagctggattcctaggtattttattctctttgaagacattgcgaatgggagttcactcatgatttggctctctgtttgtctgttggcatataggaatgcttgtgatttttgtacattgattttgtatcctgagactttgctgaagttgcctatcagcttaaggagattttcggctgagacaatggggttttctaaatatacaatcatgtcatccgcaaacagggacaatttgacttcctcttttcctaattgaatacctttatttctttctcctgcctgattgccctggccagaacttccaacactgtgttgaataggagtggtgagagagggcatccctgtcttgtgccagttttcaaagggaatgcttccagtttttgcccattcagtatgacattggctgtgggtttgtcataaatagctcttattattttgagatacgtcccatcaatacctagtttattgagagtttttagcaggaagggctgttggattttgtcaaaggccttttctgcatctgttgagataatcatgtggtttttgtctttgattctgtctatatgatggattacatttattgatttgtgtatgttgaaccagccttgcatcccagggatgaagcccacttgatcatggtggataagctttttgatgtgctgctggatttggtttgccagtattttattgaaaatttttgcatcgatgttcatcagggatattggtctaaaattctctttttttgttgtgtctctgccaggctttggtatcaggatgatgctggcctcataaaatgatttagggaggattccctctgtttctattgattggaatagtttcagaaggaatggtaccagctcctctttgtacctctgggagaatttggctgtgaatccatctggtcctggacattttttggttggtaggctattaattgttgtctcaatttcggagcctgttattggtctattcagggattcaacttcttcctggtttagtcttgggagggtatgtgtgtccaggaatttatccatttcttctagattttctagtttatttgcatagaagtgtttatagtattctctgatagtagtttgtgtttttgtgggattggtggtgatattccctttatcattttttattgcatctatttgattcttctctcttttcttctttattagtcttgctagttgtctatcagttttgttgatcttttaaaaaaaaccagctcctggattcattgattttttgaagggttttttgtgtctctatctccttcagttctgctgtgatcttagttatttcttgccttctgctagcttttgaatgtggttgctcttgcttctctagttcttttaattgtgatgctagggtgtcaattttagatctttcctgctttctcttgtgggcatttagtgctataaatttccctttacacagtgttttaaatgtgtcccagagattctggtgtgttgtgtctttgttctcattggtttcaaagaacatctttatttctgccttcattttgttatgtacccagtagtcattcaggagcaggttgttcagtttccatgtagttgagtggttttgagtgagtttcttaatcctgagttctaatttgattgcactgtggtctgagagacagtttgttgtaatttctgttcttttacatttgctgaggagtgctttactatgttgtcaattttggaataagtgcaatgtggtactgagaagaatgtatattctgttgatttggggtggagagttctgtagatgtctattaggtccgcttggtgcagagctgagttcaagtcctggatatccttgttaactttcagtcttgttgatctgtctaatgttgacagtggggtgttaaagcctcccatgattattgtgtgggagtctaaatctctttataggtctctaagaacttgctttatgaatctgggtgctcctgtattgggtgcatatatatttaggatagttagctcttcttgttgaattgatccctttaccattatataatggccttctttgtctcttttgatctttgttggtttaaagtctgttttatcagagactaggattgcaacccctgcctttttttgttttccatttgcttggcagatcttcctccatccctttattttgagcctatgtgtgtctctgcacatgagatgggtttcctgaatacagcacactgatgggtcttgactgtatccaatttgccagtctgtgtcttttaattggagcatttagcccatttacatttaaggttaatattgttatgtgtgaatttgatcctgtcattatgatgttagctggttattttgctctttagttgatgcagtttcttcttagcatcgatggtctttacaatttggcatgcttttgtagtggctagtaccagttgttcctttccatgtttactgcttccttcaggaactcttgtcaggcaggcctggtgctaacaaaatctctcagcatttgcttgtctgtaaaggattttatttctccttcacttatgaagcttagtttggctggatatgaagttctggtttgacaattcttttctttaagaatgttgaatatcggcccccactctcttctggcttgtagagtttctgccaagagatctgctgttagtctgatgggcttccctttgtgggtaacccgacctatctctctggctgcccttaacattttttccttcatttcaactttggtgaatctgacaattatgtgtcttggagttgctcttctcgaggagtatctttgtggcattctctgtatttcctgaatttgaatgttggcctgcctttctaggttggggaagttctcctggataatatcctgaacagtgttttccaacttggttccattcttcccgtcactttcaggtacaccaatcagatgtagatttggtcttttcacatagacccatatttcttggaggctttgttcatttctttttactcttttttctctaaacttctcacttcatttccttcatttgatcttcaatcactgataccctttcttccacttgatcgaattggctactgaagcttgtgcatgcctcatgtagttcttgtgccatggttttcagctccatcaggtcatttaaggtcgtttctatgctttttattctagttagccattcgtctaatctttttccaaagtttttatcttctttgcaatgggttcgaacatgctcctttagctcggagaagtttgtaattaccgatcgtctgaagcctacttctgtcgactcgtcaaagtcattctccatccagctttgttgtgttgctagcgaggagctgtgttcctttgaaggagaagaggcactctgatttttagaattttcagcttttctactctggtttctccccatctttgtggttttatggtctttggtctttggtctttgatgatggtgatgtacagatgggattttggtgtggatgtcctttctgtttgttagttttccttctaacagtcaggacccttagctgcaggtctgttggagtttgctggagatccactccagaccatgtttgcctgggtatcaccagcggaggctgcagaacagcaaatattgcagaacggcaaatgttgccgcctgatccttcctctggaagcttcgtctcagaggggcaactggctgtatgaggtgtcagtcggcccctactgggagatgtctccccgttaggctattgggggtcagggacccacttgaggaggtagtctgtccattctcagatctcaaactccatgctgggagaaccactactctcttcaaagctgtcagacagggtcgtttaagtctgcagaagtttctgctgccttttgttcagctatgtcctgcccccagaggtggagtctacaaaggcaggtaggcctccttgagctgcggtgggctccacccagttcgagcttcctggccggccgctttgtttacctactcaagcctcagcaatggcggacgcccctcccccagcctcgctgctgccttgcagttcgatctcagactgctgtgctagcagtgagtgagtctccgtgggcgtgggaccctctgagccaggtgtgggatataatctcctggtgtgccgtctgctaaaaccattggaaaaagcgcagtattagggtgggagtgtcccgattttccaggtaccatctgtcacggctttccttggctagaaaaagggaattccccgaccccttgcactttctgggtgaggtgatgccccacccttctttggctcacactccatgggccacacccactgtccagcaagccccagtgagatgaacccggtacctcagttggaaatgcagaaatcacccgtcttcttcatcactcatgctgagagctgtagactggagctgttcctgtttggccatcttggaactggggcctttttttttttttttttcctcccaggctggagcgcagtggtgcaatcttggctcactgcaacctccacctcccgggttcaagcgattctcttgcctcagcctcctgagtagctgagagggtacttggcctctcaggcatccaccaccatgcctggctaatttttgtatttttagtagagacggggtttcgtcacattggccaggctggtctcgaactcctgatctcaggtgatccgcccgcctcggcctccctaagtgctgggattacaggcatgagccaccacacctgaccctattacatgattttcttttcttttctttttttgtttgttgagatggagtctcgcttcgtcacccaggctggagtgcagtggcaccatctctgcccattgcaacttctgcctcctgggttcaagtgattcttctgcctcagcctcctgagtagctgggattacaggcgcacaccaccatgcccagctaattgttgtatttttagtagagatggggtttcaccatgttggccaggctggtctcaaattcctgaccttgtgatctgcctacctcagcctcccaaagtgctaggattacagatgtgagccaccatgtccgacctattacattttcttttcttttttttttttttttttttgagacaagagtctcattctttcacccaggctggagtgcagtggcacaacctcggcttactgcaacctccacctcccaggttcaagcgattcttctgcctcagcctcccgagtagctgggattacaggcatgcaccaccacatctggctaatttttataatgtttttagtagacacaggatttcaccatgttggtcagtccggtctcgaactcctgacctcgtgatccacccaccttggcctcccaaagtgctgggattacaggtgtgagccaccgtgcctgcctattacatgattttcaaaccacattttgtttacttaaaattgtcaccgttttctcatgtgatatataatctttttaattatcatgaatgcttaaaattccaaggttccaagaactttatgtttaatagcttattcaatccttacaataatcttataaagtagttactattattattctcattttacagatgaggaaattgaagctcatgtagtttaagtagttagcctaagataacaacagtgggggaagcttggggggagatttaatatccaaactatgctcttaacccaaatataggttaaataagtaacttcctattgctggtcactttttcactattataggtaatgtttcagtaattatctttgtgcatttaacttttttcctttgggattatcgcattagaataattccccctaagtgagattatcaaatcaaagcaaccaatcgtttattaatatgattaggctctcatatatactgccaaactgatttctaaaagattcaggttaatctttactttccccagttgcgtagtattaatttatctcagtttagccagtattaacttttttgctaattaaattattttaactctttaaaaatatttgcatgttaattatgttttccaagtcagaaaattagctgtccctattaactcaagtccctatgaactcattgaacaagtatttatcaagattgttactgtatgtaaaagtaacaaagaaaagtatgtaaaatatggtccatgtctttatgatactaggaatgcatcttttttttttttttttttgagacagagtctcgctctgtcacccaagctggagtgcactggcccagtctcagctcactgcaagctccacctcccgggttcgcgccattcttcttgcttagccttccaagtagctgggactacaggtacctgccaccatgcctagctaatttttttttgtatttttagtagagacggggttcaacatgttagccaggatggtctcgatctcctgatcttgtgatccgcctgccttagcctcccaaagtgctgggattacaggcatgagccaccgcacctgggaggaatgcatcttttataatttgtagtacttttaatgttttaccaagttgccagttttttacataagtagaatattaagcatctttccagttctattagctgctatgtgtattgctttggattgtctacataagcaatcatgcatgctatctgtgaataataacatttttatttcttcatttccaatctttatacttttcatttctttgctgtgccatattgaattggaaccttcaatacaatcttgaatagaattggtgataattggcatccttaattaattctggtttctcagatggcaagctttcaacattttaccattgagtaagatgttgctatagatttccttatattcccacttgccaagagtttttttaaatcatagttgggtttttgtcaaatactatttatgcatttatcaacaagatttttttttcctcttttctgttaatatggcaaattacattgactgattttttttttagatgttaaacaacccttgcatttctggagtaagccccatatatattatgtacttttatatactgatgtattttacctgctaatattttaagatttttgcgtctatgtttatgagagagattggcctataattttcctttcttgtattatagttgcaaggttttggtagcaaggtaaggctaaccttgtcaaaaaaaaaaagttagaaaatagtcccttgtttttattctcttggagaataaaattggtattacttcttccttaaatgtttggaagaatttcctcttgaagttatctggtgttggggttttctttgtgtaaaagttttaaataaccaattcaattccattaattattcagattttctaattatttttctttcagcttggtaagttgtactttttaaggaatttattcattttattcaaaatgtcaaatgtatttgcataaattttgtcacacacatattcccttatcttttttatgcctgtaggacctgtagtgagttcctcttgtttatttcatatattggtaatgtgtgttttctctttcttttttaaaaattttctttattccttacctggagcactaaaaaaaaaaaaaaaaaaaaaaacttgatattcatctcctcaaaggacttatttctgtctttgtggattttctatattttgagattttgggtttttttgtttgcttgtttgtttgtttgtttcttaagacagtatctcactctgccacccaggctggagtgcagtggcatgatcatggctcattgtaacctcaaccttcccaggctcgggtgatcatcccacctcagcctcttgagtaactgggactacaggtgcacaccaccacacctggctaaattttttgtatttttagtagagaaggggtttcaccatgttgcccacggctgttcttgaactcctgagctcaagcaatctacctgcctcagcctacgaaagtgctaggattacaggcatgagccactgcaactggcctgtattttgagtttgtttactatttcattggtcttgctcctgtcttttttattttctaacttctaatttctatttcctaatttctattttggtttattctctgacacatagattatttagaagtgtactgtttaattttcagtcagttgagtgttttctcattttttaaattgattatattagttatgtattgctgctgtaacaaattaccacaggtttagtggcttagaacaacacagatttattatcttaccattctagatgtcagaaattcaaactgggccttactgggttaaaaatcaaggtgtcaccaggactgcttttcttttggtggatctaggagaggatccatttttttaattttttagtttctcaaggctgcccacattccttggctgatgaccccattcctccatcttcaaagccacattggctggttgagcctttctctgtatcacttatctgtataattcttacactcaccctcctgactccctgtttcccttataaggacccttgtgattagatcaggcctacccagataatccaggataatcttcccatctcaagttcagctgattagcaatcttaattccatctacaaccttaattcttccttctcatgtaacataacatattcacaggtaccaggcactaggatatggacatctttgtgagggagtgcattattttttttggaactttatggcccagcatatgattgattttgggaaatgttctatgtacatgtgaaaagagcactaactctgtccttgttggatgcagtgttttttatttatatatatatcacttagggcccatttttcaaagtctgttgtttaggtcttatatatctttactgctcttttgtctgctctatcagttgtttttaaaagataagttaaaatcccactatgactatggacttgactatcttcctttttaattttgtcgatttttcccttgtatatttggaagctttgttattagatgcacacaagtttagcattgtgatatcttcctttttgactcctttaacactatgaagtgtccctctttatgtctagcaatgcttcatctcttctttatctttcatgacattgaactttttaaagaatacaagccatttattttatagaatttgactcaatttgtgttagtcttatgttccctcataattagattcaggtttcacatttttggttggaatattacataagtaatatgaatccttctaagggtattacctctggagatatatgatgccccttatcacagccttaattggccaggcatgttggctcacgcctgtaatcccagcactttgggaggctgaggcgggtggatcacctgaggtcaggagtttgagaccagcctggttaacatgacaaaaccctgtctctactaaaaatacaaaaattagctgggcatggcggcgggcacctgtaatcccagctacttgggaggctgaggcaggagaattgcttgcacctgggaggtggaggttgcagtgagctgagatctcaccattgcactccagcctgagcgacgagagcgaaactccgtctcaaaaaaaaaaaaaaaatagtgttaattatgagctcttggatcaaatatcatttgctttctccactgtatatttaatattttccctttttgtaaataagcaatttggaaaaatgattgcttatattaattttgaattagcataaataaccacatatccaaaaatacttactccagatgtacttgatttttgtttatgcttatagggaagaacagctttgcattggtcctgcaacaatggataccttgatgccattaaattactgctagactttgctgctttccctaatcagatggaaaacaatgaagagaggtaagttgttgttgacttttttttttttttttgagatggcttctcgccctgtcactcaggttgggttgcagtggcacgatcttggctcactgcaaccttcgcctcctgggttcaagcaattcttctccttcagcctcctgagtacctgggattacaggcatgcacgatcacacctggccaatttttttgtatttttagtagagatggggtttcaccatgttagctagggaggtctcgaactcctcaccttgtgatccacccacctcggcctcccaaagtgctgggattataggcgtgagctaccatgcccagccaagttgttgacttttttttaaaaaaagtgctctttatcatacatcctttctaccagattttttaaatctcaaggttagatattgttcagaaataataactatactcataataaaacattacactaagaaatactgagccagaatagaagagcaaaactttcatgcaatgttgatttagaatcatgggatcttatagctcttcagaatttcatctattgcctagggcaagcatgtattttgcagatgagaaaattttagtcctgcttctgacttctggctaacataacgtcagtgaaatcctgattgactgggcccaggagtacatttaggccagcggaatgtgttatatattccagagatttctcttgatgaagaggatattatcagtcagtagacaaagagatgccaccatgtagcatgaaaacataaggagaagctaagatgaaagttcagggtttaatctaaatgcagattgcatgaataatgtaaggtctggagaattatattagggttattgaccaagaatccaggcccaataaaaaggaccaaacaggccaggtgcggtggctcacgcctgtaatcccaacactttgggaggccaaggcgagcagatcaactgaggtcaggagttcgaaaccagcctggccaacatggtgaaaccccatctctactaaaaatataaaaaagttagctgggcatggtggtacatgcctgtaatcccaactactcaggaggctgaagcaggagaattgcttgaacccaggaggcggaggttgcagtgagcccgagatcatgccactgcactccagcctctgcaacagagtaagactctgcctaaaaaaaaaggaacaaacagaatgtgaagtctaaggaatagcgattcttggtggtgttagatctaggaagattcttataatttgtaggtaacaactgagtttgtgatcacacttccatacctgaggtcctgttacaggaaaggggtcccgatccagaccccgtcagagggttcttggatcttgcacaagaaagaattcagggcgacttttgcagtgcaaagtgaaagcaagtttattaagaaaggaaaggaataaaagaatggctactccagagacaaagcagccttgagggctgctggttacccgttttcttatggttattttttgatgatatgctaaccaaggggtggattatccatgcctccccttttcagaccttatagggtaacttcccaactttgctatggcatttgtaaaatgtcacagcgctggtgggagtgtagcagtgaggacaaccagaggtcactctcgtctccatcttggttttggtgggttttggccagcttctttactgcaacctgttttatcagcaaggtctttatgacctgtattttgtgctgacctcctatttcatcctatgccttagaatgccttaaccttctgggaatgcagcccaacagctttcagcctcattttacgagatcctctttaagatggagttcacatgcctctgacaatccctctgacctaggtctttgtgttagttttcatgtttcatggatgctctaactaaaatggctcctgctataataccattcccatcctcttagccaccacccattctttctattagttggtggaaaactttattgagaagggacttctctacgtccatctcagaggaaacatgttcctgttttctagaaccaacccctttaccacttctttcagaaacttccctcattagagggagagctgaagatgtctccctttgaaactctaaaaaaaaaaaaaaaaaaaaaaaagaaagtttaagaatccttagacttagtgatgacttgttttgtttctataaaaatttattctgtgtaacagcatttaccgcctgactgctatatttttaaggaaacaatgaaattttttaactcaatttccatttatatgctaaaccttgaatatgagacctaagtaactgcatgaattaaggtgtttactgcctcccggaataaacatatgttaattacagaccaaaagaccaaaggaaaaatcctcctaactttacttgccaaactatagataaaaagagacagtggcaataactcagtctttgttaatgtttcatcagcaatgtaccttgatgtacaaatgtcagaacttggcactgccttttacgtttattgacattccagtttaggcattctactcatcccatcagaccattcccacatggcaggtccaattgtatcttgtctgttgtctatatccacattgtttcttggttggttaccatcagtgtagtgctaatttttacttctcatacattgacactagtcagttgatgaacaacgtatagacataatttttgccaacttctgctgactttcagtcaataactatctgacacactcaccccaaccctgatgggaatattcacagcatttgaatttttctaaattgaatttgggatgaaaaaagattcagtagtaataatcacaatgtgttttatgatcacacttgttttaaatactgggtatagacttcaatcttaaaatgatgctagatatttggattgtgtctctgaataaaaaattgagaatcctaatttgaataaaccaattacaaaaatatattttttgagaaaattgggtaaatttgattatgaagtggtccttagattttactaaggaattcctgttaattttgttagtataatgacattgtgggtatgcccatattatttactgatgaatacttaaacacatagagatgaagatgttacaggaaagtggtcccgatcccgaccccaagagagggttcttggctctctcgcaagaaacaattcagggtgagtctgcagtgcaaagcaaaagcaagtttattaagaaagtaaagtggtgaaagtacagctactccatagacagagtagggcgttcccgaaagtaagagaggaacgtatccaccctaagtacaatacttgtttatatacaggattaaaaaaaagattatggggagatgtgctgtgctacaagggtttgtgataaaggattcattttcttaattactacatttttcaagaatcaatattattatcttcaaagcaaaattaggaatgcctttgttctccagatatcgggatattaggactctctcaagtctgggtctgtttagtaaacatcagtatgttcccttaacggtaaacatctagaggctaggaatacctttctgggaatgcagcccagcaagccccagcctcattttcgtagccctcactcaagatggagtcctctggttccaatacctctgacaaaatgataggagttccgagattagctataaaatactctagcaaaaataaaaaggaagggtctagatgaagcaaatgtagcaaaaaattgttaaatttaggtattgagtgtataagtgtttattatgttattctctctaccttttttatgcttaaaatttttcataataaaaatatatttttttacataaaaatatttaagatataattttcaatccaaaagcagcctaagaagtctagttcttctctttacaaatgaggaaacaaaagcccagagaagttaagagaatgcccagggtcacacaggtcccctgactcccagatcagcattctttagggtatattaagctacatgttatttccttttgtaatatttgtaggtaaaggaataatttgggccctatattttataaactaaattttgttaatcctgcttatatattatgtgaaggatactacctattaataattatagaaaaaatgatcaaacttaccaaatacgtatgttgtttgcacattgatttaagaaacagttttattctataggaaacatactaagtaattgatatatgtgttgtggaaggttactgaactgggagacatgttatcttagttctagtctgcattctatagaaacaatttacataacctttggtaagttgcttaacctctctggagctgttcatccatttataaaatgaaggtattgaactaaatgacctctaaaattcaatttagctctactattgcatggtttaatgactctatgataattttttccattagagaaagtacagtcaagaaaggcattttagaacttgtagcaaaattttttttaattctcctgaatttaaaaaatgttatccacttataaataatgttttaaagtttatgtagatgcctctcagatggtccctgaacagtaagtggcaaatgaagctgtcctaaaatagaggttccttaatttcagtgtttggggtttcttcccaaactcagtttccttactaaagtgatcaaaatactcctatagtgaaaaacctcttccttttatgtcttaactgtgactgttaggtaagttttgaagataaataattttttttctataatcagatgattttctatgtctagtcatgcatccatataatcatccttttttctgcctcataaatcatctgatgttttttcctaagaccttttatgggtttggctggtcagagtcatcctgagaggaatcagcatcagtggtggtcatgggatggtcatagatactagtttgggtcctatggagataatatttttgataagcagctgtggtattgcaagccatacagcagtgaatgtcctgtaataataacaatcagagctgacatttattaactgtttcctttggaccaggaacattgctatcctctttacacttatttttccattttctcctcatgccaagtctgcaacgtattacattgtttaacagatgaggaaaactgaggcttagagatataaagtaagttgtttaaaaagtgatagtcatcgttaccattgttggatggtagaatttgggggattttttttacttcaattttttttttgcagtgttttgagttcataaaatctatatcattttgacaaagtagtaatttttgtttaaaaaaggaaattgtatctcccagatatgaacagtggttaattctcagggtgggaatatggatgatagctattttcctctgtatatttacccaattttttatgtttccaaaatttatgaagaaatttttttaaaagaataggctgggtgcagtggctcacacctataattccaacactttggtaggccaaggcagaaggattgcttgagctcaggagttcgagaccagcctggagaacatggcgaaatcccatctctacaaaaatacaaaaactggccgggtgcagtggctcatgcctgtaatcccagcactttgggaggccgaggtggtcggatcacctgaggtcaggagttcgagaccagcctgaccaatatgatgaaaccccgtctctactaaaaatacaaaaaaaattagccgggtgtgatggcatgtgcctgtaatcccagctactcgggaggctgagatgggagaattgcttgaacctgggaggcggagattgcagtgagctgagatcgcgtcattgcactccagcctgggcaacaagagcaaaactccatctcaaaaaaaaaaaaaaaaaaaaaaaattagccagccttggtggtacatgcccgtggtcccagctatttggggggctgaggcaggaggactacttgagcccaggaggagtcgaggctgcagtaagctgtgtttgcaccactacactccagcctgggcaacagagtgagaccctatctcaaaaaaaaagaaaaaaaaaaaagaatgtgccgaaaacagcacacctagaaagttgccatttgagattcaaatatacaacaatatgacaataatattcatcgtttctaaataatgtatttatcaaaacagtgatgtatatacactgtacaaaatttaaaaggatgttcactgaagactcaatgttcctcctacccctgcctctgagacagctagttttcctcccccagaggcatcactgttagcagtttcttggaaaacttctgaaaatacatttttcatagataaacatacagggatatattttttatacaaatggaacatgccataataactcctgtttcttgcttttttctttgtcttcatttgacatcctggagattgtttcttatttattcatatatagcagtaatgactgcatatacagatatcttcattatatggatggcctgtgcattgtttaagcagtcctctgttgatagacattgaggttgtttctattcttttgctatgactagctgtacttctatgagtagccttgtacataaagcatttcacatgagagcagatctataagataaattcctaagagtgaaacggctatgtcaaatggcatatatacatgaataattttgataaatattgccaaatcatcctccctagaagttaaagtagtatatgaaagagcctgactctctctgtccttgctagtgcagtgtgttactaacttttctgatttttgcaaatctgatcatcattgaaaggtactctctcatgttagtctaattcatatttctcttaaatgagtgaggttcaacatttttatgtgttaagagctattagtactcttctgggaactgttatctttgtctttgatgtcttttttactctgtaaaattttgttatttttatgtagtcagatttgtcaatcttcttttatggtttccgaaattttttttttttttggagacggtgtctcactctgtcacccagtctggagtgcagtggcatgatctcagctcactgctgcctccacctcctgggttcaagcaattctcctgccttagccttctgagtagctgggactacaggtatgtgccaccatgcctggctaatttttgtatttttagtagaaacagggtttcaccttgttggctaggctgtctcgaactcctaacctcaagtgatctgcccacctcggcctcccaaagtgctgcgattacaggcgtgagcctctgcgcccagcccttttatggtttctgaattttgtatcctttttttagaaaagacttccaacatcattttttaatcttcctggtttcttctggtactttcatggttcctttttaaaatatttagatctttgctctatccagaatttattttggtataaaatgtggttataagaatctcttttttttccccagatggctacctggttgtcccatcactatttatttagtaatccatcttttctgcagaaatttaaagggccattcttatcatatactgaatttctccttttggagttctgttttttacttcataagcattaactgtcagtaatcatgggctcaaatttacaaatctcacaatattttcactacctttttagatggggcagggaattatttggcacatgggaaagaagagaagtgatcatgtctttccaataggcccctatttgtttgccagggagtaaaactcaggaactgacatggttagcagcacaaagcacctgacccacagtcatagtcaaccttgttttgtgcccctcggagaaaaaaagaatagccctgttatagagaaggtggctttgcctggggaatattccacatcttagaatgaagtttccttctgctgcataataatattttcagtttaactgtgccttaaattacattctaaaattaaaaaaaaaagaaatcttcctcccacttcagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaagtaagtatgagctacgcagattgcgttttcgccacccagaatcagggtggaagtgggggtgtggggggtgctggggtggccaggagagggaaacagatgagaatctgaattactgttggtccctgcaaccggtcatcttccctcttctcagcactccgtcttctggaaccgaggctgcagtgaaggacagaggcctaacctctgctgggtagtgattcctctagactagtcccaatgtttcagcccagggacaaaccactcccacccatgggagggagttggggatgggattgcttcctagaataagctgtaaagaaataactgctcctcttacccttcctctctttccaaaagaaacatgccaatatctagcctactttcactagaccagtctaagtctggttttaatttgattaaagcaaacaacttggtttttttttccactcagttctttttttttttttttttttttttttttctgagatggagtctcacttgccgcccaggctggaatgcagtggcacaacctcggctcactgcaacctccacctcccaggttcaagcaattctcctgccttggcctcccgagtagctgggactacaggcgcgcgccaccacacccgggtaatttttgtatttttagtagagatggggtttcaccatgttggctaggctggtcttgaactcctgacctcaaatgatccacccacctcatcctcccaaagtgctgggattacaggcataagccaccgcacccagctttccttcacccatttcttaacacatctgtactaaataaagtaatttactcaagaaatattgattgaattcttactatacagacaaaatgcttggctagagcccagagagaaaatggcaactaaaaaagcaaaatcccccctgcctcaaggacttcgcattttttttggacgatgatacaaaatagctgtctgtgcctcttgcacattctgattatttcacataaatgattgattttaaagctgggtgcggtggctcacacctgtaatcccagcactttgggaggccaaggcaggcggatcacttgaggtcaggagttcaagaccagactggccaaaatggtgaaacaccatctctactaaaaatacaaaaattagctgggcgtggtggttagcacctgttatgccagctactcgggaggctgaggcaggagaattgtctgaacctgggaagcagaggttgcagtgagcccagatggcaccactgcactccagcctgggcaatagagtcagactctgtctaaaaaaagaaaaaaaaaagattgattttagattatacttaggtttgccttttctttgatagatatgttgggtagaagtatttcaaatagcagcagtgcatcacattagcaaatacagataccaaaaactctgatgataaagatgtggacaggcagattctttttttttgagacagtctctcgctgtcactcaggctggagtacagtggcatgatcgccactcactgcagcctccacctcccgggttcaagcgattcttatgactcagcctcccaagtagctgagattacaggcttgtgccaccacacccagctaatttttgtacttttagtagagatgaggttttgccatgttggccaggctggtctcgaactcctgacctcaagtgatctgcccaccttggcgtcccaaaatgctgggactacaggcatgagccactgtgcccagcctgggcagattcttgaaagataacttcctggctgtatctcgaatgtttctaaatcttgagtccttctaactcttaaatcctacatcttacccacaagggggaagcataagtgtactaaataatcattaaaagtaataataagaggcaagataagtcattttaatgagaagttaaataccactatgtactggaatgctaatcatcatgtcagccttcagtaaatagagaaacataccattttctgtgactctaaagctactgaagtagatggcatccgaggaaatactatgttgtactcttctcttaatgatgccctcttcctttcacttttgccaaagaatccagtatcaacataaagcctctacacccctctttttccagccttcttataaaagttctctgcatgtgagtggcaagcataagtagataatacacatgacaaattatcctgagttgcaagtaaatgatctctgtaaagggatggaatgttgtatttccttctactgatgtttccataaactccagtttattgtgtgacaatctattttcaaaatttgtagtcatacctacttgaatataaggtgggactcaacaaaggcaacacaactgactttgtatgtcccctaaagggaggctgtagatctctaagagatatacttaagtggtggagaaactgatttcatttgttctatttctcaaaagttatttcttaaaatctgagtcagtgtttaattttgcgtttaattcttgcttgaagaaacaaacatcaggatgctaaactcagtccttgctgctgctgcctcattgactaagctggcccaggcacagcatgtcacctcggtgtacctttcccagtttattatgttaggatggcagaaatcattttcctcaaaatgaggatgtgaaaggcacttattaaacttaagtaaagtgatttctaatttactgaaagagaaaccgggagagaaaaagttatagcgatatttactaagacaggtaatgttagaaaatgctatttaaggaatatctataatcaatttgaaagcactttataattcacactgcactgcctatgttgttgccaaaatgaacattactataatttacctgccaaagcacacggttgagtgtacactaaaataaaaccatatttatgttgatcacccttcttccctgaagctccctttttgccaggttcttatttcactcaaatctcagatctcctgtaactctctgattctcccttctcacatcttttaaattattccatctccacactgcagtcagccttgaaggcaaactttttagacttctgctcatgctatacttttttccattgaaaatgtatctactcttaaattttaaattaattcatctctgtagatagccccctaatctgtctcacatcctgacctcctggaactctaatctcatatcttcagttgcctactgggcatttctgctatgcttttgtcacttgccaacactttagatcattggacgtttccatttgcatgtcctgttttcactataacttcagactctgcaacacaccgacatgcaaatgcaagcagcccatcaccacagtctgtctctcttctggcctttttatgtgcttgctagtgctgctaccattgattgtatgcattccccctttgatagccttttgctttcattcttctgtgccaccaccactctatacaaaccctcgttcttcttttttttgagacagagtctttctgtcatccaggctggagtgcagtggctcgatctcagctcactgcaacctccacctcctgggttcaagccattctcctgccttagcctcccaagtagctgagattacaggtgtgtgccaccacgaccagctaatttttgtatttttagtagagatggggtttcaccatgttggctaggctggtgtcaaactcctgacctcaacccacccacctcagcctcgcaaagagctgggattacaagcatgagccaccacgcccagccccctcattcttaaataccagccatggtgctctgtaagatccttcaacatttctttcacttccacttacatttctaagtctcatttctctccactaccaccaccctctcacttgatgtctcagccatcctgaactttcttcacttcacttactgggagacctgagctccttcctggctagtatatgtgattatgtttctaagagtttcatcgtcacgtccagttttggtaacccagttcaaactcttgtgatgcttaagtcccttctacgagagattgttctgtgtccccaaaaagtcaagtgcaagaagtcctgtacctctcaagatagcatattccattagtggagggctctgtctagcaaaagttcttttctaccctttggtcttgaagctacccctggaagccaaagagaaaaatctaaatcctttttcataaaccaactttcagatttttaaaaaactgctcataacacttccattgctactgctcatctccttttcacttggtaattagtcaatgctcccgtgaacatcaccagattgttaatggttggcccatgtgtctgactcatctgctcacaaagtcatctggcccatggggaattacttccatagttctatttcatgccattccacttctctgagcctcagattttcatcagtaaaatggaaagaggttttcttaattcaagatgggcttcagggatccatgggtacctgaaattgtacacagcattttgtgtgtcaggagcacatatgcatttcgtgggagaggatctatagatttttttttatcacattctccaaagggggtccatgagtcacacacaaaaagacaaaaaccactggactaaatgatctctaacgtccctcccagctctaacattctgtaagtcaaaggtcctaagacacacgacattttcttattcccttgagagggagttaaagatcaactatttctatgcctgttattcagtgacaatgaagagataaaaatctgacaaacccctagacaccatgcaacaccaactgaaaaggttagagctaaatcttttttgtctcatgaggtaatattttcctctcactggaaatgatccaacagaagtggaattatcatctctccacaatcgtatataaggaattttttaaattatgtgaagatgcctataatcacagcactttaggaggccaaggcaagaggatcgcttgagcccaggagtttgagaccagcccagcagttcaagacatagtgagaccacgtctctacaaaaaaattttaaaactagccagtgtgtagtggcttatacctgtagtcccagctactagggaggtgggaagatcacttgagccagggaggttaaggctgcagtgagctacatcacactattgcactccagcctggaagacagagagagagaccctgtctcaaaaaaaaaaaaaaaaaaaaaaaatttatgtgaggagctggtctctgagatctcttctgagtctctgctcatgcatacttctccctctgcctgaaataacctctcagtttattcctctctcattcttcatatgcagcctttttctccccgtttaattagtgagtgtctcccacatcctcccatagccctatatagttacttctcctttagcactcatcacatctagaactcactgttggcaggagtgtatgggtctgattccctgactcgattgtcagtttcttgagaacagggactgtgtgttatgtacctccacatctctagtaccttagaatgtttggtatatagtaagcattcaataaataaatgttcagtaaattcccctacaaagggtctaaaaccttacataagccattgatcactgtaggccttagtttccccatctgtcaaacggaagggttagaccaaatactctcttaggtttctttcagttcttatacgtgactctccgtaagtgtagaactttaacttgtttgccttgctcaaggcagcaaacacattatataccactcatcctcacaatgctctttgacacttacatattcattttgttttccaactccctgaatattggtcatgagaaaattatcatttgacagattataacagtctgtgttctgattttaaaaagaaagagcaaaggggctcaccgctgtccatacttgaacatgaaaccatgattctgtaaacttcttagactcaaactgtttacaagtcttatccctgccagatttagagaatattgggaagaacaaatgcaggtaaataccgtttcttgcttagaagatataaggaagtttagccaaatagttgacgttaatttgtctctaggaaccaaaaacatacccgtaagaaatggaagccggattgaataatgtggattttagatattacaaatatagataaatattaaaaagtagacatgacagctgtccttaatctcatttcataaatgtggagatgggcacacaaaggttagcctgcctgaagtcacacagctagtaaggaagagagatggcacatgaatctaagtctcaaggccaagctacctaccattacttggttcaagggaatccttctaccagccaagcccatactagaggctgtccccagatgctagcaaccatctgattgaataaccatctgtatcattcaattatgccactgttgatcccattcgttgttaagagagtggtgccaagccaccattatcaattctataatataattcaataacgctcttcctattaccctcaaaactaacagaacagagcacaccaatattctcctaaatccttgagaaagttacaaatattgattggtccctagcctacaccaggacaattaactagaatggcagcatttaggcaaagctgggttaaatcagtatgacaggacacactaactagacttctcttttctgtggaagcattttaatcacatctctcagacctcactaggtgttgtattcatggcaatggaaacctgaatattcatgggatgggaaagagcctgcctggttctgcagtgtctgatagaattaatttcttcgtgtcaaaagtgggcaaatagaactctcttgtgggtcgcagtatttagaaggcacatagtggggtagaaaaaatatcaacttccataactccaactgtgcagggccagagtcgagagtttgccatattgtgcaaacaaatacatccactcctgagatgctgaaaccatcgtacgttcaagtcatttaagttactgcccttgatcagcttttgttaaaatttgttaaaatttctgatcactcaccttctttttagcccttttcttgctaaattttcatccaggctagtgatttgtaaaaatttctatctgtgggtcttagatttggttttagggggctttgggggaatatctctgccccacaatagccctccagcaatgtgaagcagcgttgtgtcttgtaaatcttttcttccctgggtagacagccccagtcccatcagctgatagtctggaaactcctcttcaccctgtggagcacaggacctgaaatagatgttgtcaaagatttgatccccagttgactttctcactttcttatcctgtaagcctctgaagagctgcaaaattgctctaaaagagacagtacaaaccagactaaattggaagcccattagaagctgtcatctagccaatttctcttcacatagtaggtaggaaaaaaaaaagagagtgaaaggtgggactagtttatccactaatattctgccatgttaataattttcctgcagaaatgttgcttgctgtgtcatagaactttttttaatttttcatatcaactagaataatctttttctgattttttttctaaactttacaagtaaaatagatctttataacatagcacaccttaatgattaaagatctttgacatttcatcataacttaagaaaaaaacatttaaatttcaggacaattattgaatctaagagctaaggactaaacactacgtcgaaagctagttatggctgagtgtggtggctcacacctgtaatcccagccctttgagaggctgaggtgggaggatcacttgaggccaggagttgaagacaagcctgggcaacatagggagaccttgtctctacaaaaattttttttaaaaattagcctaaaagttcaaggttacaatgagctatgattgcaccactgcattccagcctaggtgacagagtgagaccctgtttctaaaaataaaaataaaaaagaaagctcatttttaaatgctgctaatggttagtttgaagtggcatccccagcttctttgtatgacccaattaattttttaaataatggaagaagattaggtgaaatttttaaaaacaattctgtcatggggatgaattttaccaggagataaagcagctgcgttctatcttggctctgtctgtagtttaccatgcagccttgggtaagtcacttacctctctgcctgttttcttatctaccaaatgagggtgtcaccctcaataaactggtttcttcaaactcttacactatgagcaatggttctggaccttttccccagggagagacatatatgtggggtcacgttcaactctcagaagctgaattgtgtgtgttgttgttattgctgctgctgctttagttttaaggcagcaatatagataaaataggatacaagttatgcataatttccagttttaatcccactccgttttttctcagtgatcactgctattacatcaaagaaccactggtctgaagaacttcacaattgtgggccatgtgccacctagaagatttttttaatgcaaaatgcatcaatttaaaaaacattaattatatttgtaagaccaggggctaattattcattcagatgattgcattctgtctcctaattctgcttacgtagttctaccaaaatgaaaaatcacccccctggtatcccccctccaaagcaatctccagaagccaaagccctcttgctttctggatgtcttgatcactttaaaaggctggatcccctgttcctcatgtggctgcctttgttgaaggcccagaaaggtttgcagtgataaggtttgccccggggctggctacagagaggcttcttggaattgaacaagagagctgttgggtttcctaaaaagaaagaggagactgctcaaataacaaagtctaatttatcacctcagagtcccccttaatggcagtgagatccatataggtgccaacccagacagccacccacatgtgtctgtctaaagagccaatatcattctcttaaaacagccctgctcatcggtgctgataaaaagctcagcacttcctctgccttcctggagcaaggctattaaatctattagcagcacttcagccacccagatgcttccaccttcttctgaaaagcagccttgtcccagagagatcacactgaaatggcacctgcttgcatccgtatgaatctcaggctccgagatgacaggctgtccggctggcctgtagaccacagtcattagcaggtggcaaagatgtcacaaaaccagagtcaaataaaaacactagagctgtacaggagttagcacgacccatctggccatgttctcggtaatgggactcagtagaaaactattatataagcaagcttggaccccagatcaggggctactccatacaggaagaaagagtttcagaaggggaatttaacaagttgacaaggttgtaaatcaaaatgtaacccagatgtatgtcagctggggctttcctgtcgcttgagatctaaataagctttgcttcaaatgccgtagtccatagcagtctggattctatgactgcttggaggcttagggtctccgccttgtctcatgcttctgtgtctgatccttagctctgcaatttgtcaggttgcctataaagaaggcatgctcatgtgtgagcaaggtgggccttacaaaaaattggtgtcattgtggagaatcacatttcatattgtatgtttcattccatctagtggtatagtgaacagtccatattagactttcctgtgctcttaagcctggctactcaaggtgtggccagagggccagcaacacctggatcacctgggtgcttgctagaaatgcagaatcttgagttctctctagcctaagtcggaatccataattaccaagacaccaggtgattcagcccaataaagtgtgaggagcacagaactaaagtccttttcagccgggcgcggtggctcacgcctataatcccaaccctttgggaggctaaagctgggggatagcttgaggccagtagttcaaaaccagcctgggcaacaaagtgagaccccccctccccatctctacaaaaaatttaaaaattatccaggtgtggtggggcatgctactcgggaggctgaggtgggaggatcgcttgagcctgggagttcaaggctgcggtgagctaagaaggtaccactgcacagtgcactctagcctaggtaaaagaccgtgtctttaaaaagataaataaatacaaaatataacatttcttctatcatatattaggtctttgttttcctggctgtccccttctgggtagaagattcctcaggagaggacctgaaatctgtggttgtcatttctgtatcttcagtgcccagcagagagagactcagaaattaagtgtttttcctcctgtctttcccttgggaatccctacaagttaacagcaatggtcaaacaaatcctgcccctaactcggcccctttgtcttgagttaggggcctgggctacctttctgagccacctcagacccacctgcctcgcccagctactcatctttagacgggcccctgctccccagcccttctctgttctcctgctacccaagggttccagctttgccaccagctacttatgtgtgactttttgaaaatcaccctaccttctgggtctcatctgtaaaatgagtggatctgactcattagctagagctgtcaacggcagcatctgcaactcacaggtgtgttttaatcactggcaaggtactttgcaagtgactttttatatgatcattaaggtttgatgggcttttttaaatgaatagagcagattcaaggttatccctttgactgtcattctcggtagcattctggtgtgctttctgaaacaggagaaaaatgggtggagttacaggtagctccagggatcacacataagcttggggcacatacaccgttgggagtgtgttatgtttcacacagaaaagttgcctggttatctgtcatgtgtctcaacagcacaaagactgatctataaacttttctgctccatcatcttttgggctataaggcctggtgtaaaagagatggtttttattttatctggagaaaagactgctcttggaaaatgcaaatttccaaatatctcctgtgatgtagtagctcctcttaaaatttaaactcacacagagacttgaggaggtgatactctttaaattttttcatcttcttctttggctttgcttccagaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatggtaggtgtattgcctttgtcatcttctgccggcccatggactgtgggcttttttgattggtgtatttagaccaattacacttaagataattgttatattagcacctaggaccgccactttatgatttgtgttctacttgtttcctctggttctcagttctttttcttttttttcccttcctgtaggttacttcagcatttttaaaaattctatcttgattgatttatggttttttgttttcttttcttttttagagtgaagtgtgaaaacctcacttccattcactttgtccacttttacgtttcattgcttaggtatcggatggtgttataaattttgtttcaatcatgaaatacaatttataaaactcacaaaggaaataacattttatgcgcccgcctgtatttctgctcttctgttgtttcttcttccttcctgatgctctaagattcttgtatcatttcctttctgtatgaagagctttctatggccaatctttaagggtatgtctgctagcaacaaattctttcagttttcctttgtctgagaatgtttttatttgattcctgaagaatcattaagccagatatagaattcagggttggcagttcttttcttttagcacttgaaaaatattgtgccatttccttttggcttccatggtttcagatgagaaatccactgtcattcaaattggtgtttctcagtaacagtcctaggtaatatgtcatttctctctggctgctttcaagatcttaaaatttatcattagctttcagaagtttaatatgatgtgtcttggcatggctttttgcagtttatcctatttagagtttacttgtgtgtcagggatccccatgatccccatccccaagactaccaccaggtttggtgaggttggaggatttactagtttgactgagcatatagttgtactcccagttaggatttattataacaaagggacacaaagcaaaatgagcaaagagaaaaggtgtatggagcaatgtccagaggaaattaggcacgagcttccaacggctctctcccagtggagtcacacacaacacgtttaattccttctgcaataaattgtaacaaccagtcagacaatcttttgttgacaaagaaagctcacatgaacctaggactccaggatttttatctggagtcagtcacatagataccctctgcctagcatatgccaaaattccagactcccagaaggaaaggtgtgcagcacgaaccctattgtttgcacgaagcaatttaaacacactgagctactcttataagttagagaacggtaggagctttcccaaaatctaagtgcaaatgccaacacagtgaaaaaggcaaataatgtcttcgtattattatgaaaatagccctgaccttatggactttctcagaaaggggctctggaacttcatgattactgaattcagggcttggacagttcaatctgtttctttgaaccttaacttccttagctataaagtgagggtatactttctacaccacaaggtagctatggatagaaataattcatgtagtgtacttgttatagcccataactcatcataggttttcagtaactattattattgagccactcattaatctagccaagaacaactacagaaaagtatacataaaatgactacaggccgggtgcagtgactcacacctataatcccaacactttgggaggctggggcaggtggattacttgaggccaggagttcaagaccagcctggccaacttggcgaaactccatctctactaaaaatatacaaattagccaggcatcgtggtgcatgcaactcaggaggctgaatcacaagaattgcttgaacttgagaggcggaagttgcagtgaaccgagattgcgtcactgcactccagcctgggtgacagtgagactctgtctcaaaaaatatatatatctaaaatgaatataaacatttctggaatataattccataatccactttacagtgtaatccttaaggattatatactcatgatgctttggtacatattcattcatttattcatccaaccagctttaattaagctcccataatgtgacagccatgttgaacttccttgagttctttcttagcttggggcctttgcagatgccactccctctaccttattttttagatatcagggataatgtttcttcttctgttcaaccaatatctccccgctaaaggaggctatagtttcctgctattgcttccatacttctcctatacttccctcttataaagatcatcactttttactgttattactggtttacttgtcattttttccaccaaactgcaagatctgtaagagtagggttgcttccattatctactgctgtataacaaaccacacaaaaacaaagtgactttgaacaatgacaatttaatttttatgattctattttggttgggaagtttgtttacgggcttcatctggtctcactcatgtgtctgcattcaggtggagagtcagtggaattccatgtctaagatatagtcacttaaatgtctagcaattgatgctggctatcagatgggattccttgactctggtttacgtggttttcatcctccagtagactagactggcttccttacattgtggtctcaggacagcattttcagaaagcgaagataaaagccacaagacctcttgagaaatagactctagaatttgcacacattatattgatcaaagcaagttacgagaccatcccagaccaaatgatgtcgagaaatagattccacctttgtgcatactaagatgggaggaatttttggctattaaacaatctgtcatagttcctatttggtcacagattattcacattcctcccacatgcaagatattcttaccccttgatatggattggctctgtgtccccacccaaattcccagtgttcggggagggacttggtgggaggtaattggatcatgatagtgagttcttacaagatctcatggtttaaatgtgtgtggcacttccccgctcgctcatgctctctcctgctaccatgtgaagaaggtgcttgcttcccctttgccttccaccatgattgtaggtttcctgaggcctcccagttgtgcttcctgttaggcctgtggaactgtgagtcgattaaacctcttttctttataaattacccagtctcaggtagttctttatagcagtgtaggaacggactaatacatccctatctcagtaccccaaaatctcatcctgattatctcatcacacttgaagtctaggattttaagacatgaactagatgtggttcaggttcaccagctgggactctttctgattcagagaccaatgagccaaaaagatacattatcaacaccccccacacccaacaaacagtggtaagacaggaacagaataaccacagtagacaaaagagggtggaataggaggcgtatagcagccattagtccgtagcaattctgaaaaccagctggtcacattttaccagggcccctactctgaggtaaatattccttgattagggtctcatattactcctggtggcttcctattccattgttctccatgtctcttggctctgctacctgaattcttggctctgctctctgagaagtccttccttttcctaagaaatgcccatgtttgcagctgagtagctttctcagcctatctcctgactataggatactggggccccagaggcttctttttgatttgaactatgtcaccagttcaagcttgtggtactctcaataatgcgattatctcaaaaacttcatgggtttcctgcgaatctgattggattcatttcatatttcaaaagccacatccattatttttcaaacaagctttgctctaatttgagtggcttagatttctgtgggaaaatgcccttgagattcttagaaatttttttgtcgagctgagagggcctattatgtaccacctcaaatatttttgagtcttaataaagggttgtacaaccatacttttttttttttttaagacagggtctcaccctgtcacccaggctggagtgcagtggttcaagcacagctcactgcaacctctgcctcccaggttcaagtgatccccccatctcagcctcccgggtggctaggaccataggtgtgcgctaccatgcctggctaattttttgcatttcttttttgtagagatgagatttcatcatgttgcccaggctggtctcaaactcctggactcaagcaaaccacctgccttggcctcccaaagggctgggattttataagtgttagttattgtgtccgccctgatttgatctttatgctgaggcctatgagactcttttgctggttggaaagaataaaaatgttaaaatagttttattttctaacccagcacatcccgggatctttacattatctctaaattttgcttacaaacggagcagtttttccttcattttatttgttttctccccatactttgtcatatgtagcttaaaaagcagttgacattttgttctacattccacctggaaacttcctgaactgtatctacagctccattaggtatattttctatcttctatgttactgcaagtgacaattttgccagttaattctgccactgaataacaaggttcacttctctctagattccaacagcaatttcttttctgctcttcgagccttcaccagcagtctcttcattgccttcccagcttctgctcaccaaccagtccaaagtcaataccctgggttttgtattttaagacagtacctctcttttatagatataaatatctgtgttggttatctcttgtggcataataaaacactcccaaaactaagtggcttaaaacaacagaagtttattatttctcacagtcccatgggctacctgggcagttcctcttctcgatcacctgggctcattcatgaggttgatagaatttgcacaagatgtggccaagatggccgccttcatatatctggcaattggtggtggctgttggctgtctctattctcctttatatggccttttgttctccagtaggttagactatcttccttacatatattgttctcagagcagtactcttgagagaaggcagaaactgcatgtcacccagtttatccattcacctactgaagaaacatcttggttgcttccatgttttggccgttatgaataaagctactataacatccctgtgcagcttgtatggacataagttttcaacttatttgagtaaatataaaggagtgtgattgctggatcttatgtaagaatatgtttagttttgtaagaaactgccaaactgtcttccaaagtggatgtaccattttgcattcctaccagcaatgaatgaaagttcttattgctccacatccccaccagcatttggtcactgttttggatttttgccattctaataggtgtgtagtggtatcttgtagttttagttttttttttggcccggtggggtgggggttgcatatatgtgaaacattgtaacagctctaagagtcagagctatacaaaaaggtggagccagagaagtgtctctcactccctcttcatctctactatccagctcccatttctcttttctttccacctctttcccactcaactcctgcaggtaatcaatttctttagtttttgctttatgttttctatatttctttttcacaaatgagcagatataggtatattttcttatatccctttctttctttctttgagacagagtttcgctcttgtcgcctaggctggagtgcagtggcgcaatcttggctcaccgcaacctctgcctcccaggttcaagtgattctcctgcctcagcctccggagtagctgggattacaggcatgcaccaccatgtccagctaatttttttgtatttttagtagagacagggtttctccacatcggtcaggctggtctcgaactcccgacctcaggtgatctgcccacctcggcctcccaaagtgctgggattacaggcgtgagccatcacacccagcccatccctttctttcttacatgaagagtagtatagtttagatagctcttttgcacttaagagtattttattttacattattgagacatagtctcactctgttgctcaggctggagtgcagtggcacaaacagctcactgcaccctcaacctcccagcctcaagcgacctttcacctcagccttctgagtagctgggactacaggcatgcactaccatgtctggataattgtttttttgttttatttttagaaatggggtctcactatgttgtcccggcttgtctcagacttggctcaagcaatcctcttgcctcagcctcccaaggtgctgggcccactgcacccagccagaacagttattttaaagtctgtttctgaaaacacattatctggataatctatgtgcctgttttattaagaattttttttttttcagacggagtctcgctgtcacccaggctggagtgcagtggtgcagtctcagctcactgcaacctctgcctcccgagttcaagcgattctcctgcctcagcctcccaagtagctgggactacacgcgtgcgccaccatgcccagctaattttcgtatttttagtagagacgagatttcaccatggtggtcaggctggtctcaaactcctgacctcatgattcctgcctcggcctcccaaagtgctgggattacaggcatgagccaccgtgcctggcatatttttcagtttagatgttgtatttgtttttcaaatctatccttttctcgtattttaaacttcttttgtgtgtttaatcaacgtgtgtgtgctaacgttttgagagatctgatcttgctattgtgttaactgttgcttatggtacattgtttcctcatgcattttgtgattttggattgtgaagtcattttcagaggactccgttgtgcagcctgagttgagggcatgtcacactaaagcaatattgtgtttgcttctgtgaggcatcctgggatatctccatcctaagaccagtttttatagtaatatctcctatggattgagaataaatgaataccaagcccatgtaaggaagacgactttggttttaaattcttatgggagactccttaccccatccagaacctgggctgaaacaaacttccttgtcatctctaagtgctggagagcagattttaaaatctggattatttccaaaaggtatatcccttcaagagtgctggcttcatgtagagtcttggttccagttaactttcttcctgcaaggactcattttctgttcttatgtagatgttaaagcacagccagatatttaataagaccatctgttgcccactccaccaccattacctgcctagacagtcactggatcagctcacatacttaattgctttgattttcaattttctctttgtttttggcctccagagttcctttattttcttaaaggcatgacagtgctttccaaaggatatccactatattttcgttaaggcgagaagggcttcaggttatctaacctaccatattgctggaaatagaagttaaaccgtttttttcctagtctgtaactgccactattatggtgatgatataggctaagtctgaatattttatgtgaacatattaggaaaattatcctactctgcaagttttggacaatattttttctttgtttcctcaagaaacagccagagaacattctaaaggccaatctgcttgtgtccacttcagacccaatgaaggcagtgatggaagcaggcatccaggagttccctctgttgagaagtccagaggtgagacagctggcgatgagcggtgtgcaaaggggaaaggcttcgtgaagcagccctcctgtatcagggtggctgggcctgatgagaaaggagaggactccaggcgggcagctgcaagccttccaccgcacgatagccactggaagcccagcaggcggcatgacacagaacccaaggccaaatgtgccccccagaaaaggcgcactcaagagctcagaggaggaaggtgctctccggctggttctagccgccctggcagtgcccggggggaggcggtccatgctgggcagaatcctccccaccatcgtacaccaagaaacaaagtgacacaagccaagctcacaggagggctctattcacatttgccacagagcacagaggagttgaggtcaggagctaggaggctggagacatctaccctgtccgaggactttcaggtatctaaggagactgatccagcacctggtcccctctctgggcagagtgtgaatattgaccttctccccgtagagctccgactgcagataattcagagagaacgaaggaggaaggagctgtttcgcaaaaagaacaaggcagcagcagtcatccagcgcgcctggcgaaggtaggaaaatggggtgctgccgcatctgtggttctttgttactgatattctcaacatgacatctgtgctctttgatgttttcccagtgagttccatgtggtggcatggtaaggccaattttatagagcctacccatgaaattcacaccagatcctagtaatttacattgtataaaccatttggaagatgtttttgcctagaaagatgggaaagtgctcaggacagcatggggtaaaggaaaaagccctgggtttgtaaccatgaaatgtgaggttcaggtaagctctaacaggttatgtgactttgggcaaatcacatggcccccctgaccctctgcttcttcatctgtaaaacaggatttaataattgttgcacatgtcctgttaatatgacaggttgctggaatgagataatgcacgcttcattaattctaaattactacacataggagatactttatttttattcttatgtctttactacccaggaactagtcatactccaaacacctaaaccagggtctggatataacagattgagtgactaaactgtattatgtaaacctgtctgagcatctaccaagctcaaaatacatagtaggcactgggagtgggggtgaaggctgtcctaaaagcctgaaacagactcccaatatagtagagacaaatgccgctaggggatgattatgggaggacttgaggggtcttattgctacaaatgttcacgtctcataatctctttcatcctgaaagcctcactagagcctaaatctaaattaggccttacagtgatgaatgtccagagagaagctggacccatcaccaataggtgggagttggccgggcagagtggcttacacctgtaaccccagcactttgggaggccgaggagggaggatcacttgaacccagggttatgagacgagaccaccccaggaaacacggccaaactccgtctctacaaaaagtacaacaattacctacgcatggtggcacatgcctgtagtcctagctatttgtgaggctgaggcaggaggatcgcttgagcccaggaggtcaaggccacagtgagccatcaccatgccacagaactccagcctgggcgacagagtgagaccctgtctcaagaaaagaaataggtggaagttatgtcgccgccatcactggggagaggaagacggatggggagggagacaaggcaaggaaataatgcggcacaggtgtatgagatatcgaggttcccgtcaggagaaaaaggaagacgttctctccttaacattggcagggagaaaactagatagattcccaggaggtccagggagaggcctccgttcatatcataccagagactgcctaacccagagccgggtgatctggtttgtgcttgcacaggctttgcaatgtgttctccctatgtctgtttcagctcttggccattaacaaagtcctctcatgcctgaccccatgtgaactcccaaccacaccaggaagccatcatgacagggagcagtatccccatttttcagacgagaggaaaaactgacttgtccttttggtgcagatccagcacttgaacctctggctgactcaaatccaagggcctttcccttacattattagtgaagttagtttttgctgtggtcaagctaagggaggtggaggtgggccccatgcactttgcctgaaaataggctggagaaggctgcctggttggtgtcacacacatcagggtaaccaggagaagggtgatgttactactaccaattgttaacatactagtattatttattggacacttgtgccactgttcaaactagttttacctgtgcatgtaatcgtcactgataaccctgcaaggtaggtattgttcttatccccgttacacagatgaggaaactgaagcacagagaggttcatcaactcaccaacattacagagcaagtgccagggctggctttgagccaagacagtcggcctcgaaagccacaggtggaaatggccattgcactctgtgggacatgcactggctaccatccagatgaactttttaagtattctggctaaaatctaggatctaaacaagccagcaaggtttaccacgccagaccccacagctgctccctacctgaaatgtctccttctccgactgtctgactcctttgaagagtcagaagctgacaggtcctgtcagtaagtgaccagagtagcaaatgagccttcagtcattcccccaagaacagtgggcttatggtctaacatgcccacctgcgtaggtaactacacaggccccctctggatgtgccattgtgcaattctgaggcccaaaggacttctgggattgttgcacattgcagaaagccaagtctggtgacagtaaacacacttttattgattctattatattttaactacattttctattgtaaatacaggagcctgaagcgctgtcctgcaagtgtatctgatagcaaacctaagcagtgagggctggggcaggggtcagggctggacactaagtgttcagtgcaggctgtggttataggggacaggtggaggatggagaaaaggagctggaaaacaggcagggaagaagtgggcaaaatgaaccttgggtcctgagaaaatgaaacttgatcttaaaattgtcagtttaataaccaagtaagatgactattttaaagattgaaacaggatcctggacaagctgagcaggaaaggtgctgctgggcccactgagggctgacaccattaacagcttcagccactacctgggcttccccccaagttctgtgcccacaagagcagaaggtatggaagacagcatttcaaacaggagaaactgaattatagcgcggtagtgccatacttttctctagacttggctttttggaaatgtggtacgtattctagtagagggatgccatggtgttaccctccaggacagaaggaagagtagtgtaggctgactgaaatcagcctttggggaaggagggaggggctgcaccaagcgctgcaaggagcttttagcagacttaggaaaaagattacttcccatttggtgcagcccaaatgggatcactgtaaaatcagacatgaagcctgttgctctctgcagctacctataggctcactaggaataaagacagatacagataataaacattgctgcagctttcctttggaggcctcaaaatagttgttgtgctcagtaagtttgggagtgcatgtgggactgaaaacatcaaataaatcctagatgtaaatatagccatcatccccattcctcacccactctaaacccacctccaacagacttatcttagtaagatgcagctcatacctttaccactctaaagccccctttcgtcaccaaagacacagtgcttccacattgtgttactgactttctggcacaaatgcctctatctatctctgctgatgccagttctgctacgtagaatgcccttctctgcctggtaagctcctattcatcttttaaaatccagcacaaatattaaccttgtgaaaccttaccaaaccatcagtcagtcctgcatctgtttgcacaaccagctccttgctcttgcacagtactctcatgccacacgtacctctttacacagcagcctgttccactagtctgtgagctccttgaaggcaaggaatcatgattgaatcctagttcaggaggtgtttgataatggaaaaagaattccacattcaacatgctgccgccaaaattaggaatgggagcttgaatgaacctaccaggaattcagcaaatactactcctatagcttctagaaaccttaaggaaatttagttttctcagtactgtgatcttaaagcctctcctctcctctgacccaaccagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggcccccaagagtccatccaagggcacctcaggcacaaagtccaccaagcactcagtgcttaagcaaatctatggtaactgtccttctgcctactttgtagttcacaagtacccccagagtaccacatcagaatctgaagtagaatttaattacattgggtaaacttccattcagataaattaggttggtgcaaaattaattgtattattaaaaatggtcaaaactgcaattaattttgcaccaacctaatatttctcaagcaccatttcattcctgcctcccagcgatactgggtcataattgtttggtttcgtgaggcattctagcatctcagcccagagtgccctcaagctttactgtttaaacctctccagacccctgcttgagtctcctccttgcattacccatttggagcattcacgacttagctagactctgcctgtatcactttgacttttcctatgctgagatgttatagggttgcccactatgagaatgctcaacacccatgcactatagtaaatatttgttcagcagattaactgctgtaaattgaaacattttcagctctgcaaagagcccatccaaatagacccagtagagttcaagaagccttgctggctcaagagaaaaaaagataagcaagagcacctttagaaagatctcctacagcatgaactttaacattcatttagcaaaatctcaggactttaccctgggcctacatgtttccacaccatacctaacttatcttgacacacacctgcaagctcaagcctttaccacaataaggaattcagaagttggtcaggccaaacgtatccctggccaaagaaaagtaacagttgttggttcatttcaggttgttctcacgaagggaaaatacatcatcctacaagatctgtaaaagcctcttctgtgctgcgtctcaactcaggtaaggcagccactgcaaagcagatggtggggaagaacatggggaagcattttcctttgtttcatccccaaagacagaagacattagaacagatatggccagggttttccaatggtcatttgatttcatgggattattactgtagccaacatctgtctccctaagaggcaaattattttcacaactaaaagctattattgttaacattaactccaacagaaataaatggtagctattattgatcacttttacacattttttcacacaaaggaaataaatgaaaatactgtcactcttcaaaggaataccttgggaatccttgttccattttggtgtcacactatgatcccctatttccttctccaagatgggaagaacaccatgaagagaacactgagagcatgtacagcccaggctcagctgtgcgtgctttccctcatacaggagaagctcagggaactttcttttcagccaccaagacaagagtgttttacttagggccccctcattcacaccagcattaaatatgggtgataagttcattgctgtcagcagctaatgccaggtccagtgtttctcataggtggctatggcaacacgctcccccctgcctcctcgatccacacagtcatcctggaggaacagagtgcagctgggaaggtgaacaatgactgtcagcatgaactttaatattcatttagttttttgatggggggcaaaaacctggaggtgggggacagagtaattactgccaaatctttaataagtgttggacaactcatgtaatacagacaggctgatcagggagtggtgggtggggtagttagaaactttcaaagcaatcaaggcctacagtctgtttaaaaacaaacaaacaaaaaaacccctttcattatacctgagcaaattaaagaatcatttcaaaaacagaattgtcagatatcactaccagagaagtggcatttagacaatcaaatactagcataaattagataactggatcatttttcagtcttaagagaaaaacaaatccaagactaccagaaatcttttaaaatggtgtttagcagcatataagttttttagttaagagactcagaagggacagagtaaataaattcaaatcaatacttaatgatttcttaggacttcatatgaacaagcaacttacttgtcctacacatatttttgactggtttaaaatcagacaaggataaaatgatcttttcctaaccccaaatttaggagaacacacagttttgttaggctcaagcccacccacattaagcattaaccagttaatgaatattattgctctcaccctccaacttggagaaccccccacccccgaggttttagtagtgcctttaccacttaaaaaggaagaagcagaaaggtggatatagcaaaatgccagcctccttgggctgtttctccacatgtatttgggaggcagcaaatcaatccctgctcatgtcagtcttctacacccagccttgcaaaccacccaccaagaatctcagcagagccttttattgacacacaacacacacacacacacacacacacacacacacacagccttgcaaaccacccaccaagaatctcagcagagccttttattgacacacacacacacacacacacacacacacacacacacacacacacctgggcctatctctttaacaataaaagaaaagaactccctttaaagttccattccagtgaatggaataactgtgattattagtattggtaccccctgtacaaatccagtttattcttgctcacctgcagaggggtacacagatgacaactccattcaagatacagtgaagacagccaaaaacaatagttcacattaaaataattttgtggaagttataaaaccaagagagaaaaattgagacatatgtttgttacttttaaaaactactaaacctttaatgtatttgcttatatgctccataaaaagttagaagcaaaatatagcaatgtcttcagcaaggtttctcatatggggcctcagtatcatttgtcaaagtatatcactaatgttttctgactgtggcatcctatacatttgttaattcaaagtcataaaaaggcctcaaaaatccattttgatattcccatcagcttatcattcatgaggatctgaatattttctaacaaacctattttctagaacaactattcaaagtgtaataggagagttaaaagatgtgttacctgtttatgtaatgtgttatgtgagagacccagagagagaatctatttgttatttcaggcagactgaagaccgaggttctggtaccagctccccaagtgcctgctctctcttaatcaagtctcccttgaagagatgtcccatatcttgagactgcaggaaatataaagctattatattaagtcatcctgcctctacagtaaactggcccatcatcccagggatagcctaaaccgaaatccttcttcctcaacaccaatgaactattcccttcagccttaaaattaataaccttaatatctatctggtatttgtttttaacagtgagcaacctacagtgtatacatctccttgagaacagtggaagatcaaagaacttttcttataacctgcaatcagctactcagccaaaaaacaaaacaaaaccttgactgcctatggaggaagactgtgttcgggggagctggcatagctagtgcagagttcagattttctgctgataatcttttacaccttgggaaaactttaatatccgtacctgaaggctgattcacctaaaaatgtgttaactgaaagaaaatgtcagaatgtttcctttctgctcttacacagcattgttttgtcaatcaacacagcctgcactgaaaggacctgcatagactatgtctgtgcaaagtgcctgagtgtctgctttcacctcagtctgtacagttggaaatgagaattcataattaacagcaaaatctaaggaaaactacggctgctgggttgggatttctgccagctagctggtactggcttcttgtttcaagagatgaacctaaatgagataggaagcctgtcccatagcagccttcctctcactactttcctggcatctaatgcaacaaacttatcacac

SEQ ID NO: 37378 - DNA, 4351 bp, Homo sapiens
tgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggtaatggggcagagagatgggacctggggcaaaggctaagcgaaggagagctggagcgggtgaactaagagcgggggcgagatctgaggatggaaggctttgggggtgtcggaggcagagggacccgggggtttgcagcgaagggtgtctggagagggagagctgaggaggggccggttctgggggctgcagaacggggatttatggtgtcgactgggagcaggaggagggtcttcgaggggcctgggggcgggggactaagatggacgcctgggaagggaactgggaggcagcggggtgcctgggggccgagggctgaggacggggtgcggaggcgcactctgggaatgccgagagggtcccgcagagacgtcagggcgcccgtgcgggccggcggggagctggggggctaggggcggacgcccgacgtgatggcccttcccgcaggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtgcgggccccgctcgcggacgctcgggggagggaagcgaatgggctcggcgagggaaaggacgccccgggccttatcagagcccccttggacccgcaggtggccgaggggcaggaattgaaggacaagagtcgcctgcgctatcctattaacggtgcctaggggacgggccctcgcgctggagttaagcggccgggggtggagctccaggcctagcggggaggtccacggagattggcccccaccccaggctcctttgtgtgcctctgttacgcccaggacagacgccgggggctctccctatgcccctcgtccccacagccttaccccatttactgctactccgtgcaccacagcagtggctggggtgatcctctgaaggccagggtggcagcctaatgcttggggcagggtctgtggcccccctgagttttgggctctgcgtgtgtttgcggggtggggatgtggaggcgcgcagccccagggctcactgtgcgctgtggttcaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggtgagaggggtcctggggtggagacggaggcagattggggcgtctgcctgtacattcactctccaatattctccaggcaatccgatttacgacttttttctgggacgagagctcaaccctcgtatctgtttcttcgacttcaaatatttctgtgaactgcgacccggcctcatcggctgggtatgttgggcttgactgagctggcctcaggccagggggagggttagggtgggtgagcagcgcttgggcagggcagggccaaaactgtgcagatgcgagtcattaaccattcatattccacaaacatttgttcaatccacctgtgcctaggtactgggagacaaaaataaagttagaggcaaaaaagcatctttgctgcagagagcctacattctggtgggaaagacagaaaaaaataagtaaaatatatacagcatgtcagggatgacgttaggagagcacgtgcaattctcaacagcagtcaagcacagaatctatttccagggagtgaccgcatgctgcttgatggtcaaggcagtgcagaacctgaaattgatcgctggggttagcaacctacccgtcactagtggccttgacaacattccaactgtgatctctggttctgtggccaagattacccaaagaaactcttgggcaaggcctctcctgttgccctggaaattatcttacccgaggcaggagtgccaggtgcccaccctgggtctgggtcctggcctgatgacaggcacatctgaggacacttcctcatctttgagatgtgataaaattaaagctttctcctaagattactgggaagattagaagaggtaatctttatgatagaacagagctcagtgtcaaatgcaggcgcccagcacaggcttgctccggctagccacactgagcacgtaccacttgccagggacgctatggagggcttcaaacacgatgatgccattgagtcatgacaggcccatgattatccccatttttcacacaggggtgggggaaagtaggctgtggagagggcaagcaacctgcccaagtgatgatgctgagatctgaaaacaggtctgtttgagcactgaagccttagcccgaaagggcttaggacagacaaggcaagaagaaacaggctgcgggcacctccctgtccacagtctctgtccttgggtctagggcctggatccacttaagagctggagtgtaactgacagttgagaagggcagaggctggccactgctctgcccaaggctgccacttctgtggagactattgccttgttccctctccccaggtcctcatcaacctggccctgttgatgaaggaggcagagcttcgaggcagtccctcactggccatgtggctggtcaatggcttccagttgctctacgtgggtgatgccctctggcacgaggtgaggctggactggacgagggtgggtgtctgagggccgcatagggactaagccagtgtgtctgggtcttgtccctgcaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatggtcagtcaggaaggggcagcaggctgggcccatcttccccctatccctttgattcatgctctgtttacacgcaccaccacataggtgctaacccccagggttctctaaagccagggcagggtcctgggggtccaggcagagtctgggctgcagacaagttgggcagatgttcggggtcaggcaggaggctgcaacccttgaccttgaccaccggttcacactctctcaccagctactggttactacatcttccgtggggcgaattcccagaaaaacactttccgaaagaatccttctgaccccagagtggctggtgagctggttctctagggccatgggtgaggtggggcagctgggcttcctgggaactctccaccctgctgtctttccccagggcttgagaccatctctacagccacagggcggaaactgctggtgtctgggtggtggggtatggtccgccatcccaactatcttggagacctcatcatggctctggcttggtccttgccctgcggtgagtggcccatgtggatatgggtagggacatgtgaggggaagaggtggctcagcgaccacaggatgcctactttgggtatgcaccagtgagagtagtcagagagctgggggtggacccagtgtgtggctggggcacacctctgtgccaacctagtaccgtgtgctttgctgcagaccctggcgcttttgctgctgagccccgatgcccacatgagccatgaggtgtggaaacgtttgtgaactgcggggtggaggggccggcagggtggtcacagagcctccttctctacaggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgg

SEQ ID NO: 37379 - DNA, 35548 bp, Homo sapiens
cagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggtgagttttattggcaaactgtgcctctgggtgatgtgtgcctatgctttacaagaattgcctaatttcccaccccctgcaagccgcaaatgaaaaggattgcaggagagatggtgcatttgtgttggaattgactggagattcagagggctttttatatccttggttaaaaggtggatatatactctggctggggaggtggggggccatctgagagcatctagaaaccctaatgcatccagattgaaaggaagaaaggaatctagatgctttttcccccatggaaaatagctgtgcacacacagctggcaggtggccttggtaagcaggttagggagaagctgccacctgtggcagagccttggccagccgggctctgggtgtggcaagcctggtcagcaggcactgagtagcacttcctctgccaccattgagaaccaggcaggaggccagaggcagtgagggacagatgggttgggtttacctgtctggcagtatatggtgtggctgtgacctgggtggttattgattaaactattgggttcaaaagaaaggaagaagcgagctgtagcacccaatatatgcacttttctgtatgtgtattagactttattaaaaagtttatttgaaaatcacaaaggaagggaaagaaaaccctgagttagatatgctcatatttctaaagtgcttacttagaacagtcctgagtatgttgtgatcacataagtgttggttaaataaataaatgtccaaatggcataaaacaaagtaataatttctagagcaaatctaacttataaaatgacctgtggaggaaagaaaacactgccatgtctttagacttttttttctacttgcatatgcactttcatttataaatctttatctatctatctatatctatctatctatctatctatctacctacctacctacctacctatcagagttacaagctactttagtgcagaggtggtcaggtcttccctgaaaggttgatgtgagagttaaatgtgatataataatagtggtggcaatttgggcactgggcccttattatgttgcagacacgatgttaactgctttgtacatattgtctccttcaatcaccaccataaacctttaaagcaggcattactatttccttttgcacctgagaaaactgaagctcagtgaacttgagaaattgcccaaattcacaacaaaagtaagcagggtgattaggtttgttggagcccagagccagagtgcctaaccactgcaccatactgcctctcacagaccatgcatataaagtccaggcaaagtgcttggcatataacgggcactgtaaatgcagtgtttacaagtacacttcattttaatctgataacacgatagttttaaaaagatcattgtttgaagatctttttcaaatttatttttacttaccgtaagaatatacaattagctaaaatagcagctcctttcaaatcgtaaaataatatagaattatttgaatcattgagagtgatgagcttctatgacacagtacactagaggtagggaagtgtgtgtgtgtgtgtgtgtgcgcgcgcgtgcgtgaactgctgcattttcaggcagaaacctttaacatccacattcctgctccctgtcccgtgcctcaaggctggcctgcgcacgggagtctcagttgggcgcgcctctgccaagccgagactgaagggggctagcctctctccctgtaacgctgggcgggccacgttaggaggctatgaatcagctgatttccttggctgctccaaccccacctcaaatggccacctcgcacccgcccgccaaaccccatggccaggactccagccaaggctgacagccaagcccgactgctgcaggaacactttgcctagagcttattcggtggtagtctggttttgcctaggctaggaggagcccaatcccagaccatgctatccagtagtcggccggacttttcttcccctaattcgcacccaagaggagcccgctagatcaatccccgccaatcctaggaagctggcatgcttcgtaggtgcagacagtaatagcggggaccggcgcggggcaggtgtgtccggctaagacgccaggacagggcaggggctccaggacccgagaggagagggacttcttccagcgctcaagcgcccgctgccctctattagtgggaaaggaatccagcctcagccccgcgcgggcgcggtcggcgtcggcgggcccagaagcccagccctgggcatccgctgagctacatttggctgggtcttcccagagtgggctgaggagccagtttctcggtcaacactaggtctccacggggccaggggagaagggaggtgggaggtgagaaagctcagccgcctctggtttcgagtaaaagtcgccgcggttttgcagggaccgactttttcttgaggcgcatttaaggccaagtgactgtctcctgccctccctctctcctgccccctctcctccctgagtcccgccctcccgcacacgctgacccagggacacaccctactgcagcgacgcaaacagggcgttgttcccgttaaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgtaagtgatttggtggggagagtgaaggagatggaggagaaatgtgggcatcttccagtgagggtgccagaaagcgcagcgcaggcgcggggctttggccagctccctggggcttctgtttaggggcacagggtcccctgtgtgtcctgtttccctccaatgggtcttggagtaatacaacgaggagagcctttatggtctataagaccttacagggcaagggtgatggtgctggtgtctggatagcggataagggcggcccagttctcgccttgctgaagaggcgttgactctgggacacactggcaaaacagtccctgtggcggacatcccgagagtgttggactcctgtggttccccagttcccagcctcctgccatcggcttaattcaaaccctctgggagtcatcagaaatccttgtttatttcttccagtgcattccagagtttctttgaatgtgatgcttgtggagaggaacagaggggcctgggattgggtactttccaaactgggttattgaaacgttgtctccctggcccaagactctgcctaaaatggtccccagagtctcagccagatctttcacagccatgcatgtcctctaacaggtcatcccagccttcagttcccccaaagtttaaaatgaggggcgaggaccgcattacttgggataaatgtcctgccggctctgaccggctgaaattctcggactcagccttttaccctctgtctctctctcccgtccgctggacatctactcccttcggtccaggctcctgggctcctgtcccaccgcacccagaccggagctcaggcttgttggggttcgtgtcctggctttgagtgcctggggtgcagactggacccctaggcgagcacgtgggtctagcgcaagagcagaatgccccctgaccccaggggctgcctggggaagcgcgcggtggacgggaagcgcagggtccgggcaaccctctcgagccattcttttctttccacactactctggctctgcaccacctctccggagccgccagagtctgcgcgaggctgagctggggccaggaccgttcctctacgctggcagagttgggtggaaacttggagacaaacggaatgcggagagcactggggtctgggaaaccagcctcctcgccgctgtctcccccaccgcatgccacggctgtctccaggtctcagacggaaatctgggcacctactcccctcacccctacctccaccccataggggaattcaccatctgaaccggggtctcggagaacgtgacctctcaccttccagggaggtcgccgggaggtgcttggggtgggtggaagcgtgcagtggcctctgctcatattttctggaaacccctccgttccctgggtggttttagacgtgcgaaccgcttgttttgtttccaaaagcaaaagatgttccgttgcaggcgggcccggctgggcgctgggcactgggcgctggtcctgcaggcggctgctgccccctctcggcggcaggcggcgcgaaggctcctgacccgcgcgggcggtcgggctgcgggcgctgggccaggccgggccttccgctagtgcgcgggaccctccctctgcgcgcgcctccgtcgctcggcccagtgcgttcggcctcacgcccagcgctctcctcgcaggcagaaactccgctgagcagaacttgccgccagaatgctcctcctgttgctgagtatcatcgtcctccacgtcgcggtgctggtgctgctgttcgtctccacgatcgtcagcgtgagtgcctggcggggaggctccctgcgcggcccgcccttccccatctgggttcccagcccgtgctcctgctggttcaggactgtgttatttgcagacagttggaagtctcagacgtcccagggaagtttctggcaatctgcccccttccagttgctttgagaaaacgagagcagattcagtgataggaaccaagcgagcgctgggctgggttagctgcgcaggtctctatttaagccaagtaacttcagagccgatctagggtccccgaccttcatttgacaagattgtttaacttttttttttcttgatgcagcctcgttgaagaagaggagtatttatgatttttttttctccaaaccatagtcagatgggtgaattaatttataaaacacccttttaggacttgaaattggaaagttaaaatgggcttttctggaaaagagttcacaggtcccatgtcggctttatggcatgaacacaacacattgttagtaaagcttccactggtaggaacaggccatcagagtaacttctgttacaaaactgtccagcccattagatcttaaagttattttcttggcgatgaagatgagcagacattcaggcagttttccagtggtggctttcacttcttaatttaaggcacattgtaagcatgattttctttttcgttttcttttcttttcttttctttttttttttttttttgagatggagtctccagcctgtcacccgggctggagtgcagtgccatgatcttggcttactgcaacctctgccttccgggttcaagccattctcctgcctcagcctgggattacaggtgcccgccaccacgcctggctaattttttttttttttgtatttttagtagagacggggtttcactatgttggccaggcttgtctcaaactcctgacctcatgatccgcccacctctgcctcccaaagtgctgggattacaggtgtgagccaccgtgcccggcctgtaagcatgattttctagtctctgtgagaaataattatgttggggatttgtgacttagtttaacatttacaagcatcttcacagtatctccattgtgcctggtgatgatgatatcagactgataggagctataaacaaggaaatagactgagagaggcgggcttggggaatgatcccgagatgctgggaggagagaaggcttgaatgcaggtgtctaaggttgagttcatggctccttctactatagtaaacatctctgcacataatcgtttctgtgtgcatgtggaacttctccatttacaaggtgcttttaagtcataaaacgttggctcttaccatgcaggggtgggcggtgtggctaggtggatgcgggtgcttttcgccatccctgggcctttctccttccccttttccttcactcctccctccctccctgactcaggatatctatctgattctctctagcaatggatcgtgggcaatggacacgcaactgatctctggcagaactgtagcacctcttcctcaggaaatgtccaccactgtttctcatcatcaccaaacggtgaggctggttttgtgctccatgagcttgtcctcagacgcctgtaacacgtttctcagcccagagctggaaacgcttattggaagacacaagccagaatgtcgttgctggggtggggtgggatgtgacagggagccatgagtccagggaaaatgggaggggtggtgatctcgctggggaagctgagatcctgggcatcattgtgattcactctacctagagacatgcccttagtgccctcctgatcacttaggataatgctttttgtgattgaaaaaaatatcgacctgggagctgtgaaggtggtatgatagctaagcctttggcagacccccttgggacattggatcaaacgtgtatctttggtttggtggctgtctctattcagaaatgtcctgcccctttctgctgcagtgacagtggggctagctcactgcaccgtcagttacatggacacaagactggctgcctttccaggtcttgggcctcagtgatgccacctagcatcaaaacctttgaatgtttccttgttgcaagatggggacttgaagctatttgcaaaaccctaagctaagccttggggtccttaatccagaagatcgtatttctcctctgtcctcagcatctttgcttgtgagatatggaagccaggcttcatgagggtcaaattaagggataattggcagcagaagcaccaactaggtacccaaggcacccagagggaaaggaacacccagccaggagccctgtgtgtttggatgcagacaggtggaggtaaacaggatgagctgttttggtggctgggtaggccatagcgattgatgttaagagcccgtggacctggatccacatgatcttttgttccagaagatgtgtcctcaggctggaaggacctagagatacagcagagctttcctaacatcctgggtttaaaaggccacggaaatacagctttaaatgttgctggagctactcatagatccagtatatatgttcaagatgctacaccagacgagagaaaccagtttagatccagttcagtaaaacaggcagtgaagtggcctttggtcctggctttgcataatccagttgctttgctggactttccctcttacagctcagtacccagtaatacccaagcatgtccccagctgaagcattataaaccaaattccttgaaccacagtacaaatagaaactgctaaaataataatttggtaatttacatggagaagatacgcaaggagtagaaaaccctgctttatgtttttaccttctgggttggggagggagcagagaaaaggtcccagtcctattggagtgagaacagtgcttaatcttgtctctgagtgtgtgaaaggcattgaattaaagccatcccagaaattacgtggtgggtttgcatggtgagttggcaactgagtaaatgaaatactcatgagtgcctgagaatgtgaccgtagcactgcttgtccccaaagccacagcatccggtttctccccctttagggtctggctgaagttcccggagcactccggatgggagtctccgtactcgctactgacacctggtggttacaagtagtgactcagcccgaaaagggcaggctttggtgctcacaggcgccatccccaagtggcatctggccacgcggcttggcacagaatcctggactcttgggcccggaagggggcagttttggcaggcgtgttaaaacccggcgaagtttcagcagaaacgaggcggcagaggagttgctaagttgtgcttaaaccatctgcaggaaagaaagcaatattgacctgtagcatgttacagattgacatttggtgtcttctgccgttggaaatagctgtcagttggtgctagaagcagatctcaaagaggcactagggttattttaatcaggaaacttcttatctctcaacttgttccttctgtgccaagctcatgttcttgagttcatttacaatgcctccttagtgtgggtttcaaatctgcctcgttgctttccgtgaggaccccagagtgtctgttttccacatctcccttctcagctctcacaatcagggcattttgaaaacatctggacactgcacctgaacatgctgggtttgttttcacgccactcaggcttaatctaaatttgaaatttccatttacacttccccagtagtggttatctctgccgctatcttccccaacgtggcagcacttgctacgacttcagccttaagtggcgaatcctccagggcctctttgattgagtttaacaattgtggctgcagacaataagctgaaaaaaatgtgtactttttaaaacattatactgtctttacaaatgaactatgctcattgcgaaccatttaacttgtctgtatttgctcttagaaagtatatttgaaaaaaaatacttgttaagtaatcaaaagtaatttgttattgacatcgatttgtgaagaatatgttgcaagtgtgaaaaaataaatagtggtgcaatctcggctgactacaacctccacctcctgggttcaagcgattttcctgcctcagcctcccgagtagctgggattataggcgcccaacaccacgcctggctaatttttgtatttttagtagagaggggtttcatcatgttgggcaggctggtctcgaactcctgacctcaggagatccacccacctcacctcccaaagtgctgggattagaggtgtgagccactgcgccatgtgacttggtatttttttctgaaaggactcatttttctggtgcatgaccatgacacttcacctctctctgggggttgccactcatgttgttttctacatgaatggggcctcctggcatcgtgccatgaggcagtctaacatctaggttgtgtagtttgaaagagacacaccagatcttgcccccaggctacatcttaatattagaaatagttttagatttttaactaactgactttgactccgcctgccttctcgtttttctaaatgtgtttgtatactttctggcaccccctccttatctgcctcgtgtgggcagaggtaagagaggcttagtgtggggatattcgttatgatattgtatccagtgcctctccggcccagggaatacaaggatctggaatgcatgggccttgccttgatggtcccgagcctggtcgaagagtcaggagatagatatggaagggtgaatcactcccttggaaggcagagcaggccaggtgcccaaagggaggcaggcagacagcgtctgagttcagggaggaagcggatgggaaatctctggtgggaggtagaatctgatccatcctccaaaggatgggcaggatttaagtcaatacaggcaacggggaggagaatattccctgtgacctaaggtaagggtagaacaaggcaggggatggggtagactggttggctagtgttctggttaggattaggattgattgtgtataagagaacatcttcaaatgataggggcttaagtaagatcatttatttttctctcttttcaaagaagtctggaagtaggtagcctgagagaggtatggaggttccatgaaattgtcagagatgcagacactttctagctcatttctttgccatctcttgggtttggctgtcatcttcaggaaacaaaaggctgctagagctccagccatctcatccatgattcaagcagtagggtggagaaaggaggtggggaagaatgaatctccttttcttttaatgaaatgtgacatggtcacacctacacctatttacaagagaggctgagaaatatagtcattcggccttgggggaagcatggcttttcaaatcatagaaacctggcagcaaatacctctctgtaagcctggtgtggaatactttccttgagggtttgaccatcccctcccatacccaatcatactcttttgcaatagctcagttgggccctatgcagttccataagtcccagttatttcagcattcttcaaagagtccatctctgctgcatcctgggctctgtcagccaccccaccattctcacatgggctcttctcagaaactttaggacctgttgaggcttctctctctctatttctaccacctctccaggtataagtaagtcttattattattattgagacagagtttcactcttgttgcccaggctggagttcagtggcgccatcttggctcactgcaacctccgcttcccgggttcaagcaattctcctgcctcagcctcccgggtagctgggattacaggcatgcgccaccacgcttggctaattttttgtatttttagtagagacgggctttctccatgttggtcaggctggtctcgaactcccgacctcaggtgatccacctgcctcagcctcccaaagtgctgagattacaagcgtgagccaccatgcctggccatcttattattatttaatgagtccagacctctcttctgaatcccagacctgtttatccagctgtctcctggccacttcccttgggatatctaagagaggcccccaagtcactaggccagagacagtccttatcttcctctgccaattcaacccctctgtcactttctagtattttagtgaatgctgcttcaccagccagcaagccaaacatctagagtctgccttgacttgacgcgtttccttctttctcttctcagcattgtcacgggtccctcaggccaccccattgttccaatgcctgttgcccacctgtggtcacgctgcttcctcgtttgtcagaggcgccagggcagcctcctaactagtttgcctgaaccctttcttgctcctctgtgactcatttttcatatggaatccaggctgatatttaaaaaagcacaaacctaattatatcactcctcattttgaaacctttcagaggccgttcattggtcttaatcttcagatgaaaatctttaacaaggcccatcggaatctacctgaatgatccactcctgcttctgttaagtctcacctcccatctctcttcccctcatcttggaatttcagcgttttctcacgtcctgaaatgtgaacttcccacttcgggagtctctccatttctcttctgatctttcatgcaggactatttcttgaacaactctcgtgtaccagagactattgcaggtgctaaggttacaagagtgaacaagagcttatgttttactggacaaaccagtcagtaaacatggagaatttgggggcaatggtaagaactatataagacagggtaatgggataaagagggattgcagtggtgaaggaaggtctccttgaggagtggccaggagccagccatatgaacatctcggggaggttccatacagaaggaccgtcaagtgcaagatcgctggggagggaaggagcttggcgtagttgagggacagagggcagggcagactagtgggaacagagagtgaggggtaagtagaatcacagaccatctcaaaggtaccccccacccccactaggaaggagttgggtgcacatggatgcatttctaatctttgtgatttccttagacctgctgtcttccacgggtttctcagtggtccatttgattccaagttggagtgacagtccagaagcctctataaggcagaatatatcagaaattgtacaaggtagaaatgcatcggtatattttcagtgattattttgggtgacgggattcttatcactttggctgttttctttcttttgctgccttacctgttttcctcattgagatcttttattttcacaatcagaaaataactgtgaacattttatgttagaaaattggttttgagtagtaagtaggttccctctgccttgattaagagagtggagccctggggcatggcacgcagggtccatggcgtcgctttgaatgaggccagttcctggagctttagtttgcaaactcatacaatctggaaggctctggtgagggggaggggtgtgccaagcctcctccccaagaccctatgggtgagtttaaaatctactgacccaaaggattcaggcaaaacatttgccctgctattgaatgaaccagtgctttttgttttgaagtctccaagatccaaatatcaagtccaagttctcacaagcattcccctgctttttgtttaatttgtgtggacctgacgtgtagcagaatgggtcagaatactggaattaagccacaggcggcttgggagcccaagagctagaagggcacagtcctggcttgccctggcccctggctggtcttcatcagcttcagtgatgaggcaggacccaggcagtttgtcttcagtaaaatctgtctctcagggcctgtccctgctcacaaagtcctctcttgtctcagaagaaaaggtagttgataaactttttcatgctgaggtgttaggcacaaaaaatgtgcccctttttgaatcacttttgtttttaaaaaggaggccagtgctcaacaccaaagcatgaagggaattgttgagctttcctgtaatctgtccccaaacgtccttggccacctccattgtctaagggcagtacctgcagcccctcatttcccagtgacaacaggtgggtctgctctgccacagtgtgtgggcgggaccagcaccagacgctgagaagatgaccacttactactcttcttttccatttaaacagcagcagcagcagcagcagcagcagcagcagcagcaacagcaaactcatgactatcaataggttgtgtgaggaattagatcaatgctttgggttgaaaattagagaaactaaatcttgccagtctcagcagcccccaacctgagcccttggtggtctcctatcatcgctgtcttcaaaacgatcccagacttgtttatcaatttggtgacactgtcattttggcaaggacaccagacaatttccttgtctgtggctcagcttttggccagattttagaaaacacgggagaccttctgcatttatgggttcatgttttacattttaaaatcttcgtggctccctcagccaacccataatctctacccaaggaatggctctggattttacaggctcttatgagatgctgagaccctggtggtacaagggaggtacagaggacggaatgtgttgtcaacatgccaggatttcaacccttagggtttctctgatgccaatacccaggaattagtatgaaatgtttgtttgaacctgtgtctgaactgtatgacctggaatctatagtctttgctttaaaaaaacttcaattgtatccccaagatttcaccagcaccaagaaaacatcccttgcatttcaggagcagggactggccatggtgcagcctgaggttgtggatgttgatctttggtgcccgagagaaggctgtctgggatgaagccttctgactgtggtcaggtccctgccagtgctgggggccacatgagtgtgcagtcatccacacacaagtggcccccaacactggcagggacccggagtcatctggcccatccctccttcctatcccatcgagccacagacccctctgcaatatgcctaccacatgttcatcctaccactgatggggaacttattaccttcaagagagcctcttttgtttttgaagagctaatagtgagatccattcatgtgttcttcaactctattgagcctgtcctatgtactgggcactgttctagaaatggggtgcacagagatgaacaagaaagagcaggtccctgccattgtgcagctcacaaggagttggaggaaacaggcaatacacaatacatgcatcactatgggtagtggaacatgctctgcaggaaacaaatagggtgatccaatggaaagtcatcactggaggaatgagctgctcagggaaggcctcttccttccatagtgatgtggtctgagatttagaagacagggaaggaccagttataggaagaaccatgggaagaaaattctaggaggtaaagggaagaaccaaggccctgagttagctgaagaaaggagggtggggaatgcgggagagagggatgggagcaggatcgctggtgcctcacaggctgtggtactgagaaggacagttgggacatcattgaagggttttaagcagaagagtgtcatgatttgattcatgttttgtaagctcattctggctgttgagaatgaattctggggagaggcaagagtggaaactggggaccagtgaggagtttgtggtcatagtccagactggacatgatgatgacactgagatgacaatgatgacaatgacaatgatgttaagaatacaaacagctcacgtaagtgccaggcattctttgaaaagcaatgcatttaatcctcacaagaactctaggaggtagctggtggcttagctagggaggggaagtagagaagaaaacaggtctcatgacagggtttgctgatgggttagatgtagggagttagggaagaatgattctagatgactctacgttttgggcttgagcaactggtgtgtaactgaatcttggactgagatggggagactggaggaggaacagaagatttgcgggaaggtgtagaaatcaggatttatattttgaccatcagagaggtcagcaaatcacttcaatttagaagtctttggcttaggggagaggtctgggctggaaattcaaagtcaagagtcattcctctataccgaagggtattcaatgttgtggtgctgaatacagttacttggggaggagttgagagcagaaggcagaaaaggggaacagggttcagagctaagtcttgggcatgccaggggttaacgagggtacaggaaggagaggagactggggatgaacagccagtgatgagggaggaatgccaggagatattgtcacttaagaaattacctcggctgggcgcggtggctcacgcctataatcccagcactttgggaggctgaggcgggcggattacaaggtcaggagattgagaccatcctggctaacacggtgaaaccctgtctctactaaaaatacaaaacaaaattagccgggcgtggtggccggtgcctgtagtcccagctactcgggaggctgaggcaggagaatggcgtgaacccgggaggcggagcttgcagtgagccgagatcgcaccactgcacgccagcctgagcgacagagtgagactccgtctcaaaaaaagaaattaccttgttaaacccaacactgcccctcttttgtccattcacttctagttgccttcattcatgcctgatgtgctggacttgggttttatcaagttgcttggcacgtccttaaagaatttaaatctccacagtgcctcctggacaatgactgcagggtgacccccgtctctcctctacacgatgactcttcaaacagttgacgattgcagtttttctttccttccttctttcagtggcttctctggtgctggtcccagctgcataagcagggcctcttcttgcccttctgaagtttggtcagtggtttggcttggcaggctgatgagcagagaataagggaagccgctctctctttgccacaccattctccttccaccctctctagtttttgtggattctaagtctgaagaatggtggtagaataatttaattcattagattgcaagcatatcattgacttctctgcacccccagtgtgttgtagtggaaaaactagtagtctgggcatcagggaatccttgtttttctgcaccgggtctgcctgtaacaaattaggtaacctggggcaggtaccctggtttcctaaaagcagagcaggcattgaggtaggacctgaagttgaggtaggacctgcacattgcatgggtcccggagcctctgttcatgttcaggatgtaattgtggcatcgagggatcctaaaaggaggtggcctctgagctgggccttggcaatggggtagaattgcagtaggcagagggagcagagatgggttttgtgcttgtaaacgggcattggtttactgtcactggtgggggtagcagctcttttgttctagctcttcatttccataatgcgtgttcttttttcatactttaggggaaagaaggaggagaactctattatttctatggggagaattcctcctaaacctgaagatcttaaaactaagcgaattattccctgttcattctccactgatgcagttcatgactgcaattgcaactgcctttcccgtcattttctatggccaaactcagtgtttttaagtgagctcttcttttaaaaaacaaaaacaaaaacaagtctcctgataaatccgtttgaaagacactaagttttgaaagttaagcaggctttgatcattcatggtacattgtgaattaccaaggagggagattgatatccttcatcgtacaatgcactcccctcctttttcttttgtatctggtggagtaagtcttccaagagcaattcttagagaaacaaagcctactctgtttccctgtttctagagttttccaacaagggtataaaaaagcctcagacagcttactattatccagtaacctcaggtacctcagtggctgcgtgttattccctttagaagtccaaaaactcactagcagagcaagaatatggatgtcaaagtgcagaactagaccctgacaaactagctctgtgcctgccacaaagcctcttaattaggaatgcagttcattgaataactgtatcaaagttagctggaataccttgacatgaagattccttccacttactgagcagtttgtgcccactagtggccagacacaggctttgctctagctaaaatacccccaggattacctgttgagagagccgcccacgtcaccttcatcgcctttgtgagctccatgctggcacatagttgtctccatctgttttgctttccgcatgaatcataggcaaagttagcctgaccagcaagcccatttcaaagccaccagctgggggagaagttgaagcccagggggcaagacccacgctgggctttgggcatgtttgagctggtgggcgaagcatatgggcaaaggccacattgtttaggatggaggcctttcagagactcagctatttctggaatgacattcatactgagaaataaggaaaatggcgatctgtgtgatggttgtgggttgggaggtttgggcgtgggagtcctggtcttggggtcatgtgttttgaaaacagtctagcactatgcaaatgggaggtgttaataactctttgcctctgtgatttaccctctcatggctttttctctcttggcctctccaaggtctcttctgactcttgcaactgtccttcctttcactttcaacaaaacctgttctcttgagtcagaacagttttatgaattgcccagagtgggacttgatatggggcagggttggttccatgctggtaatgaaagatgcacataaactgttacattgaaaagtgcttcatactttctgagcccttaactcactaggttgtaggccctgggctaagaatatagctgagggggctgatgtatttccttcattgctcagctgctcctacagcaggaatctgaccttgaaatgagctttgatctttgtgcaactcgagcttcccactatctgctgggggagctaggtctgggtgctgccacggcccatgtcagaaagctgtcagcagctcttataccggacactctcagaacaggaggcctgcaaagagctttagctttagttttgttgttgttgttgtttttgagacagtctcgctctgtcgcccaggctggagtgcagtggcgccatctcggctcactgcaagctccacctcccgggttcacaccattctcctgcctcagcctcccaagtagttgggactacaggtgcccgccaccacgcccagctaattttttgtatttttagtagagacgaggtttcaccgtgttagccaggatggtctcaatctcctgacctcgtgatccacccgccttggcctcccaaagtgctgggattacaggtgtgagccacggcgcccggccttttttttttttttttttttgagacgagtcttgctctgtttccaggctggagtgcagtggtgtgatctcggctcactgcagtctccgccttccgggttcaagtgattctcctgctccagcctcccaaatagctgggattacaggcacatgccaccacacccagctaatttttgtatttttagtagagacggggtttcaccatgttggccagtatgatctcgatctcctgaccttgtgatccacccgctttggcctcccaaagtgctgggattacaggcatgagccaccacgcccggccagagctttagtttttaattccagtgctcagcaccaaggttggatattggcttaaaacttccactggaaactccacaaatgtttagcaggcctccactttgcaccaggaactgagtgtggcctggaggacagcaggtactcaacataagttctactatttattgcatacttgcaaattgggtggggcgtggggaagagtatcgccacactggggcttgtgttaatctatagtttagccacttgggatgttggtgtcacactaggtttgatctaaatagaacaggtttgtaattgacagcattttcacttgcattatatttctctgaactcgaatcattattttctgtacagctgacttgttttgctgtagcagagtttggcagataatagcttgcatgtcgaatccaacctgcttttgtaaataagattttattggataaatggctattgaaggaatgggtcacacccactcatttacatcttgtccatggctatggctgattttgtgatacaaaggcagaattgagtagttgttaagaagaccgtatgacctgcaaagcctaaagtatttgctctctgattctttatagatagtttgctatctgtgcagatatttgcactctgactctgtagcacccttatgctggagaggagatatgaattgataccaaagttgtatcaaaacacttttggagttctggccaatgtgctaataacctggcttgtgtgaacattgtggctctcattttcttttttcttttttttttttttgagacgagtcttgctctgtcgcccaggctggagtgcagtggcgcagtggcgcgatctcggctcactgcaagctccgcctccagggttcacgccattctcctgcctcagcctccagagtagctgggactacaggcgcccgccaccacgcccggctaatttttttttttttgtatttttagtagagacgggttttcactgtgttagccagcatggtctcgatctcctgacctcgtgatctgccctcctgggcctcccaagtgctgggattacaggcgtgacccactgcgcccggcctgtggctcccattttcatactgcttggtgtgacccagatggaaatgctccagaacctggcccctcaataacagcctgtaaatgcttgtttaccctgttttctcacatcagccttttaggtggggttatttgcactatcctttaacagcgcttcaataacaactcttttgtttgatcattatgacaacccaataaaatatattagtgcctcaagtacgtaaagcagaattcaaggccaaaaaaatgtatgtggcaagttaggtgggcggtcagaagaacttggcaacagagcccagccctgcctgggctgtcctaaccagagcacataaatgctggagagagtcaggctttgcacgtgctcacacgggacccttaccttggacaggatcaaagccctgtcatttctggagtgtgtgatatctgctgtctcttactgcgctggttgttacctgtctattccagttctgatgaatggctctgattggggagcagcatcatctgagcttagaaatgtcctcagggccctgtggggttccctttgagcaacaacgagagctcttgaatcttgcaccagccttttggagctggaatggagtttgctttctcctgggctgggctctgttttttttcctctcgctgtccttgtgtagcttttgatcaatggcactggaggaaaggaaaatcccttgttgttttcctgggcatgtggaagcccagtcctgcccagaattccactagccctttgagttttggaatcctgactcttagtaagtcaatagagtgctgcatctgtttttacctttgtaatcttttaaattggttttaattatttaagtaatacaagtattataatacatgaaaatatcctcaactgaaaggcttcttgaccaaactcttcttcgttgcaacagtagttcctgggggaacccactgacatcaatttgacacaactttggctctttctctacgaatatttgcatgcctgtggatgtctatacgcaattacatagttttttggtgtttgttttcataatgatgacatgttgtgtgtgcaccttactcttttcattgtcttggagacctttcaaagactcttcattttctaactcatgatttttttaactgctgcaaaatatttcattgtgaggatataccataatttattttccctcatagaaatgctacaatcaatgtccttatttattttcctctgagtatatgttcactgtttttccaggatatagtagataagcacttgaacacatatagtgtcattacgctagaggtgttacaatttttaaactacttttaatggcaaaaattacaattacttttgtatcaacctaatatattctgccacaaaatggctggtcacaaaaggattataataataatattattattattcctgtgaatggtgtctgcaggtagctatcacttatttgttctgctgatattatccattttttttgaattttgcctattggctggatgaaaattggtgtcaccctcctcatgggtttctcttgcatttccttggttgctagtgaggttgggcaccttttacgatgtttattggctgttcatatttctcctttgctaatcacatggcttttcaattttatacttagctgttttctctttgttctgtctgtaatttaattttgttaatgatgcgaactagagatttaattttatgttttaccaaatgaatagccaacactatgtattgtctgttgtatttttccccactggtttatatgatgttgtgtattatctaccaaatttacatgtatgcttccaaagtcttattccatcccattcttttatttttctttcatgattaacaccatatttttgaattgctaaaactttataatataaatataagctttgtatgtctataaataaaatacattttattaattataattatatgttatataattataatataagcacttgaacatatatacttctataattatatattatataattatatatcatacttctatgatatgttctataattatatattgtatatatcatagttctatgatatgttctataattatatattataaagttacaattaattgtatatttaatttataccatatactgtaataagcaaaatatagaaatatgttttaaatctggtaggtggtatcttgactcattggttttatatgtttttctgattttctttttgttcatttgttcgttttggtttttagttgctgttgtgtttacttcaaattttttcttatctgtcattgctcattgttttttagatgaatttttaattgatttttttccagttccagttgcaatatggattaggacagcattgaatttgtagattattttggatgaaattggcatctttataactttgagtgtttctatccaggaacttagtatgtttctttagtacttcttttatgtacttgaataaaatttgtctaacttgttgatgtatccccaaagaaccagacatttttattaaatgtattttaatatttttttctgtctcattagtctgtgcttttatccatattaagtcaattaatttttggacttatttcattgttttttttctggcttcttgagttgaaagtgtagttcactctttttaaggatttttctagcaaatgcttagaagtgtatacattgtcctctgagaactgctttggttacaacccacaggtgtgccatgtggctctctatataattccttgctgaagaagtttttacttttcatcttgttttttttaatccgaggaattatctggaacactgtttttaaatttccaaatttattttggctagtttgtttttaatgtctaatttctgtttgcctttaggtatatgttgagcctacatcatttctgcttctatatttattgagatattctttgttgcccttatagtcagtttgaaaagctgtcccatgtgtgtttgaaaataactttgctatatagacacaagttttctatacatctattaggacagatttgttaatcctcttatgtaatctatattctttcttctttttggtctacctgacatctattttgaggaaggaagctaaagtcttctactgttattgtgattttaacaatttcttctcatattttgattactttttgattttaactttttcaggccatgttattatatgcataatgatttattttcttcagtcatagatcatgtaaaccagaagtaaagatcaaataaaccaaatctttcctctatgaaacaaccaaacaactctctggccacttttatcctttcaacataagttctattttttattattaatttatcttctttcttttttgttaacatttgcctgaagcttcttttcagaatcttttttgtttttgactgttgcttgttttaggtgtatctattatattagaatatagctacaatgtctctcttttttttttttttttttttttttgagacagagtctctctctgtgcccaggctggagtgcagtggtgtgatcttggctcactacaacctccacctcctgagttcaagcgattctctgcctcaacctcccaagtagctgggactataggtgtccaccagcacacctggccaatttttttgtatttttcgtagagatggggttttggcatgttggccaggctggtcttgaactcctggcctcaagtgatctacctgcctcagcctcccaaaatgtcttaatcaaagataaaattccatatcttatgagtgccttgaacccattcacatataatgtggttgatgatagacttactatcttaatgcatgtgttttatttattgtgcttatggttgaaaaccatcttcttcatctctggatcatcagagtcaaccagagggcttggctcaaagcagtaggtattcaacaaatgctcattgaataaaaatgtccttgatcctctaattctgatttgattcgagaaataacttatggcaaagagctcaattgtaatggggttgggactaaaattcaagttaatgttgaaagatgtttcaagaagtatttaggttatattattaaatattagacactttctgtttatatagatttaacatataaagattttaagttttctgtgtatgtgaggtctcgtagtagtttctgctgaaaatgacaggggcgcggggttaagggtgaagacagtatctcaggattggagaaggaaatctaagatattgtctccaccagccatactcctcatgaacatgcacatggaaggacatttcccagccaaagtgaatccctttatttgttttagtttcagatttgagtctcagatttctttgtaattccagctgcatctaccaaagtgctagataatttttttattttaagcaaacaatattatgagaacattatctttattgcaaagtgctcctccagaagaacctctatgctggataaagacaaacatttgattaaggttatgtaagagtgaaatcaggatggctcacaacccattagccgtcattttcttactttaattgacaaagaaattgaaaaaatgaaagaagcatatgttgtgcttgaatgtgaagagtgctagactagaatcaaaggcctcttagatttggctgtgtcatttgggctcatgaaaacacctctggaaatctctttcagtgcaaaggagctggactagttgatctctcaggtttcttccaactctaaaatatctccagtctgtgccttggaaacatcttaggtgaaaatctaggaacagttaacctaatttgcacccttaaaattctgccatgagctgcttacaactcaaaacaagtttatcttactcagttactaattataaaccatccagatttcagagctgtgagtactgggtgaagcattgaaggtatgcttttgaagccattacatatggcagttactgagctgaaaggattaaatgctgcagcttccccagttgcccttcctccatgagagcagtgcctgcccccagcattctgtggcacttggaagacaagacagaggccaaatgcagatttttaccctgggcttccctctacagtgtggaactcaggttgtttcttctttcctccctgaaatgacatgagtttgcagcggatggtgaactgaagaaaccataggaggctctgtcttcttgcctgaatttcagttggaagcttggagatttggggttcaacagagataaggaagtgtaagccttcatcccgtctggtggttggcgatcacacaccgctctgtgctgaggctaatggccatgatcagagttgaccaaaaaaaaaaaaaaaaaaaaatacgggttgtccaagcaaattgatttccatacctatagagagcatacctttcttcatcagtattttcttccattcttccaaaaaattactttgggctctaacagccattcccgtgatctttacctctccttggggaatgcagataatttgaatagtggttttaagctatttttcttggaatacagaagttctgataagcccttcaaagacccctgagggcaagaagagggaaggtagtaggcagggctcaggccctctttaacacagacacatgtacataagtaacacatttgcaccaacactggaaggaaattcaatatattttaaaatgactttaactcctagtgatggaactatagatatttttttacagcccttccctgaatgttcacatgtgttttttatatatatgtgtgtgtcacgtatttgtatatgtgtatatacacatatatatagaaacacgtacatatttgtatgcatatttgtacatataggtatatatgtatgtaatgtgtacatattggcacatgtgtgtgtttgtatatgtatatatcagtacatatagatgtatgtatatatgtatatattttttcctccaaaataaacaataaagaatgtcttcttagattgcaaaagtgaattgtctgagttctgctaaggaaaaaggacttctgcttctgctgcctgtgaggactgtgctgtcagcagtcatggcccttcaggccctgcacctcgaggcagagccctcccccggccatggccagctctcctaaccaagtgtctctttcccccagaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtaagttgtggatggtaaagtccatgtggaagcggggtgcatccaagtctgcggaatgattagtttagtagaaggatgtggcctcagaatgactgatgttcatgagtctccccactggatgctttccataaagtgagggtgggtgcttgtatgtgtgggtgtgtacctgtatgtgtcttagaacttgggacttagaactctccccttctccctggaatgagatgcatatgaaagagaacttagaggatctggaaggaaggtccccacccaagccaggcgtatcaacaggaatgaaactgcaatctggacacataatcagaggtgaatactgaggctatctgtagagcaaaggtcaggcttgagagctgtttctgtagattacattatgcctccagaaaatggccctgatgtgctaagaactagcaaagtagttatcaggtatgtgtcttccaccaataggtagtgatgaagccacactgacaaattctcaccttccttgcttccagttcctagattctactgggctttgattgactgttgtcatcctctggtgtcttcattttgacactcttgtgtcacatattgtcatttccaaacatggggctatgacaacacatgaaaacacatgagaggtctccttaatctcctgcctaaactgtcttcaagttccctctttaaatacgttattaatatgcatagtgtgcagagtcctagaaacttctgttacacagggtgacatcttccaactttgtctctggattctgcctagcatcttacatgcttacatcttacatcttacatcttacatcttgcattctgcctagcatcttacattagctcttacatgtctgtctgttgacttactgttgactgaaccagcagggcattggagagaagtaagagctagatgtagtggtggattctgtggtccaaattcatagatcacaaacttcatatgtaccagagtatgtctaggtactgggagatgttctcaattctgaccctctgagagggcaaaggatgtagcatctcttctctgagttggttgtcagaatgcccatggtaccatttcaccactctgtccccaggagcagtcattggaaggttgacgtaaatagggttgtatgggaagacacagcccaaggttagatgttggtgaccttgtctagaagacagagagttcccctttcctgaaaaaaggaagtaaatgattaaccacttctcattaaacactcaaatacaacatttcaatactcatggttttgagatttcaaaaccagacagtgctttgctacttacacatgtcttatgacaccaagccaagctcctggatggttgctggctctgttaaatgactaattatgcaaggagatatcatttctaggtacgttaaagtgaagagttacccttactcaattttcagttggaataaaaacaactgtaacatattctggggtttctttttttttttctcactcgttttagtttgatatcaaatcaaataatgatcatatccattgcatcagtggatatgccctcaagataatatggatttagaaccagaactttcataatgtatttctattgaaatgttagtttcataagcgatgattgggttttcatgcccatgtgtgagatgtgcctcgctcaaaccttgttatgatttggcacgttacccatctgatgtgaaaaaaattacattttatttgtacaggctcgttattttactgatgaataatttgagcccaccagaggataaatgaatgaccaaggtcacccagctcatgacagggacggttgagtgttacactgaatatagtgaggtacttcttatattttaaagacagaatgcaccaaaaaatttaaagaacacaaaatccaaggcagaagctctgccttttatattatcttttattggaactgatttacaatggaaggtaaatgcaaatttgcaccatgtattattctgaagttccaaacatctgtgatgaatacaagcctgtactataagacccagtcacattgaaaatatggagctgagaagaggtaagctgctgttgaatgggctccttgggatagccagtaccttcatcttcattcatcctgctgagctgtttcggctttaagttctttaacaatgtctttttagcaacatcattacatcattttaggccaaaactcaaagtccagagataagaacccttaagtcactcatgtaactgcactgtgtgttaaaagtatttcagttcagccaaacactcttctcctaggtattgcgatttaagtatatttactaatccactcttgcttcactattttcattctcctccaaagtcaatacaagatgtttagaactgtgctggaagtgcagaattccgaatgtaaaagcgcatgactttgtcctctttatcccctttacatctagctgcttacgtctcatgaaactgaattttcagttatctgttggtccacatttgaataagaaattatcttgaatttgaaatgctgagctgtaatagcagttgtaatttgtaagtcctgagagtgtcctgtcctccgttgttaatcccagtcaagatcatctgagagttggtctccagggaacctcagatctctaggatgttgcactggaaatggctgcaggatctttccactaattctgagaactgaaagagttaggaactctatttggagagttcctggttcccttatcgtgtgacagttctaagtcaattttgtcatgtggttttctgactcacagactagtaagaagttagtaattagagagctaagtagattagggttgttggagatgagaaacccacgttttgggaaaacctggcaagtgacaacttaacatcaaggaagtagtcagaaaagctaaaactgacaaacagaaggtagaagaaagtagctccacactcatgggatgtgaaatctacaagcgtgcatgcccggcaaatgcctctccaatgcactggagcgttttaagtggaaaccactagaatctctgtgtagtctccggaagtggctgtgagggctgcattatctctgcacagcttcctcttggtgggcccagctgtgatctttatggatggcacacatcagctttcaggaaaagcacatgaaaggtgctagggctcttggagctgactgtaggtttgggagttgtctgtctccttgctctagattacagctctgtgtgttgtgtggggtctccatggtttgccaaattatctcttcctcacttagccacaaggctgacagttaggaactatctcttcttgattgcattaggttggctgcttcctgaatgcatatcaaaaggctccttcctttagttcagtgctttcaacctgagctgtgcatcagaatcacctgaggtcctttaaaaaaaaaaaaaagacagtgggcggggcgcagtggctcacgcctgtaatcccagcactttgggaggctgaggtgggcagatcacttgaggtcaggagttcaagaccagcccggccaacatggtgaaaccctgtctctactaaaaataaaaataaaaaaatagccaggcgtggtggtgcgtgcctgtagtcccagctacttgggaaactgaggcagagaagaatcacttgaacctaggaggtggaggttgcagtgagccaagatcatgccactgcactccagcctgggggtgacagagtaagactgtctcaaaaaaaaagaaaaaagaaaagaaaaaagacagtattcaggtctcatccctggagactctcatttaatagttgtgggatggatccactgcctaggtgactctgatgtgcatttagggttgggaaccactgacatagccattaaactgtccctaatcccactgtaaggttttctaggatattttcccagaaataactaaaccaccttcttagagaaggaacatcctgatcctgcgtctggactttggagtcattcttattttcagaacctatagccatctattccttgacaagatctgttgggttgggttgcactagactggaaaacatcaagaaattaatctagacacagacctaaaaggaagatttgcacgttttgatttattttactgcttacacccagcatcaagctccatgtggggcacatagaggagcctgaataaaactattattggttggatgattagataattgtgtttcctcggcagaatcaaactcaagtcaaatgtgtggttaccgggattaagaacagaaagaatagaggggactcctgagtgagtttcactttctctctctttttgttattgttgttcatttgttttgttaatagaaagatcaatatagctatagagcatttaaaataaaaggatttgggccaggtgtggtggcgaatgcctgtaatcccaacactttgaaagactgaggtgagaggattgcttaaagccaggagttcaagaccagcctgggcaacaaagcgagatgccatctctacaaaaaatgatttaaaaattagtggggtgccttggagcacgcctgtggtcccagctattcaggaggctgaggcaggaggattgcttgaggctgagaggtcaagactacagtgaactatgatcaggcccctgcacttgctccagcctggtgacagagtgagaccctgcctctctaggaaaaaaaaaaaaagaatttggtggggggggattaataaaagttcagtgccatcctgttcagagtgattcaaaggtggcttaagtcaaataccacatttagaaatttttgttagggacggatgattatggatgtctcactggccatgcccaaatcagagtcaatgctatgggtggctttctaggcagcaatggtcatttggatactgaaaatgtaaaaggagtgggcttcaatcacagaaacacagagaagtctcttgctttcagaggaacaggcctcacagccccttcctgccctcccttgttgccctgaggatgaagtgggagggagaaaaaggcacccactcatcaacccaacatcatagctgcaccttccagtgaccaccctggtggtctcactgacatccctttccagccaacttctctctgacttctgccccaggctctcaaatgaaagtgcttttgcgaggttaccaaagtacactttgaagtctttaatttgttggatcactctgctcctttcaatactgttagctacttactctttgaagctctattcccctggcttctgagacatcgctgtgttcccacttgcctgagtgaacacaccaggcggtcatgctggcctctcctctctccctcaccccacagccagccttctactgaatcctgcatttgggtagcatcctccgtaggcattacgcccatttctttgtcttgactcactaaccccagtgcagctatgcaaaggcctcctcatgcaccttccagctacctgccttgtccctgcccctgaatccattttctgcaccatggccagagtgatcattctaaaacgtgcgtctgatcatgtttctcctctgctgaagtttcctcagaggcttctcatcacagcttccttaacatgtcatgtaaggccctctctttcctgacccttagtgagctaatcagcctattatatgagagtccgtgtggcttctccagttctccagtttggactcagcgcccgtctatgctcttggggcatctggtgcatttccttccctctctcgaaattccatcgaactatattgaaattatatgcaaatgtctgtcttctagacacacagtccttaaggtaggagccatgtctcacttatcttggtacatctagagcagcagctagaacagggcccgcatgcaataggcactcattaaatgttcactgaaccaaagggaatggagatgataaggatgtactgggaattccctcagctacttcctttgaccttggccccttgggtgcttccttccagaggctctgggctctaatcactctcatggggttgcagtcactgttaaaggagcttaagactttctcttcaaaagggctttaggcagaacttgcaggaagttgttgcagacctacccatcctgagacagggagaaactcttgtaagttgaatgctcagcacatttgtattgtctggacagggtcagtgtccttctgcttaaagatgacctatgctcccagactcaggcccctaccagggagtcccggtcattgccaaagagcagaacatctgcctgtgcctcagggcctcacttacccttgccacagggacctggtgatacatctccacctactggttgctgagaaagtgagtcacagtccacttactaggggtatttggcttttggagatgactactggatgacattaactgtcttgggttgcagacagagggaacccagccaaagaatcatccttttctctatttcagggtacatctattgctttacatgcagacaatcttgtaataatatattccctaaaacatcagtctcatgacaacaatcatataaagtgtgtatcctctctttggctttgtagatatctaagtttactgcttatcacggttaagcttagagtcattcacttctgagattctactaagatgaaagtcatacacattaagctgtgtagttagtcgctgcacttctctatactgcctctttctatccctcttgttcaaggatggaatctggtatctcctcttagtcagtgaaatcggggagtagctggtccactcagctcctgaggcatttctcatgccagatctggttagacagcccatttgggagccctgcctgcatgatgataagtgttgtcctgccctgctagcactctgttaacacctttctctctgccaaggtcatgtttccttttttatagccctgccttcattagataagtcagacagagcccaagagacaacttcagtatttcttaaagacaagagttagcactttggagatgcaagccgtggaagagtggggcaagataattaaggatcctggacctcaaggcaaataaagtgtgtccccagcagatcaaaactgctgttttctgcaatcaacaattaacccgcaatgatttcgctcctgacatggccatctttgctgtcttctgaacttcctgtaggtggcaggtcctggatgctgtcccattttggttccaagactattgtgtggctctcttgacaggggccagtcaagtggcagttttctcctctgagttgcaggaggacaggcttaacagggtggttcatgtggcgtattcccacttctgcactgtcttcaaacaaagttgcagtgtccagtaaaacagcagcccaaatagcagtgaggttagatgtaggtggccgggcggtgggggggcgcgggtgcattgggaactctggaactgcatgaatcccacacggcatactggatttataatagagtcactcagagcttctcaaagaccctgttttcagggaggaaacagaccaggctttgtgcagctccaggctggggtgctgacatcactggacccctccttgtggggggacgctgtctgtcacgtgagctggggccatcagtttgagcgtggctgctccacagggcccaagatggaggcttttcttctctttccaacaccgaagggctgcattggtgggccagggagggtggcctgacccacctgcatatccagtgccctttagccttctttgggcttcaaatgcaaccttggggcacccagggaaatggagcttgcctttgatcatcttccccctctgcagcgtggcttcccagtcatactgtcggctgcatccttattcctcactttctttttccctctccacacatttctttgtctgtttggcagtgcccataggcattgcttgcttcacctggtatgtggcaactctgttagggggaccataggcccctgtggtctgcatggagcttaatccttttaccatggcgtgactccaataatggtaaaatgtcacttcacttccattggctttaggtaatgccaccactcacttgtagagtggcatatagatttccaggggtttccatacccaaccacccttggaaagagacaggtaggtttttcttgcagcctgaatgcctgctggccatgtagtgtggcctgggaattggtgacagtgaaagaaagagaaatagggcagaaaatgtaaagaaaaccctcaggtattaaggcctaggtggccaagattggaaatagagagcaagttgttttccttgttcccatatttttgtgctacctcctttcaattctggacctggaagcagatttccttccagaggtagaaatgttcttcctacccagcaattgtcagcatccggggtggcggagagggggccgctctgccatggactctccgtcacccagcttgtccctctccttccccaggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactc

SEQ ID NO: 37380 - DNA, 68769 bp, Homo sapiens
ctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtaaggcccggcgcggtggggcccgggcgggggtccgggagaggagcgggcgccggcctcccctggcccggccccgagagcccagcgctgccgcgcctccggcctccgcgcgtgcggcccccgccgttcccggcctggcggtgggggctgggggaagggaagcggtctgcggagtccgggctgagggcgagggaccggctacatcgcggcgacccaggttccagcggccgcggctctacccggcgcgcgatttccaggttcctccgccggctggtgcctgggcgccccgctctcgcccgggagcgaggccctgggcctccaaacgccagcatctctttctcgctctttctgcacccctccacaaaaggacttctgtggctggaaaccctttggcaagcctatctcctttattcagtcgggccgagttaacggcaggagttaggctgtgtgtgtggctcctccctttaaaaaaagacttgctgcgggctggagagttctgagattggaccgattccgtctattattaaatgccatctgtggaccgggattggcaggtgtttctttcacgctggcgataactatctctgcatgtggtgttacctaggtggtcctaggtttcgactttcttttttggttccagagataattctagaaaatttacgttgcttgtggtgagaagcgtgatcaaattaacacgtgctttcttacaaaacgttttatcatcttctgtctgtggatttaccttcctgatgcttgtggctatcacctctaagcaaagaggttaatagcattgctatttctgttagtgttgcagttgataacgataacaatagtagcatgtattaattgctagtgacaggcagagcgctagtttctacacggattatctcaaaataaccctttgaggttgatactgttactgcctccactttacaaaccaggaaactaaggtttaggtaggttaagtaacttgcctaagaccacagttttaacgtgacaaagcctagattcaaactcaagtggtctaacttcatagctgcatcctccacccccactcccttaaacgtgtatactccttaagcattgctcatgttgttaagctaattgcgatgttgtacccataattttgattttcaatttacaaatactctgtaaattagatgagagaaacagttgtttttaaaaacatacatataggccgttcgcggtggctcacgcatgtaattccagcacttctgggaggccgacgtgggtggatcacctgagggcagctaatttttgtaattttaatagagacgggggcttcgccgtattggccaggctggtctcgaactcctgacctcaagtgatctacccaccttgaccttccaaagtgctgggattacaggcgttagcgaccgcgcctagctcctaatatgacttttatcatgcattaataggaaatgttgggctatgcttctgtagaaatattctcttgagaataatatatttatgcttagtagctatttctgagaactgcttatgggtgacacccttagagggtgtttatatgtttttgtcttttaatatatttatgaaaacaaaatattcataaaggaaaaaacccatttaccatttgggaacttcttttgtaaaattaaaaacttacagctatgtatgtataatctgtatattaagttaaaaactctaattgattttggtgaatttcagacaaactagacatattttattctctttaagacggagttttgctcttgttgcccaggctggagtgcagtgttgcgatctccactcactgcaacttctgccttccgcgttcaagcgcttcttctgcctcagccttctgagtagctgggactacaggcatgcaccaccatgcccggctaatttgtgtgtgtgtgtattttgagtagagacagggtttcaccatgtttttcaggctggtctcgaactgctgacctcaagtgctccacctccttcggcctcccaaagtgctgggattacaggagtgagccaccatgcccggtgaactagccgtattttaaaacacaaataacattaaaacctatatttactaaggattaatattacaggacaaaattcacactaaataaaaattacattgactttataaaaagataacttttattagaaattaactattttatttgaaagttacgattttgattttatggtggcatattgtacctcctttgatcaatatgtacaaatttcaaaagtgataaaaaatatattctgtatatacttgtttaggatgacatttgatgttgcctgtatttgtataccatccagattctcattcttgactttgagatttgatttgaaatattttgaataaatgttaatcatgattatccttatagcctcttatattaatttgatcattaaaagatgttgatgcagaaacaagcaggcatttagaaggcaccttgtgaccaccttagtctacaactactaatagtaatgcttatgataactagcctttctagagcacctagagggcattgtgataagcatcttaatgaattatctaatttaaatcttaaaatagcctattaaataggtcttgtagtttaacgttcccattttactgatgagaaaatgcaaattggggaggttgtgatttactcagcatcacagagctagcaaatggcaaagccaggatttattttgttttgtttttgtttttgagagagggtctcacttttacctaggctagagtgcagtggtgctgttatggttcactgcaacctcaacctcccatgctcaagccatcctcctgcctcagcctctgaagtagccaggactgcaggtgtgtgccactacccccagctagtttttaaattttttgtagagatggggttttgtcatgttgcccgggctgacctggaactcttgagctcaagcaacccacccaccttggcctcccaaagtgctggggattacaggtgttcgccacgggatttaaatccaggcagtttgactccagaacttgccctttgaccactctgctagactatttcgtatgggttttttaaagcaaactttgaaatcaagtagtcaagctctttatagtgatgctattgtaaagctctaaaggcttgacactattaataatatgtatatatcaacattactacacagaattctgcaagtttcccctcccccactttattgatgagaaaaatgaaacatctaagtcaatggcttccagacttttggactttgccaacaagtaaaaaactgttatgtgtgggggacaattgggaccagacgtaagatctccaacttttatttctgtcaaggttgagaatcttcttaaacactactgcaatctggtcaggcacattggttcatgtctgtaatcccagcactttgggagccagaggtggatggatcacttgaggtcaggagttcgagaccagcctgcccaacatggtgaaaccccgtctctactaaaaatacaaaaatttgctgggcatggtagcacacacctataatcccagctactcagtaggctgaggcaggagaatcgcttgaacctggaagtcagaggttgcagtgagctgagatcacaccactgtactccagcctgggcgacagtgatttttgagactctatctcaaaaaaacaaacaaaaaaactactgcaatctactgtcctgatcctttccttaaaaaagggacatttttaccaccacaaaggtaggaaggtcatagttacaacataaaaacagaataaatttaatattatgaaaaactatattacattgtgttagtttttcctcctttggtcatagaccagtcaaaaacatgtcctaaactaacaccaattcagagatcattcaggaatgcctgggtgacacaactgattctgaactggtaattagctgagtccagtccagattcactctccagtctgtctgacagcaaagcctgtgcttgttgccctgtcatgagctctttctagtgaacagtgtctagggttttggtctcctgtgaacagtctttctcaggtgttgactatttccttctccctccaggtagggggccagggagaatagtctccagcagccaatgtcttaacagctttagtcccagtccagtttgtaaataccacccagagggtgagttccactgcttccctgtttgaggtagttcttttgtctgtgcttactcatggaaggggcaaggcagtgaccataccagggcaagaaaccacgggcatattccagtattcaagaaactctcctgctgggtgtggtggctcacacctgtaatcccagcactttgggaggccgaggcgggcggatcacctgagatcaggagtttgagaccagcctggccaatatggtgaaaccccatctctactaaaaatacaaaaaagtaaacgggcatggtggtgggcacctgtagtgctagctactcgggaggctgaggcaggagaattgcttgacctaggaggtggaggttgcagtgagccaagattgtgccattacactccagcctgggtgacagagcaagactctgtctaaaaaacaaaaaaagaaactctccagtaaatagcttgattttacttagtcattcaaaattcgaatccccaccttcttttatttcctgtttttacttcactcactcctatagttctccttctgtcatctttgtgtaacataaggagttaggtgtgtgttttcctcgttctgtcttgtctccagcagatattaagcccacctgtctgtttctgtctgtaagtgttctaagttccaatttcggcaaagattgtttttttccttaagtttttttttaattatgcctactaaagacactattaaaattacttttatattttattttactctatcacttgctaataaaattatctaatagtttgaataatatatgttttatctttaattataatactcttttgcatatattctctcatttaatcatcacagttttctatgaggtagatttgagaggtggtgttatctttatatacaagccaaattcattattttatttatttgtttattttgagacagagcctcaatctgtcataaggctagagtgcagtggcgtgatctcagctcactgcaacctctgcctcctgagttcaagcaattctcctgcttcagcctcccgagtagctgggactacaggcacgcaccaccatgcccggctaatttttgtacttttagtagagactgggtttcaccatgttgatcaggatagctttgaaatcttgacgtcatgttccacctgcctcggcctcccaaagggctgggattacaggcgtgagccactgcgccaggcccaaattcattatttgataggagcaagattttaactaggagttgaaaatagaagatttcgtatatcagcaacctgatcttaactactgattccaaaatgtattttttggggattgcctttgattcaaaataaaatgtattccataccattttagatttgcctaccttgcagtactaatcaccaaagtttgtgtgtgtttgtgtgtgtgtgtgtgtgtgtgtgtgtctgaaacggagtttcgctcttgttgcccaggctgcagtgcagtggtgcaatctcggctcactgcagccgccgcctctcgggttcaagcaattctcccacctcagtctcccgagtagctgggattgcaggcgccggtcaccacacccagctaattttttgtgtttttagtagagacagggttttgccatgttggccagtctgatcccgaactcctggtctcaggtgatctgcctgcctcagcctcccaaagtgctgggatttcaggcatgagccaccacgccaggcccaaagttttaactgtagtaaataatgctatctctcctggaagagccacataaacatatgatgaattcttttagaacttctttttagctgggtgtgatggctcatgcctctaatcccagcaactcacaggctgagatcggacgattgcttgaggccaagagttcaagaccagcctgggcaacatagcaaacgccagctgtacaaaatattaaaattagccgggcacagtggcttgtacctgtagtctcaactacttgggaggctaaagcaggtgaatcacttgagcccaggagttcaagactgcagttagctgtgattatacaactgtattccagcctgagtgacagagtgagatactgtctctaaaaaaaaaaatatataaaactttttttaaatgacaatttataaaatttaaatggttttttttcatcacttagcagagtatcaaccatcccaattttgttaataatacttttgtcaccatgttggggattctggggagaaagctacttggtatatatatatatttttaacactgtgctgctataattaacattattattcatatgatactgattaataatttttaaaagtgtagaaacatgtatatataatttgtacttttagagccaactgctggtactttctgcagtataataataaatggaaataaagtgacatggagcttttatgcaagataatcctgaaaagatgtataaaagtcaaatttgagtaacttaaaatttaaaaatagcctgaaaaatcttgctatttaaagaagtccagtgaagaattctcttatatagcaaattctctctcttaaaaataaaatcaatggagtttgctcaaagcaggctctaccactgtttcttcttttagattgtacacatttaatagatatccattattagattcagatagtgaagacaattcataagtacacaatgctggttctatatatatgtgtgtgtgtgtatatatttatactatatacccacacaaatttaaaatttaaaaaaaaaggaaaacttgggaagcctatacaggtatgtgtctattttttaatttaaaattgagaaagggtaagttagatttttttttttttttgagatggagtctcactccgttgcccaggctggagtgcagtggcatgatctcggctcactgtaaccttcacctcccaggttcaagagattctcatgcctcagcctcctgagtagctgggattacaagcacgtaccaccctgcccagctaatttttgtatttttaggagagatggggtttcaccatgttggctaggctggtcttgaactcctgacctcaagtgatccgctcacctcagcctcccaaagtgttgggattacaggcgtgagccactgcacctggccaagttctttttcttggttttgttcatgttcatatttcttttaaaaagcacaaaggagagctttatttaggactttataacttactggtaatagaacattaagagaatactgcatggtggtgatttaatagattctgtttaatgcttttgatgtttacctagagaaaaccaaatctggctggatgcagtggctcacacctgtaatctcagcactttgggaggccaagactgacagatcaattgaggccaggagtttgagaccagcctgggcaacatagagagaccccgtctctaccaaaaatacaaaaaattagccgggcatggtggtgcatgcctatagtcccagctactcaggaggctgaggcaggagaatcactgaatccaggagacggaggctgcagtgagctgagatcgtgccactgcactccagcctgtgtgacggcaagactctgtcgcaaaaagaaaaaagaaaaccaaatctgatggtgtaagtttcacagcagctaaaaagacatggattcctgtagtgttaagtaagaatatgagagcaatactaaccctaggcctcattccggccctgacgtaggtgctcaatagatgagtaaataagtataatatatgtttaaactgaatcaacttccagtttaaagtgatcgattagtcacatgttgaaatctccctttcttgctctaaaaacacagagatggtaagtaaaattgaaacaacacagagccaagtttgaaagcaagagagaaatctccacatgcaggagtgaagaaagaacctatagcagtgagcttgattgaagacaaatgttccatgggtagacagggaacaaacacagtacatgaatactacttaggatctgaagtgtttattgcttgccaggagacggaaactgagttcccaaggcctgttcaaccttcagaatcaaaactagacatattttgggaagctgagaatggggaaacacttttctctccataaatgaagactgtatcctcactgaggttgagacgagaattaaaccatccatcccacaccataagtagaatcctaaacctcaacttgtttgaatttggctttggaattctacctgaggtatgtaaccatctaacacagaaactaatgtagaaactagttttagcttgtaaactctcaggatctcatatagaggcaaacttaaaactgcctccaagggttggtttccacaacacacaacgtgtatgggaccaccatcaaagattgcaaagtgagcttatagacaaaaattatgccatgaaagagactgaaaatttatatccaggcactaaagacattagaaaagatctttaaaataaatatttaatgaagccagaatttaaagttatgaagcatgaactggtgaccataaaacagaaccaaatagaaatatagacataaaataattgaagtgaaaagatggaatatcagaaatagataactaaagagctatataagaagttaggtggtggataaattgcttaattaagaaatgaggccaggctcagtggctcacgcctgtaatcataacactttgggaggttgaggctggcagatcacttgagcccagaagttggagaccaccctgtgcaaaatggtgaaactctttctctacaaaaaaaactacaaaaattagctgggcatgatggcacatgcctgtcatcccagctacttgagaggctgaggtgggaggattgcttgagcccccgaggtcgaggctgcagtgagctgtgatcatgccactgcactctagcctaggcaacagagcaagaccctgtctcaaaaaaaaaaaaaaaaatgaaaatatacgaaatgaaattttgtcttgaaaaatgggatttagaaaggaatgggagggaatacatttatgaaacaaaaacaacagaaccaaaggcttagaggctgaaaattttggaacaggaagggaaaacaaaataaaaaccctggactacgactggtaagctgagtgatattggacatgtccatttctgtttctgggctttatttttttttcatttaaattaagatatttaaactaggtgatgtctaagactcgtgataactataattgtgattcaaggaaaatctaagtgtgtacatctaattagaataaagcactatttaggtttatgtacttggtaatatgatacatactctaatgctttaggaaggaagctctataaagggtatcagggtcataacaatgtattaaatagtgtggtattatactaaatatattgatcttcctgattctgtcacagagctcctcaaacccttggatttcctgaatgataagagtgtctttaaaaaaaattttttttaaactgatgcataatagatgtacatagtttcagggtacgtgtgataatttaatatattcatataatttgtaaagatcaagccagtgtattctggatatccatcactttcaatatttgtatttatactagaaacattccagttcttctcttttagctatttttaaatgtacagtagattgttataaactatattcaccttactgatctaacactaggtcttattccttctgtcaagttgtatatttttatccattaattccctcccccccatgataggagtgttttttgtcataatgatccccttttgatcacacctgagtgtatgctagtcacctgaggtgacttagggtagagcccctaggcagcctcagggtatggctgatcactagaaagaccaagtgattagagggttagaactttcagccctatccatgagctttggggaagggggtgctggacattaagctctataaaacttttgaacgacaagatttgctgagcttctgggttgctgaacacatggtgctggcagagtggcctgtccagagagggcatggaaaccctgcatccccttgcccccaatgccttgccctctacatctctttatctggctcttcatctgtatcctttataataaagggggattttttgaagacatattagaataaagcaatttattgtggataagaagacttaaaaatgggccatggttaaagacttgttaagcgttcctaataatgatacatttgacaaggaaatttagttatttctgtgacatataacaatttaacattagaattatgactgacaacatttcctaagacgtatcagatttctaggaatctcatgcagttttggaacacatattaacctgttcatgttaatgggattctaggaaatggttaaacattattcttatttggcaatgcttcccatataatttaacatgcccaataagcctaatatgtttcgcttggacttccacaggcccttttggaatgtccaagagttagtttaaggtcaaaaagatgtaatttagaatttgaaatttgatttggggaagcctgttaattatgtcaaaggtttaaaacacttgatcaaaaatagtatcaaaggtcactgtgatgaaatgaaataatattcatttagctgaagtgatttcaaaaatcaagagatttcaaaaatcaagaatcctcactctttgatagaaaagcaaccccattttccaaaaaaaaatcaaaaggcctaataaagacagcatgatgcaaacagaatgtttcttctattttgcagcttactcaaaaggcaaactataatattttgttattttttattaatactacacaaaaatcttcagaagagaaaaccaaattcaatatattattattattttctttttttgtactttttgtagagacaaggtcttactatgttgcccaggctagtctcgaactcctgagctcaagtgatccacccatctcagcctcccaaagtggtgggattccaggcatgcaccactgtgcagggcctcaatgtattattattaaagtgaattttaataaaaccttataaacaaattcaatctcagtcagctttgaccacacaacataagatttccgtaaattttttacaactacttacaaaattatttcaggtttttttcttccccaacttgttttatccatttagttttatctatatcattttttccttcattatgaaacctttaaataacctctaaactagacagaattccttttttcaacaaaaaacacatcttttgtctttcttataaccttcctcaccaaaaagcatcctgcctttcttgtaaaagcattgtttttctttatatctagttgttttaattacatatattacaattttgactcttactaatttccagtataaaacctagtaggaagcaattttaattgctatgtaccaggtacagagttctggacagagctattacgactacgtctggaggacccaaccccttctagcatggccaggaggcactgctggaccaggagggcagggccatattgagcctggctctgccctgcagctggtggcccaggtactgaagataaacgtatgtacctgggcctcaccatggtcacctgtgtagactgcagaatttaaaggctcaaaaccaaaaacataagctcagacaaatcaaacaaatattaaaaatatctcaggagcaatagtttgatgaccttaaaatacgtagaagaaactgtgtaaatctaaccagtagacccaaggcaaaaatgtctgaattatatttaatattgacaattttgagacattcctattttaccaacaatttttaaactagcttatttcaaatagagagaatttaagctttttcaagagggagtttgaatatgtcagaggagacaccgaggaaggttaatctgaactaccagactacaaggtggagtggccttctttataaatcccacaggggatccaaagcaggcagtttgagcatacaaaggagttttactttgttttaaatctgaattctgcttgctctgttccttttgtgtcttttcataggtctctgaaaagatgagaggtctctgcaaaattttctcataaatacagccaattaatttattccataagcacctaagccaataagcctttttcatggaaagtcccagaggtagctttgcaggtttagaataccatagacatgagtggaattttttaaatggcacagaattggttccgcatgatccccaaaagaattcactcccacaaagaggctaagatagcagaagactcttgttgccatagacagtgaaggatggtgtgtatgtatggtgtctctagtatcacacaaatttgtggggggcattggtcacagacccattactccatgacaccaggacgcccacctggaattggacttataatttttttttttttttttgagatggggtctcactctgtcatccaggctggagtgcaatggcacagtctcggctcactgcagctctgcctcgcagactcatccagtcttcccaacttagctagtaccacaggtgtacaccaccacacccagctaattttatttttgtgtgtgtgggttttttttttttggtagagatggagtttcaccatattgaccatgctggtctcgaactgctgaactcaaacaatctgcctgcctcggcctcccaaagtgctgggattacaggggtgagccactgcacccggcctggacttgtaattctttatagttgctttactttttgaaaaaatgttaatatctttaatctgtttgaaaggttttgctaactgtagtggcaaatccttctacctattctttttcaaaatttcttggattttctcacatgtgctctttcaaatatatatttaagctgagtctaaagctccataaagttcaaggctgcagtgagctatgattgtgccactgcactctagcctgagctcagaatgagatcttgtctctaaaaaaataaaaatgtaagctctgtaaatattcttggaatttttgttggaattgccttagaactgtggattgtttgaggggaaactgaaatgtttactgttgactattcccatccagaaatgggtatttctatccatatatttaggacttctttatgtctgttagtttctgtgttggtgtattcctaggtattttataatttgtattagtattgtaaatagaatcttttatcctattacatatcttaacttattattgctgatataatcagccactttgctgaagtcttcttattagttctagtatttttttcagttgattgtctcagattttctaggtggcagttatatcatctgcagctttagaccttcgttgtaaatgggcccaaaataatgctgcttttttattctaagaaaaacaattcagtggagtcatgaagtgaaaagtatagcaaaaaattactctttaagggcaggtgcagtggctcacgcctgtaatcccaacactttgggaggccgaggtgggcggatcacaaggtcaggagttcgagaccagcctggccaacatggtgaaaccctgtctctactaaagatacaaaaaatcagctgggtatggtggcgcacacctgtaatcccagctactcgggaggctggggcaggagaatcacttgaaaccgggaggcagaggttgtagcgagccaagatcgtgccattgcactccagcctgggcaactgggtaagactctatctcaaaaaaaaaaaaaaaaaaaaaaaaaaaacacctttaaatttgcttcaatacttattataaaataataagcataaatatacagaataatagtaataaagagtgtatatgcaaaattgtaattttatggtattttgaacttaaagcatcaagatggtagcataaattaatttctaaaaagaaacctgaacacttacttttcatcatggttatttctgctacactattacggctatgataaaaatccagcaatgaaaaaggatgaggataatgatgtagcacctgcttaatgaataagaccattcagatgagcaaaatacataatttcaatatgttgtgttacctttcccctgaaaaggccatcaggaatttgttagagtttgatgcctccccagtagttagccttggtaactgaggaagtaattggcttgtgtttgactcaaaaagtttgtgtaggctcagctactggttatttttctgtcttactgtcttttgaacagctcagatatttcttaaaagggtctcaaatctcctacgtgtgattttgtagttttgttctactgacagaacatattcagaaattaaatcatttttttaacaatacattgaagattttctactgctgccttttcctcttactctttctgctcttcccattttctacattctttgtcagtgttttcttaaggcccacaattaattcttaaatttcttctttgaagctgtgaacaaaaccatccctactatcttggcctggctacctgtacagtgttttccacttttttgacaaagaacaggaaaccttttaaatcattcagacattcttttcatttatgtccttcatgctttaattatttacagtttaattacatctatgactatttaatatgagtgaaacattcttggcaatgttgaaggtcttctaaccctgactgcgtcatatttaatatcaggcttaccatccatacatggatgtgttgatgaaactctaagcctcatacaagtggtcttgaaacatcaaatcacacttgatttcaaaggttgatggatggaagtggtatgggaggcagaaaacaacttcagcaaagttacttgcaaactggagtgtttcagtgtccaggaataaatgatcaagcaacacatttaaaacatccctttttggccgggcgcggtggcccacgcctgtaatctcagcactttgggaggccgaggcaggtggatcacctgaggtcaggagttcaagaccagcctggccaacatggtgaaaccctgtctctacaaaaatacagaaaaaaaattagctgggcatgatggcgggttcctgtaatcccagctactcagaaggctaaggcaggagaatagcttgaatccgggaggcagaggttgcagtgagccgtgatcgcgccgttgcactccagcctgggtgacagaaagagactccatctcaaaaaaaaaaatccctattttggccgggaacggtggctcacgcctgtaatcccagcactttgggaggccgaggcaggcagatcacaaggtcaggagatcgagaccatcctggacaacacagtgaaaccccttatatactaaaaataaaaatacaaaaaaattagctgggcgtggtggcgggcgcctgtagtcccagctactcgggaggctgaggcaggagaatggcgtgaacccgggaggtggagcttgcagtgagctgagatcatgccactgcactccagcctgggcaacagagcgagactccatctcaaaaaaaaaaaaaaaatttttttgaaatgcctctgaattgttcagtttaaaatggttacttttatgatatatgagcttcaaaaaaaaaaaaaatccttatgtaaatggttttgctgccccttcacacatatcatggatttctccacaaatagaaatccattttaaaaaacttcacagcataataattacaatgatttgtaatgtttaaagaaataaataagcatttcaaattctgatttttggtgagataattggtaagtagaagactattatcactaaatattttagatttaatgtatagttttctctttaaaaatgtccatgtttatgatggatgcaattattttatacattattttatataaagtaattacaattactttatatgttttctagccaatttatatgatttgtttatattaaataacaggttttctaagacaaaaaattctagtacgttaaatttaaacattaaacatagtccattaaaattctaggtctagattaagaatcaggatagtttttcttcctctgtgtctctgctttcttattatttacttttccaccttcaagctaaactctcactcattaaaatggaactcactttgctatttactatgttacctcttaatgtgtttctgttacaagtgggagatgcataccttgccacacttgtgtgactagaaagaggttaaatgttttttgcagtgtctgatacatagtaggtggtacttaaagagtagcagtgattatttcccaagaacataagagtgttatcagaaaaagtaagttttcaccttcgcctcttgttacctttttaaaactgttgcagcctgtggaaacataaatgtgttttgaaaactgatacccgatggacatgaaggcctataatatgattctcttcagtggtttatttgctttgtttttctcaggtgaaagaaaagatgttgtcccggttaagagtagtttccaccacttgtactttggcatgtcgacatttgcacataaaagaaaaaggcaagccacttatgctgaacccaagaacaaacaaggttagtaacattaatatcaatgtacattttctctcttcttattaaagtttgatatatttaagactgataaggtgtgacatatttttgtagctttatgctaaggttgttcagagatagttgtttacatgaaattttcacgcttctccacatggcaaaatcgtggttgctttatacctcctcaatttcatcctcatgacttttaccaccagaaaaggattgactttgattcctagttctagctttaaaaaataaaaaataaaaaatcccagaatagtgctttggccaggactttgggccacatgtgagatatttacatttccccagctcatatcaggtactcaccctgagctaatcagttaggcccttggaaagtagggtcaaaattgtgaaatgaacctttatgtaaagtccacatcaccccacctccacttatctttttggacacaaaccattgcacacaaaaaattgtgcccattaattagaatgattagatgactgcttcaaaatagagagactcctggctctttattgtactcttgtgacaaaagtgacgtgcaatattgagatccagtcattacttcatccttcatctatgtttggttcggtggacaagtgcctgcctgttttttagtggcaatattaaatagtaagtaaaagttctgggaagagattttttttacaagaagattgcaagaggatacattgagtttattgcaatatatgaaatttaccttttggggaaaggtaaattcaaatgaaaagtgtgacttattttaaaagaacagtcataaaaaacttgccagtcccgtttgtttcccactatcagggaaaatagttaattgttaattgttatcctatgataagttttgaggggtttcaggcctacaaaggggaatttgaccatgggtcacacagagcacctcacctttgtattcttggtacatgacacagaatgagttcagcaagcagttagtgtgttaaatgaagcttaatgaaggatattctgatcttctcttgtttgtgcctgacctctccaaatctcatttgctctttaagatgcacctcatttcaaatccagttctcctgtagaacctttttacaccaccatggactggagtaattactcccttctctgaaaccccatagcagtttcttcctgttcctgtggcaagtaatcaataggtgttgctttgtgcttcttttcatggtttaagctgttattgaagtcattgatggtagttacattttcctgagtttatatcttcttgactatatttcgggttccttttgggcagggaccattcaaatacttctgtgtatcttttacagtgctatgggcgcatttgataaatatattggttttatattttatacttatggaaataatttatttaaaacctactctggggacttagagattataagaaatttataaagtacattgagtgtcaaacaagtttgcagatggagcatagtctaagtgcattaccatacttccctaaagaaaataatgtcggccaggcacagtggctcactcctgtaatcccagcaccttgggaggctgaggcaggcggatcacctgaggtcaggagttcaagaccagcctgaccaacatggagaaacttcgtctctactaaaaatacaaaattaggccggacatggtggcttatgcctgtaatcccagcactttgggaggctgaggtgggcggatcacctgaggttgggagttcgagaccagcctgaccaacacggagaaaccccatctctactaaaaatacataattagctgagtgtggtggagcatgcctataaacccagctacttgggaggctgaggcaggagaatcgtttgaacccggaagtggagagtgcggtgagccgagatcgtgccattgcatgccatcctgggcaagaagagcgaaactccatctcaaaaaaaaaaagaaaaagaaaaagaaaaaaaagaatgtctaacattctggccttctgaaatccctaagattgaatagcatctatatggtcacatcattgaaggaccacttctggaaaccccttaaacatcaggaagagtttatttttgtttaaagaacatagaccagtgattcccaattcatgggttatagactcctcaggaacttaccatgtaaagaaatctcatttgtgcttcaaatattgtatacttaataacttttcacatttttgtaaatattatctttaaggatatgttgctgctgtaattaataaaatagtaattaaaggcagtattgaattctgaatcttcttaaatgtatgtctgtaatcactgtatactcaaggtatacctgctctttgtttataaaacttttttattgtggtaaaggaagcataatataaaattgacaattttaactatttaaaagtatacaattcagtgacattaaatttatttagtgttgtgcaaccatcaccactatctagttccagaacttttttattatcccaagtagaaacctagtattatttcattttattttatttttttgagacaggttctcactctgttgcccaggctggagtgcaatgacactatcatggcttactgcagccttgacctccccgggctcaggtgattttcccatctcaccttcccgagtagctgagactacaggcacgtgccactacacctggctactttttgtatttttttgtagagatgaggtcttgccatgttgtctatgctggttttgaactcctgggctcaggtgatccgcctgccttggcctcctaaactgttgggattacaggcatgagccaccacacctggccaaaatttcttacactttaaaaggtgggacaccattatgctaggttataagcaggagtttaggtgctaatttgggctttaccatttactagccatgaaactttggcaaacccttcaacttctctaggccttagttttcttcatgtaaataatataggtaatagcatttggaaacatttaaagggctatacaagtataaaattggatttctccttttctccccatgctcatttggctaacttttctcataattttctgaaattcagctctgcatcctttcccacacagcagaaggtgagcagtggttgagcaagtgaatcttcatctgtatttacagccactcctcatggcttgcattaccgcctgtgctctgcctcctgtcagaggagtgcaaaccctattgtgaactgcgcatgcaagggatctaggttgcacactaattatgagaatctaatgcctgatgatctgaggtggcacagtttcatcctgaaaccattccctaccccctgaaatagagtcaacaagataaaaactcatgaaaatgtaactatcatcaatgacttcaataacaactaagacatgaaaagaaaaattgtcttcagctggctgtggtggctcacacctgtagtcccagcactttgggaggctgaggtggattgcttggggtcaagagtttgagaccagcctggcctggtctctaccagcctgaactcgtctctaccaaaaatataaaaaaattagccaagcactgtggtgcatgcctatagtttcagctactcaggaggctgaggtgggaggatcacttgagcccaggaggtggaggttgcagtgagatcgtgccactgcactgcagcttgggtggcagagtgagcccctgtctcaaaaaaaattgtcttccatgaaactggtcactggtgccaaagaggatggggaccactgctctaggaagttttcagtgaccctttttcctaattcctcaccacactgggtgagttactcccctgtcctttgagcattcttgtgctcacttctgtcaataccatgtatcatactcagttggaattatctcattcctccattgaggacaatgaccatatcttagtctgtatcctcattatcttaccccacagtacttagcacacacagagcctcagtacatgctgggtagatggatgaatgcataaacagatgagcaaataggaaaacaaaatctgacatgattggtgctcggagtttcacagataattaaacataggttttgtttccagaaaataagtttggattagataggagttttgttacctactcttgtaaaacaagttaggaaatacccctattcacacctcttttccccatgtactgatttatgtgttttcttatcattttttgagcaagtgaagcttcatctgtatttacagccactcctcatggcttgcattacaaagcccatttcatcttacaaagtcttaaaaattgagtgatgcagtttttttttttaaataagaatagggggaggaagaaggaaaaaagtaagaataattttatttatttatttatttatttatttatttatttatttattgagatggagtctcgctctgttgcccaggctggagtgcagtggcgtgatctcggctcactgcaagctctgccttctgggttcatgccatgctcctgcctcagcctccctagtagctgggagtacaggcgcctgccaccatgctcagctaattttttgtatttttagtagagatggtgtttcactgtggtcgcgatctgctgacctcgtgatctgcccacctcagcctcccaaagtgctgggattacaggcgtgagccactacgcccagccaagaacaattttaaattacattaaaaagttttcagttgagtgatatgatttggctctgcatcaccacccaaatctcatcttgaattttaataattaccacgtgtcaaaggtaggaccaggtggaggtaactgaatcgtgggggtggtttcccccatgctgttcttgtgatagtgagtgagttctcacaagatctggtggctttataagggacttcccccttcgctcagcactcattctctctcctgccaccctgggtagaggggccttctaccataattgtaagtttcctgaggtctccccagccatgtggaactgtgagtcagttaaacctcttttcttataaattactcagtcttggtatttcgtcatagcagcatgagaatgggctaatacaatgagtatattttatttcaaatttatgtattaacacctaatttctgtaccaaaacaacataagccatagaacatgtgatgtgaataattgtggatttgtgatgaacagagcttgccacttagttataatttgcccttttagtgcaatttcatctcaattaacacattttcagaagtctaaacaagcatttgagtgctagtgaggcactggctacatagcgcctatccgtattgaggttaagggaatgcattttatctcctgcttataaatgtgtgtaaatggattctatctcctgaatcgtttgccttctatcttacatttctcattacaaacgtaaatcagtattaaagagtctgatttgtattaaagagttgttttagtcttagattatttctgttactctcaggatatgtcttatattagattgtacaaggcttaaagatacagataaaatgtgctttaaagtatgaaatgagtaccagaaaataaatatttggttgaatcagagagatgagaaaatatataacaaatgaattggctattcatttttagtgtggatttaaagcttttagaggtagatataagtgatactttcttttacactgtaataatgcttccatagggtagagtgctcaaacaagaaatttgggaaggattcaggctgaggtctattatgattacaacagtaaaagtgtacaattgtttgattacaaggtgagccaactctaaactatgtacatagcctccgaccctcaattttgtttttcacttttgttcttcctgcctctgtgttggctgccttagcaagagagatgccaacatttttattgatgacccagtgggctaaaggtataggagtccttctgaaatttttttaaaaaaacacctgaacactattgatataacctagtaattctcaagtaactcctgctatctacgtttttttctttttctagttcctcccgtaatactactaaacatctcttttaaaccaagtattcttttcaagatgtaagattgtgaagagattttactacagattcttaatttatttcagccaaattcaaatatcctaatggactctatttagaataatgaaccatagattgccagaactaaaagagctaagtacatagtaaatacctatgcaaaccattaacttaattcgagaaggagtgttaaagaagagaatcaataactcctttattttgtagattccatccctaagatttaaggacatgctcaagctttgtatctggaactctggttttctggttattagttctctgagggttttgttaatttatttgtttatattttaacttctcccggctagttctttaataaatttagaattttcttctggttatttacacaaataatatgactaataaaagatttaaaaatcacattgctattattctatcaccttttttggtgagacagagatttactcttgttgcccaggctggagtgcaatagtgcgattttggctcaccacatcctccgctcccaggttcaagcgattctcctgcctcagcatcccaagtagctgggattacaggcatgtgccaccacgcctggctaattttgtatttttggtagagacggggtttcagcgtgttgtccaggctgatctcgaactcctgacctcaggtgatccactcgcctcagcctcccaaagtgctgggattacaggcgtgagccactgtgcctggcctctatcatctatttttatttggccatgattctcttaaaagtatacttacttttaagattataacatatacttttatatgcaattttaccactgggaaaagtatactataaatatatctctaaaatgtttgataagctgtataataaatatatgggtgcataatagtgtagtagcctttggatttggaattccagtggctgatgagactcccagctttgcacctttactggccccctagcatgtttacctgaatgttcaagtgtctgtttaagagatttgtgtcaatattgactcgtggagaaactgcatgtgcctaaagtaaaatagttcagggtctttcaggatcagctggaggaagtacacctctgctatgtaaattgggagggagggaattgctgttgcatagatgagaaaaagggagacttgggaaaagtggcaaagggagatggagaaagtaggagaagagtagataagaggatgatcatttctgcttaatactaaactaaccaggccattcattttaaactaatgtcatcatcacaggcttgcttcacttattaacaccagcctagcaaatttaagaacttaatcaactgttaacataaatatctatacataaaattatttaatcattttattttttactctgcattataaataaatcacttttgagtgtcccttaaatctaaataggaaataggcagtgcagccttgtgtagtcaactccatttatctttggcaataaggataggcaaagcgtacttttttttttgagacaggatcttactttgtcacccaggcagaagtatagtggcacagtcatggctccctgcagcctcgaccttccaggcttaggagatcctcccacctcagcctctgagtacctggtactacaggcatgtgccaccacacctggctaatttttgtatttttgtagagatgaggtttcaccatgctgccctagctggtctcaaactcctgggctcaagcaatctatccgtgctggcatcccaaaatgcttggattacaggcatgaaccactgtgcctggcccaaagcacttctaaatgaactgcatagttcatttaaacatacgttttagccttttcctttacccttttgctagagttggaaaaaaagacgcaagagtgacagttttggttttaccttctttgtatttcccagccttcaataaaatcatacaaggagaaacatgagacacatgtttattattgtctagcgtctcctccattattgaaagtgggtattaaagtctccaacttgttgaattgtctttcttcaattctgttagctctgcttcatgtattctggacctctgttgttaggtatgtctatatttataatagttatatcttcataatagattcaccctttcatcattgtaaaatgtcctctgtagtagcagcattcattttaaagtctgttttgtctattgttagtatagccactctagctctcttttggttacaatttgtgtggtatatctttttccatccttttactttccacttatttgtgtcccttacagacagcatataattggattatgttttctttcttctgtttttttttttttttctgggacagagtctcactctgtcagccaggctggagtgcagtggtgcaatctcggctcactgcaacctccacctcctgggttgaagctattctcctgcctcagcttcccaagtagctgggactacaggcacccaccaccacacctggcttattttttttttgtatttttagtagagatggggtttcaccatattggccaggctggtctcagaactcctgaccttgtgatccgcctgcctccgcctcccacagtgttgggattacaggcgtgagccaccacgcccagcctaattttatatttttagtagagatgaagtttctccatgttggtcaggctggtctcaaactcctgacctcaggtgatccacctgcttcagcctcccaaagtgctgggattacaggcatgagccactgcgcctggccgacattatttctttagagaagtatggtaatgcatttagactatgctccatctgcaaacttgtttttctctttgtctaggtgtagatctcttttgagtttataatacttggagttgttgagcttactggatgtgtggattaatgtttctcatatttgggaagttttggggcattatctcttgaaatattattctgcttctttctctcctctcctcaaacttcattatgcatatgttggcatacttgatggtgtcttacagatctctgagattctgttcatcttttttttgagacggaatctccctctgtcaccaggctggagtgcggtggcacgatcttggctcactgcagcctccgcctcccgggttcaagcaattctcctgcctcagcctctcgagtagctgggactacaggcacatgccaccacactcagctaatttttgtatttttagtagagatggggttttaccatgttggccaggatggtcttgatcttttgacctcatgaaccacccacctaaggctcccaaagtgctgggattagaggcgtgagccaccgcacctggcagttcatatttctttattcttttttctttctatcttagactagataatcttgggtgacctatttttaagtttgctgattctttcccacttgctcaaatctactgttgaacccctctggtaaatttttcattttcatttattgtactgttgatgaaaagattaaaactctgtaaaatatttgaagagatttattctgagccaaatatgagtgaccatggcctgtgaaacaaccccaggagatcctgaaaatatgtaccccaggttgtgggggcacagcttggttttgtacattttagagacacatgagacatcaaatacatttaagatacacattggttcagtccagaaaggtgggacaactcgaagtgggggcttccaggttataggcaggtttaaattttttcttattggcagttggttgagttattatcaatagaaataaatgtctggattatgataggaggctttggagaccagagtttcttcatgcagatgaagcctccaggtaacaggcttcagagagaatagattgtaaatgtttcttatcaggcttaaggtctgtgttgatgttaatgctggaggagtatagtgaggcatgtccgaccccccatgccatcataacctaaaccagccttttcaggttaaatgttaagagtgccctggccaaggaggaagtccattcaggtggttgggagaccttagaattttatttttggtttgcagtactttcattcccagaatttccatttaatttctttgttggtagtctcaatttggtgggacattattctcatactttcctttagttctttagacatggtgtcttttaagtctttgaatgtattcaaagatgtgaatgtaaagtctttatctagtaagtacaatgtttaggcttcctcaaggacagtttcatgattttttgttgaaaactggacattttaaataaggtagcagttcaggaaatcaaatactcctcccagggtttgttgtattgctgctacttttgcttgtttagtgatatttccaaactaattcttttctttttttgagatggagtattgctcttttgcctaggctggagtacaggggcatgatcttggctcactgcaacttccacctcccaggttcaagtgattctcctgtctcagccccccgagtagctgggaccacaggcacatgccaccacgcccggctaatttttgtacttttagtagagacagggtttcaccatgttggccaagctggtctcgaattcctgacctcaggtgatccgcccaccttggcctcccaaagtgctgggattacaggcatgagccaccgtgcctggcctccaaactattctttataaagtctgtattcttgtacatgcccactgaagtctctgattggttagttttgtggtcagctgataattagacaaagacttaaatgcttggaactagtaaatttcccattttttgccaagtggctctgtgtgcatgttgcggcatacctccagcactgaaccaggcagtttacaactacccagaagccttcacttccttcttgcacagagccttaaggttagccagaggtgtgagctaggatcttttcaggtctttcctggatgtgtccacagctcatgtatgtgaccttctagagtcccggtaatacctcatggcttttgaaagctccaaccccatggtcatctcattctttagcttttccttgtgagctttttgttaccctgttgtttttctcaactgttatccactgctttgggcagctgctatgctaaattattgcctctgattgtttccaacaagcacttctggggaaatggcttttcagatggggtgagcgccaagttaggtcaaatgaagatagccttgcaagtggggtcttccagggaaccaccagacaggtcaaataatgacattttcctggaatagggcttagaagaatctccagccccttcttcctgccctggtggcttccaggctgctgattttcatagtaattgtgaggtgttagttttcgatttaaaactcacaaagcttgttgcttactgaaatccagccatttttcctgaataactgctccctgattgctgcatttctttggtaaatttccagaatgttgaagaagttgcttctggttatttgtccagtgttcttgttgcttttatggaggaaaagattttccaaaggccttgctccagcattttcattgacattgctttgatacgaagaatttaacccatagtcaaatgccagaaattgaaaaagattttcttatgacatagattaattttttcttaagcatcatttcttctatccccttttaatggtatttcatggtatgaatataccataggatgcttaactctttcgtagttaatgggctttttgttagcttgtaatatccaagagaactagaaacaatgctacaactaaactttttgtatatgcctttgtgtgccattaagaatgtttctctagaatggctccctggaagtcagattgcttgatgaataatatgtatataaaaaatttaagaatactttaaaactgtcttccaaaggcctaaactagtttatattcccagcagtggtttgtgagaataactattttccacaccctgaccaatactgacatcagtcttacaaagttttgaaagcctgggcaaaaataatatgtcattgatttttcaaatttgcatttaaattatattttgaagaacaatgtcattgctaccccagtaagtaataatttttaatccttttatttctcctctttagggaatggcatttactttacaagaacgacaaatgcttggtcttcaaggacttctacctcccaaaatagagacacaagatattcaagccttacgatttcatagaaacttgaagaaaatgactagccctttggaaaagtaagagttgcttagatgtttctttttttattggtattctgattagaaaacttatgagcattatggttattatggcatgagaaatacacaatcttatataagtttgtgttttgtcagttaactacttttataaagattgtgtttctttcacttcggtgaatacttcacaagtattcactattgtaaaacttaacaaattagtttttatgcttacagtcagagcaattcaggtttgaatggaatattagaagcaaaggataccatctaatttgcactcattttattcaaaaacttttattgatcacctgctttgtgtttgacactgtaccagccactgaggctataaagtgggtaatagataggatgaccatatattatatcacctaatctaggatactttggagaataaaaaagaggtgtacccaaagctacccctggcaaactttttttgtttctttttttgagatggagtctcgctctgttgcccaggctggagtgcagtggtgcgatctcagcttactgcagtctccgcctcccaagttcaagcagttctcctgcttcagcctcctgagtagttgggattacaggcgcccaccaccatgcctggctaatttttttatttgtagtagagatggagtttcaccatgttggccaggctggtgtcaaattcctgacctcaggtgatccgcccgcctcagcctcccaaagtgctgggattataggcatgagccactgcgcctggactttttcttttcttttctttttttttttttttgagacagggtctcactctgttgcccaggctggagtgcagtggcacaatttcagctcactgcaacctctgcctcccgggctcaagcagttctcctacctcagcctctcaagtagctgggattacaggagtgcaccaccacacccggctaatttttgtagtttttagtagagacagggtttaaccatattgcccatattgcccaggctggttttgaactcctggactcaagcaatctgcccgccttggcctcccaaagtgctgggattacaggcttgagccactgcaccaggcagcaaacttaatatatatgaccaacccagtaactcatagccctgtcttctaaaagtcatcaacagacagttatgctatgattgttattggtctctagaccacaatgtacagtacaatgagaaaaaggtacaagcagatatattctgagagcatgcagagggcatctagctcaacttggggaatcagataaaagcttcctgaagggagtgatgcctaagctgaattgtaaacaggatgttacaggtagcaggcaaagtattctgggtagagggatcggtctgcatatagaactaagcatatcaattgagtttgttaagtataggagattattggtgactggtaagagtggtttctttgatgtgatagagcaaaagagatactgtgatagattgaaaaatgaatggagggggaggaaatgtaaactacccttacaagaagttcaggtaaggagggaaggaagatattaaataataagtaaagtaagacttgggattaagtatgtttcaagctggaagaaaatttaatgtttcatcgtagttaggaggaatgagcccaggagaaaggataattgttagagcaaggtctagggaaaggaaaaaggcatagggtcaaatgcggagatagagtggctggtcttgagcaagaacaaagaacagctcattctccgaagctggaataaacataaatacagatagtaaggataagtatggagatgtttgagcagaagtagtgaactctcaatcttaactgatgatcttgctttcttttatgacatagaatatgaaagtcatcgctcagatttagaagggccagggttgagtagagttggtgaggagagtgagaaatgcttggaagagccatgtggctataagataaagctgaacaaaagctaggcttggtggctcatgcctgtaatcccagcattttgggaggtcaaggtgggaggatcacttgagcccaggagttccagaccagcctgggcaacagagtgggaccctgtttctacaaaaaaaaaaaaaaaaaaaaaaaagccaggcatggtgtcgcatacctatagttgcagcagctcagaagactgacgcaggaggataacttaagcccaggaggtcaaggctgcagtgagccatgattgcaccactgcactccagcctgggtgacagagtgagaccctgtctcagaaaaaaaaaaaaaaaaagaaaaaggctaaacaagagcaggttaaaggggtgagagcagaccctgatggcctggtggcaagatcttgtttgtattggtgccattctgcacagcaatgttatttttccatagaaaaaatgaaatgtaacactgattcaggcttggagtttgctgggctggcaaaggcaggtgttacataaattcattcagttaatattcaggactgctaatgtgcctggcattgttctaagctttgaaactccacaaatgaaaacactcagcccttctcttcagagagttcactatctctggtggaaaggcagacactgtggaagggtagtacagtgataaatcatgtggggattcctaaacagtaatgacagggagagatttgctcagagtgagagatttgatcctgggattcagagcaggaaataaagaggatcctgaagggagcccatagaattggaagaaaatgaagcagtcaaagagctagagatccctctgaaggatgacgaagtgagggcatcatatggctacccaaaatggtagaggattgtgatccaagagtggataagggcattcaccattgctgagctataatgatcctaggtgagtgctgcccatcactgaggcacacagaagactgactaaagtgaaataaggattgaaagtggtaacattgaggagatccatgacttgtagagcttccctctatcacatgcctcataggtcatctgttctttccttaacattacttccatctcacaaagccatccattccattttagcagcccagtttgtttacttccctatactgcagagaagtcttcttccctttaatttctatctgttgataccatttcttccactattagctatgtagaaaataaaattgaagggatcacgtctcctcatttattcaccaaatatttgcacaccagttatatgccacatattgctattaatagttcctggaactatagaagtatatgaggtgatcatttctaacttatggtattgtctagactggaggaagccagaaagtcaaggagtggagtgagagttaacagagggaagtaggctatcatgggacctgaaaacaggaaagtctaaagcgtgtatgtatacatgataggggaggggagtggacagaaaagggcccccagagagcacgccacctgagctgcatttggagcgcacatgtataggactatacctggagagagtgcaggcaaatggtgcatcaaacgcagcaagtccaggttgagttgtgatgcatttgaggagctgaagtaagtcaacatgaagaagatgaggctgaaaagtaggcagaggttttgttaactattttaggagcttgagccttattttacgatgatttatttggaagcgacttaaggagaacagaaatgatcacagttaggtttttaagagaagaatgaattggagcgtaggaggaaattgtatttataaagactggtaagaaggcttttgaggtaaatcagctgagaaatgatggtagcttgtactgtgcaagggtggagggagctaatggatatatttgaaagctacttagcaggtagactctgtaggacttggtgatttataggattggtgttggggagggtaggagaggaataaatcaagaatggaatctgggtttcgcatttggtcacgtgatagcagaagaaacaaggtcaggggaaagataagtctgctttagacatatttaattcaagatgattactgactttcaagctttcaagctgatatttccctgttctctaaatttaaaaacaagttatttatatatttattgacatcaattgacaattgccttttttgtgctgcttctgcactctgtgtagaccttataatacttctaacgctcctgggttataaactccttgaaaatagaggtaacttcttatatccctggagaatagtgccaggcatatagtgttaagcaaatgtttgaattaatgccactttattttgcttccttgtttatatgtcagtctccttgaagactgattctttaagcgtaaggacctcatggtgatctttgcatttccagtgccttctacagagcctgacccacagttagggttcagtaaacattgtttctattgttatttcatcgtcatcatcatctactatttaagtaccctcatatttttgttaatttttagtcctgggtgttaaatagtaataatctaaggttttgggttttttttagaatgtgatgtgagaatggggctcaatttcaattttagacatttaggtttaactttcataagccaagacttttaatgtaatgcaggctgacttagacattatttactgtgcttcatttcagatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagtaaggcttgtttaaaaaaaagcttgtaaatgattattgaataaggaaaatatcattccataacacccattacatttctattttatgtttgttagccaaatcacatttcccacctcagaaaaacgtaattttgattaaaagagattaacaaaatcccaacatattcataacttttatctttgtaaaaatagcataattcatttctaatcttctttaaattattgtgattgttagaggaattacatacatacttctggaacctgctcccccaccaaaaaaagtcttaattctggtgggagattatccagaattatcattaaaatttttgtcaataaagtcaaattaagagatttttttttctcattttttaatcagttttaatttgtttttgtttttgagacagagtctcactttgtcacccaggctggagtggagtgcagcagtatgatcttggctcactgcaacctctgcctcccaggttcaagtaattcttgtgcctcaacctccctagtagctggaattacaggtgcacgccaccatgcctgctaatttttgtatttttagtagagatgggatttcaccatgttggctgggctggtcttgaactcctgactccaagtgatcagcctgcctcagcctcccaaagtgctgggatttacaggcgtgagccactgcatctggcctgttctcctttttttaatgaattttcattccaaatagttgtagcacctacaaacattataagtgggaagagtactgaaatggcaaggactgactcaagttcttgaatgagtcgcgtgatccccatgaatgtgtttcctcatgtgtaaaatgggaatagcaggacctatcaaagagctattggagaaaccaatgtgacagttctttggaaaattatcagcaatattatacacacacacacacacacacacacacacacatatgctgttttcacttaatctgagttttcttattcctctaatccattattatttttctcaatccttataatattttccccatgcccaattaacacattcttccacgtgtagaaattcagtctcctgtcgccttgtctagtggctttcaaactttaatgtgtgtaagaaatacctgtgggacttactcaaaatgttgatctctgccaactttcctctcctccccatccccaagatttctgatgaaaaagaaaaaaggtctggaggtccggattttagtgagcaccctcagtgattgtgttgcaggtgttccctggaagacactgagaaacagactgttctaacctagatgctgccaacaattactgtaactaaaacatttctgtgacataaccatgctgttcagctattttatagtttcttattagaatgattaaaagatagagagaaacttagaaatactgatgcctgagccccacccccagagattcagattcagttagtctagacttaggagtttcacaaaagagcctggtgtaattctgatgtatacccagagttgagaactgacttgaaacatgaagagcatggcttatgtgtgagggcaaatactgtatattgtttatgcaatgcattgtgctatgggttttttttgttgttcattttgtttttgtagatggtcattaaatcttgattggttggttgattgatctaaactttaagctaattaaatcagaatctttggaggtgggaccctggcattttaaagcttatcagatgattccattatatagccagattgagaaattgctgaactaaactgatttgaactgtaatagtagtgccaaatttaagataccaatgagaaagttaaacctaagatcagtttgacagcaatgaggatccactggccctcatgtctgcctgacctgtgttctagaacctgcgtttcttctttttttcctccttctctcccttccttctttgctttctcttttgaaatctggattgattatctgaattaggtaacaatatactgtgtctaaaatgactttttgttagccattccacaatttatacatatttcaaaacatgttgtacatgataaatacagttgacccttgaacaacacaggtgtgaaggtccatttatactcagattttcctgtgcttctgccacccctgagacaggaagaccaacccctcctcctcctcctcctcctcctcctctttatgattttgttaataacattttcttttttctagattactttattgtaagaatacagtatagaattcatatggcatacaaaatagtgttagtcagccaggcacagtgactcatacctttaatcctaacactttgggaggctgaagcgggtggatcacttgaggtcaggagttcgagaccagcctggccaacatggcgaaaccctatctctactaaaaatacaaaaactagccaggcatggtggcgggcatgtaaaatcccatctactctggaggctgaggcaggagaattgcttgaaccctcggtggaggggcagaggttgcagcgagccgagatcgtaccacttcactgcagcatgggtgaaagagcaaaactccaagtcaaaaaagaaaaaaaattgttagtcaatctgtgtgttactggtaaggcttctggtcagtaataggccattagtagttaagtttttggaaaatcatatgtaaatttttgatttgattttctaacacccacattgttcaagggtcaactgtatatccaatttttgccaattaaaaaataatattaaataagtaaaagtaacttcactttttcctgatgcttcaggtgtctcatcttttgtgtgattttactgtaattttcttctctcccttcctgctccttcaaatttcaaattttcagtttcagtaagtcttaacaatagtttagttggccttgtactgctctcctgcattggtggcttgctttagattttttttttttttcctggtggtgtattgagtttatttgaacatgagatgtggttacatttcttcttgggtaaaatgactgtatcatttaacaataatctttgttgcatctgctatgaacagtaattacagtttgaagtacttgaaaatgtttgaaaataaaccagtgtgacttagctaaatctgcttggaaattataccatgtcttgatattttattaaaatatcaaaatatttcaattatgaacaaaaacttagaaacaaagctgttgtgaaatgcaaaggtgtttttgttctgttgcaggggattatttatttcgatctcagacagaggtcatgttagatcaattgtggataactggccagaaaatcatgttaaggtactaatagcacaaccctccttttcacaatgttttctcttttcttgtaaattacctctaaatctccaagaacagtttttcattgttgctctcatttattttgcacttatatacatgcagatttagtgctttgcagctgaagtgatgataatagtagtagttataaaatgggctactggtataaagtttgactctgagaaagaaattagagctagaatacaaggtgagccctctcggtatcagcaccactggtgtctcctgccttctcaatctccttttctatttcactaatattattctaggtaaagaaaatacattaaaatgccataaaaacttttgtttatgaatggtgttagagaagtttggttatgcctttttttcttttaaatctaagatttagaaccttagcaaatataaaaatgttaaatatagcaaatataagccctggcctatttagttatctttcataaaataaaatgtaataacttatttcaagatctttgggtaggcttttgtaaattttattgtaggcaataatcttacctgcctttatactcctttccaaaataaacattgaatgatcgttggtttgaatactctagcaaaaatttggtcaaataattaaactcacagtatcatcttaagaccttccttataagtaggtattttttttgttctagacctttttctttttcacagttgctaaggttttttttgtttggcctaggttattgtgttggagtaccatgctgtttatttctaaactcttatttttctcttatggtaatctctccatcagaatcttgttcatctctgccatatttaatctttctgaagatatttaagttggtcctctagtcagaagaattctattcctaaaccgaagtcagagggaaatcaaatctagttaatgtctcataatactcagaagtcctagaattttaagtatgctttgttggtttacattggaaattagccaagaaacaattttatttttaagagcaaagagtaaatatatatgaagtgaatcaatcttttaaaaaatgcttttctttagtgccccatttttgacaacttttaatttgcatttttttgtgattaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgtgagtaacatcattttccccctttatcttcctcctgtattttttaaaatgtgtacaatattccttttttgaaaatgataatttaagaagggaaagttttatgattagatttttttttcttaaactccacttttaatatttatataaataatagtaaattaagtctattaaaagtttcttggtccgggcatggtggctcatacctgtaatcccaggacattggaaggccgaggcaggcagatcaccaaaagtcaggagttcgagaccagcctggccaacatggtgaaacccagactctactaaaaatacaaaaaaaattagctgggcgtggtggcacatgcttgtaatcccagctacaaggctgaggcaagagaattgcttgaatgcaaaagacagaggttgcagtgagccgagatcacaccattgcactccagcctgggtgacaagagtgagactgtctcaaaaaagaaaaaataaagtttcttgtagggcaatacatttaaaaaattgtattagtaattttttattttgcaatttttattgtatgtgtttaaactgattatataaattattttatttttacatttggtttattttgtaggcactcttaaaagacccattttacatgggcttgtaccagaaacgagatcgcacacaacagtatgatgacctgattgatgagtttatgaaagctattactgacaggtattttttaaaagtttgagtatatgaaagcacctttaatggggtgggtggggtaagaaccaaagttttgttttgttttcctttatttctttcctgtgtagataagcaggaggcgattaaatttttgagaactttgttctgcctggctgtttctgcctgattagatgtgccgatatgaggtggtacccatggtctgccttgctttcttgagttacctgacattttgagggaagtctgccctcactgcttccatcaaacgcttactgctcagtacctttttcagccttgaccttcaggctcacgcccaccattccactgaagctcttgtgcagcttttgtattttaagttctctgaccattgggtcctcccacttctctacctctttgcaccgtcaactcaggttttcccacttctatgtccttgaaactctctcttctcttgactgctaaacagcttcctcctaacttggtctttctcccacctttctctttttttttttttttgtcatcttcacaggttcttgctgtctcttactaaatgtggataactacctagtcctcttctctttcagccatgtcaactatgacctttatgcatgttactactaaacccataaaaacccatctgtagttccactgctcttgtgaggcctgcatttctaataatcagaatcttccatctgggtattctgttatgagtgcatattcatatcccacactgaactcctttcctttccaaacaacctatcttctgtattcccagcttctattattggcagtaacattcatcctgttgccaaaactttgatcttagtgttatctttgactcttctgccttctccgtcagtcagatttcagatattcctcaaattcagtgggtactaccacttaaatgtctcctgttttccattgccgcaatcttgctctctccttatctctcttctggagttttctaattcttcctccagtttctctcctctccagttcgtctccaccttaataccagattaattgttttgaaacgtgtgcttcattttgtcattcttttgcttgaaatctctgattggtttcctattgccataggataaagtcaaactcttttaccttaatgatctaaccctggcctacctttaaaattgctggcacgtagaagatatttaaacattaattccttttcagagtcaaagtcaacaagtctaaagctgaactttacatcttctcagaaattgccatctctccttcttcctctcactttcctatcttggacaaccaaatagtaccttcttagttaccccattaccttcacattgtaacagcttcttcctcatttcccagttgatccttatcaatttctattcatcctaatagttcatagttactccttttgcttcctgcatcttctgcttcagatctcttgtcttcgtatcatagtagcctcctagttgcttctgccactcccgtctccccacaccaatatgagctacgtatcactggcaggtttatccttcctaaagggagtcatatgtgaatattttcctttctctgcagccttcactgtttctacatgggatgcagaagaaagtccctcttctctaatttagcattcgagatcctcccttatttggttccaacctgcattaaccaatttctcccttatctcttaatgtaaaccatgaaatatatagccagactgttgaaaattcagggtcaccctaataacagcctgcttttcttcctagctctttactttttgttctttcagggcccacctccttttcaagccttcccttactacttgagctcacctagacgattaacatcttctttttctgaatgtcagtgaactcaaatagcaattatttttcaatttcttatttaatatatactttcttgtgttgctgtttaactattaatgtaatgagaatatacatatcaaatatatattttttgaggttcagagtcaaaggaagtgtcctcctggacacttgaaaatagtttacatagattgatagcccatgggtttatcattgtgccacattctttttaaacacctcatactttttttattgaataatttctacattttggatctagtctttcacaggctctgaaatttttcagatggccttaattgaactaacataatacattatttttgaatgctatcatagggaatattaggtggaaagctgtttaatagtgttattttcaacacaactattgtgggttttgctgtttttagatatggccggaacacactcattcagttcgaagactttggaaatcataatgcattcaggttcttgagaaagtaccgagaaaaatattgtactttcaatgatgatattcaaggtaaagcaaaaaaacttcagggttttgattcctactttttaaacatttttaatgtgcccattttttatttgtaaaaatctttgtttttcttacagggacagctgcagtagctctagcaggtcttcttgcagcacaaaaagttattagtaaaccaatctccgaacacaaaatcttattccttggagcaggagaggtaagttttgaaggctttttgaaacttaagcctatcctctcttatagaattagaaaatgggcagaatattgatgtttatgaaagagcatagtgagcctgtaattttgttgaggtagaggatatgaaatcaagagttctgctgtaaaacatgtaatttaaaatatgtttcgagagaatatcacgaagaatttttgtttgatttgtaagggaaaaataaaccaaatatttcttatggcatataatcttcatatataaagtaattcaagcattgcatcgtactctagtatatattaaaatttatgttttgttgaacaggctgctcttggaattgcaaatcttatagttatgtctatggtagaaaatggcctgtcagaacaagaggcacaaaagaaaatctggatgtttgacaagtatggtttattagttaaggtaaggtatttaaaatttggagaagcaaaagagtgtattatatttttagttggatttttaaaatattattccttaaaatcttgtttctcattggagtctccaaattataccaattgggaccttccactctcttttcaacagatgtccctagtcttgttgtcttttacaaagacttctgcttcatattgaattaataatctctatgttggcatcagacttactctttcttgctttgttgtcttgctcttaagagatcaaatggccattgtacaagtatgatcgtgtttgacactcctaaaactaggtttttagtaggaactgagaacttcctaattaaattgcagtattgcagtagttttgatatttgagcagaaattcttttaattttattattatttattttttttgagatgaagtctctctctgtcacccaggctggagtgcagtggtgcgatgtcacctcgctgcaacttctgcctcctgggttcaagcaattctcctgcctgagcctcccgaggctaccgtgcctggccgtgagcagaaattcttaaccctttggagatcataatcccctgaagaaatctaataaaaatctgtggaccctatccccaggaaaaaagcatgtgctcctgaaaccaatttatggataataaagagcttatctcccagattaacttagtacctttgggcctgactacctttgttagcattgattaccattttcactagcttaagaatgtcatatatcttctgtgtaacacattgaatataagtaaactgttccatagttaaaccaatccagtacacaatgctgttatatttttgtatgtacacattaaaatataatggtatagctgtcgcttggcatttatgtctgtggagcaagctatctaaatgtactttgttccagttctaaaatcttttcttgttaattagaaccagtattctattagtacaaaaaataaaatgaaaagttaaagtatgtgaatgaaaaatcttgagtgctcaaactacatgtaatttaaaatgtaatagtagttatataccagacattgttataagactttacatgtattatctcctttaatcatctcaaaaaatcctgtgaagttttacaaatgaagaaacagtttaaaaggtcgagggagttttccaaagtcatcagcttataagtgacggaggtaggattcaaaaccaagtatcctgactgcgaagcctgtgctctgaataattaaactgtgctgcctcccaaagaggctgtaactaccatatttactagtatgtaaggcacaaggataaaacatcacatatttagaaggctattgggggatgtatgttttgactagtacacagttagtttggtacttctttttgtaatgttggttttcatcaaatatgttgtgattctttagcatattggtaggtcaggtctaacacagtattggtagctacaatgtgtttacttagcacaaagtgagaaccctgtccatctccatattcatcatcagattatatatttcttttccagtgtgcaggtagcttggcctatgggcattaggcttccagtgtctcctggtgatcctaaacactgcccttcattttgaaactttgaaaacagtggcttcttatgtcactgtttgctcagcctggttttctcagccgattgatgatagtgtcctgctttactaacccctgcagtttcttatctggagttatcttggagttctgatggaaatacactttttcagaagtcttcttttttaccaaaataagaatatgagttctcagttggtttttgcattcagtatgtttttgtctgccttaaatctttgagaaattcttcattgttctagtctgtcagtggtatctcttctggctttgtggcattactacaaatttaacttttatggtttttgacctgggatttggaaaggaaagcatgtttcttcattcagccatctttaaccagaattccctgttcctcttgtttctgaactcttggtagtgcaagtccatggtgtctgtctgcaattctgaaatcctaaaggctttgaaattccaaaattttttccaaaatttatttttgtgaccaatctgattgccttgaatttacctagaagcgaaacctgactcaaactaataagaagctctttgtaatcttaaccttttgtacttgatgtgactattcataagtttgttcagttgtggagtatctgttgggagggagaatatgtaatatttgatatacgccatattgtatttctaaaatatgaaaaattctcagccaggagtggtggctcatgcatgtggtggctcagcttcccactttgggaagctgaggtggacggatcacttgagcccaggagtttgagaccagcctgggcaagatggcaaaaccccatctctacaaaaaaatcatccgggcatggtggtgtgtgcccatagttccagctactctggaggctgaggtgggaggatcacctgagcccggggaggtagaggctgccactgcactcaagtctgggcgacagagtgataccccatttcaaaataaataaatcaaattaaattaaatatgaaaatttcttaattccaaaactcatctaccccagataaaggactgtaggcttttgtgccacattggacttaggaagacctcatagtgtaaatgcatttttgagaggaactagaaagtttctaggaataatggtagatttgatttttgttttatatttgagtttatggacatgatgaagatagagttggaaggtatgggttgaagaggaaagtaaatgaaaatgaaaagacatttctattgtagaaacaatgtgtaactcataatgatgtctttttatttcatctttaatatgcattgactaaaaaaatactgtattttatctcaaaatttagggacggaaagcaaaaatagatagttatcaggaaccatttactcactcagccccagagagcatacctgatacttttgaagatgcagtgaatatactgaagccttcaactataattggtaggtaaagtttttctgataaataattttactccctaactgtatgttgccagtcatcattaccatgtaggattactaaaaatgaattggcagttttacctagctttcagcatgtacaatgttttctgtgataactttttggttaccatgcatgaaattcagttaccagatgttgctttatacttttaggtcctagacactgtgtagtcgatcatgatttgcttttagagttggtatgactgttggactcaaaacatgaaaaaaaccaaagccatttgcagattttaccaggaaaattctatgcagactcaaagttttcgtgggcaacaaagctgaaaactttgagtgtgttttgaatcaggcattgcatagatgccatcagactatgtcatcatggcattacattctcagcagaaaatgtaaaagtgtttaaaagaggagctatttaatttgctgtatagctgtaagtttttttgttttcttgttttttgtttttttttttgagacagagtctcactctgtcactcaagctggagttggctcactgcaacttccacctcccgggttcaagcaattctcttgccccagcctcccaagtagctgggattacaggtacccgccaccacgcccagctaatttttgtaattttagtagagatggggtttcaccatgttgaccaggctggtcttgaactcctgacctcaggtgatccacctgcctcggcgggtgagactccatctcaaaaaataaataaataaaaataaacaaccccccattttccccactccccaccccctaacaaccaccattctactttttgtctctatgaatttaactacctcatataaatggaatgacatggtatttttctctttgtgactggctaattttatttagcataatgtcaagtttcatccatgtggtagcaagttttatcttcccaattagagtgatgaagatagtcatatactctttttaaaaattggttgggcatggtggctcacacctgtaattccagcactctgggaggccgaggcaggcggatcacctgaggtcaggagtttgagactagcctggccaacatggcaaaaccccatctctactaaaaatacaaaaattagccgggcgtggtggcacacacctttaatcccagctacctgggaaggtgaggcacgagaatcacttgaacccaggagggagaggttgcagtgagctgagattgtgccactacactccagtctgggcgacagagcgagactctgtctcaaaaaacaaaaagttaaaagaataaaatttcccataatttactatgtgtatagtagacaataaatatttaagtgagaactttcagcatcttactgttttttcttttcagatttgagattgtgttctcatagattttgcattgctgagatagtgctatctttgtaatgagatattacctgtgtttttattattgtaggcctattgtagaaatgctattgataagcattgcttttatacctataatgaagttgctgtttttcccccttacttattacaggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagaggtattaataatcacatgaattgatatgtatattattttccctccactagcttattagttatacattcttacaccattgttctaatggtttccctagagattacagcatgcatctatgggtgatcaaagtctgatattaattattgcttataccaattatgggaaacaggtactttataactccactgtaatgccctcacactgtttgcactattgttgtgaattttaattttctatgtattttaaactcaaaatacattattgttatattttacaaaaattattcagatttacctacactttaatttatttatcactattcttcctgcaagtgcttctacctaggatcattttccttctaccagaagaattcctttatttaagtgtaggtctaatgaattctcttggtaatttattttgccttcattttgaaggatattttcactctgcatagacgtaaaagttggtaaatacttgagcattttgaagatatcattttactgttttctgacttttgttttctttttgatgatatagcattgtcttaggtttttaacagtttgactatggcggacatatgcgtggttttctttgtatttattccacatggggattatactgctcctgaatctatggcttgatgtctgtttttggtttttgttttttctgttttgaaaaaatatcagccagtatctctactttggccacattgtctctctcatcttatgggactctaattatatggttagagatatatctcatttatcttttacactgttttctatatttactatctctcttgctttctgtgtttcaatctggtgatttcctttggccctattttccagtttgcagattctctgttcagctgtgctcatctgttgttaggttcttaattttagttgctgtattttttcatttgtagaatttgtgttttatctgtatagtaatttattaatttagtaacagacttaaaatcatgtactgtagaaataatcaatctctaaatactgctttcttgtactcacatttcatgaaactttttactctcttcaaatgcatcttcaccatcagtgtttgtcttttctaaggctgttttttttgagtcatctggcgctgtggagaacaaatttttatttacatccgaactgtttaagattcactacttttagatctttgacactaccacgggattatagcccaattacaaatatctgcctataaatcacttgacatttgggtttttttcctaccattctgtaaggatgtagttgtaatctccacaattactttctatattgttgtggtaagtgatctaagtggctctaggaagtgatttttaaaggcttgtttacaatgatgtctagcagctataattgctagactacatccttgagagtaagtaataaatctgatacatttttttaatcttcactcctttaaaacaacgttttttatagtagaaaagtattacagtgtatctctcaaaagctaaggattcttttaaaaatataaccacagggccgggcacggtggctcacgcctgtaatcccagcactttgggaggctgaggtgggcagatcacgaggtcaggagatcgagaccatcctggctaacatagtgaaaccccgtctctactaaaaatacaaaaaaaattagccagatgtggtggcgggtgcctttagtcccagctgctggggaggctgaggcaggagaatggtgtgaacccacgaggcggagcttgcattgagccgagatcgcaccactgcactccagcctgggtgacagagcaagactccatctcaaaaaaaaccccaaaaaaccatatatatatatatatatatatatatatatacacaccacagtactgttatacctcataatttgaacaataattatatcttgtcatttaattttttttttttttttttttttgagacagggtctctcttggttgcccaggctggagtgtagtggcacagtcatagctcactgcagactccaattcctggctcaagtaatcctcttgcctcagcttcctcagtagctgggactacaggcaaataccaccacacccagctaattttttaatttttatttttgtagagacaaggtcttgctttgttggccaggctggtctcaaattgctgacctcaagtgatcccctgcctcagcctcccaaagtgctgggattacagacatgagccactgtgccccacctaatttcttgaatatgtgaattgcaattaaaattttctgatggtaacaaatatctcactcatttttattatctatcttttgttctgtcttggttatcaggtttgtttgtaaggctaatttgtccttttttttttctttttttttttgagatgaagcgtcactgtgttgcccaggctagagtgcagtggcgtcatctcacctcactgcaaactctgcctcccaggttcacatcattctcctgcctcagcctcccgagtagctgggtgcccgccaccatgcccggctaatttttttgtatttttagtagatatggggttttaccatgttagccaggatggtctcgatttcctgaccttgtgatccgcccgcctcggcctcccaaagtgctgggattacaggcatgagccactgcgcccggactgtttttgtttttcttaattgagtgatggatagtgtagaaaaagaactatagcaataatttaaggctgtggataaagttatttttggagaaagggactttactttttcaagtagatcgccataatccagtcaggatgtggtccacatgaggcctggggtatttccagtttgccctttctcctgatatccacccctttgggtatgaatcatcaaaagtcctgaggtatttatcagcacctctcatccttaacggtccctgaacatccattttcctctctgtcatcatgagactttgggtggctttgctgttcagggtctcagtcacagcttttgatttggaaatcagcagtcatcttgaggggaagagcttcaaatgctaggctcatatatcttgcttccctcttcttttgaatcttggaaacctctcttccccaacaccaaactctcactatcttgttaggtctctgcttgcttacaaaaatttttaaaaatgtattttatctggttttttaaattgtaaccagaggaaaatttggtatgaaacaacccagaaaatcattgccaaagcagaactctcagaacttcctgaacttaatattcatacttttgatatatttggcattcttttttttttttttcccattgttaaacactgtgtaggccaggcacagtggttcatgcctgtaatcccagcactttggaatgccaaggtgggcagaccacttgaggccaggagttcaagatctgcctggccaactaaaaatacaggtgaaaccctgtctctactaaaaatacaaaaaaattagccaggtgtggtggctcacacctgtagtcccagctactcaggaggctgaggctggagaatagtctgaacccaggaggcagaggctgtgtgagccaagatcgtgccactgcactccagcctgggcaacagagcaagactgtctcaaaaaaaaaaaaaaaaccaacaaaaaaacaacctttatgttgacacatgtattctctcaaaattcctttttgacctttttgaccactccattagtcaaaataaattctcatgactgttagtttccaattgatataataattattgaaatctcttcttctaaatcaatcacaaaatcaccatacagatatttaaaaattagtctctttagtatactgtcttatctttttattacttttagcttgattgcctgtcctcttcaccaggttttactacttaaaactaatggttattgttccccaaattaaatcttagtcttctacaatgactcttgggtaaatatattaaatgcatcatggatcgttgacatttccaaaatataaaaaatttaagtgtttcgagtagtagtggtatatcaccagaagactgctcatttaagaattttgttttttgtataaatattattgtaataaatgtactttattggaataaataaaaattccccaaggagactagtttgatatactatatttcatcagttttaagatcaaggattgcttgagcccatgagtttgagaccagcctaggcaacgtagcgaaaccctgtctgtataaaaaatttaaaaattagccaagcatggtggcgcacacctgtggtcttagctacttgggaggctgaggtgggaggattgcttgagcccaggaggttgaggctgcagtgagctgtgatcgtgccactgaactccagcctgggcaacagaatgagaccccgtctcaaaaataaataaataaaaagagcatggtgtcatagtttacttttacataaattctttcttagtgttacatgaaataatggcatagaattttgactagtcgtcacctgttaaatttttagtcccattttgttttcaccagggaggtgttactccaacaccgtttgctgctcagcgagaaaaatactctaaaaaaaaatcttcatagttgaattgccagctgcttacatagaccaagttggacttcagaataagaatatactattatcattaaaatctggccacgtttaagccatggattaattattgagttaaatgggcagggaggcagggatggtgacctggagaacgtgaactgctatagaatcttgtcattattgaagagattcccaagatctttctaaatttccaaacttactgataccatgagaacattttttccatgatgtgctatattgtataatctaccttataagactattaaaattaatggtgccagaaaaataattatgtacttattgtgataacatgtatgacattaaccatgaactaaccttaatcatcaaagaaacaaaatttttagtcacaagtaatgtttagaacagatagataattgtaatagctatccatagaataggtagaaaatgatataacaatatagagttgcaagtctaagatagtcagctctgccctactagcatagttagcttgcttctactcttaaaccttgtatcattttgaaatggaaagtatgtcttgtaaaagtagtggttactctgcattattgaccttcagattacctggagtcaaattcttgaatgttaaatccactaaagccaagggtctacaatgctataaagaataataacacaattaattctcttagaaatactgaatatgccagtaacatttattatatgccattatagagcatagtatcaaaattggatagatgtgacaaatttggagaagtattcttctttaacaaggcatcaggccatttgttttcctggagtgatactgtggtcatgccacatgcctgtgttataaactgcctactgctgggtattatagcatcattgaaaacctgtggctatggagttacaaaaaaatctagattaagatttaactactacagttttgatgtgtgacttttgacaaagtatttgaaaatattaaagccttagttttctgattttttaaaattagtgaaatggagatgatgatgaagttttcatgatggcaaaattaactgagttaaacacatataaagcacttggtaattagttttagcggatatatagtaaatgacagccatttgttttggtatttccccttcattcatcagtgtttatattggtctttataatatggaatggtatttattggccgtctacattttaaatttcttttttttttctttttcttttttttttgagatggagtctcgctctgttgcccaggctggagtgcagtggcgtgctatcggctcactgcaacctctgcctcctgggttcaagtgattctcccgcctcaggctcctgagtagctgagattacaggcatgggccaacacacccagctaattttttgtattttttgtattttttgtagagataggggtttcactctgttccaggccatctcaaactcctggcctccagtgatctgcccaccttggcctcccaaagtgctgggactgcaggtgtaagcttctgtgcctggccttaaatttcttaaaaataagtgtctggtttttaaatttttagtaataaatgatttttaactttattatttatttattgaatgtatactacacatgaaacaaacctcattctaacaaaaggattgtaacgaaaagattgttatatagtatattatgccttgcttccaagtaatatattggtctattttacttcaggacttgattttgtatgaattcacctcaattttctcatccacagaaaataacaaaattgaagttatttcattttattaacagggcaggtgtttgtttgccagtggcagtccatttgggccagtgaaacttacagatgggcgagtctttacaccaggtcaaggaaacaatgtttatatttttccaggtaaatgccaccattatttatgttatagagcaatagttaattatgtaaaaatacttaatggaattctttggaatgggagactgaactgagcaacagtattacagaattttggtataaatgtacaaggaaactcaaggaattcatcaaattcagcatgctccactttctctgaaaatttattcatattgttaattaaatttgtttttattatagaaataatatattgcatgatttgtaaaaatgcagaggaacagaatggcacaaaattatgtaaccctttctatctccccttggtgtacctccttaatcatacttctcagaaccattgtcaataatttgctgggagttcttctgatggttaccatcgtgactgatagatttatttcccaggttcaagcagttcccctgcctcagcctcccgagtatctgggactacaggcatgcaccaccacactcagctaatttttgtatttttagtagagatggggtttcaccatgttgaccaggctggtctcgaactcctgacctcaggtgttctgcccatcccaaagtgctgggattacaggtgtgagccaccacgcccagccaggtgttcttattttgtaagatacacccagtatactggtatcacaccaaaggaaattaataataattgcttaatatcgtttatcattacctcagttcaacaacttatttttattcccaataccttttttattctagaattgctctttctaaatagctacttttaaagcaaaaatggttacagtactcattgagctttttctggagaattattaggattcctttcaatgtttctgcctttgtgctgtattttccataaatttctagtgatcctcagttgtctctttcttttaagcaagactgtgttgagtaaaacaggaattttgtatgattttcttttgcacttgtgtcttttttcttctggtaggtctttccctgactagctgacagcaggctctaattaagatatgacaagtttatataggctggcatcaggcaagcatgtataactgttgtcaaagtaaagagggtatttagtctgtgaatatcctggtacttttctatatttttctccttttttttgcccctcatgttttcctatatgtctcttgagacctaacttctataatagaaactgtcctgtcatccataatctctttctagaacttgataatgttcaaaattaatgtgttctattcagtaacatttctatggcctaaaagacatgagggcaggaaaggaaatacttttctgctgattttaacaaagctatttttttaaactttttttttttagttccaggggtacatatgaaggtttgttatataggtaaattgtgtgttgcagggggtttcatgtatagattatttcatcacccggctaataagcatgctacccgataggtagttgtttgatccttaccctcttcccgccctctacccttaagtaggccccagtgtctgttgttcccttctttgtgtccatgagttcttatcacttagctccacttgcaagtgagaacatacggcatttggttttctgttcctgtgttagttcacttaggataatagcctccagctccatgcatgttactgcaaaggacgtgatctcattcatttttttggctgcatagtatttttttttatttatacacatggtgtatatgtgccacatttactttatccagtttaccattgatgggcatttagattaattctatgtctttactattgtgaatagtgctgcagtgaacatacacatgcatgtgtctttatggtagaatgatttatattcctttgagtatatacccaataataggattgctgggtcgaatggttgttctaaattcagcaaaaccatattttatatcatatctgagtattaaggaatttagcagttgattatttttatataacactttaaaatcctaacttaaataacagctatggataccataaatatagacattaaaaatgacctggtcaggcatggtggctctcgcctgtaatcccaacattttgggaggccgaggcaggaggattgcttgaggccagaagtttgacaccagcctgggcaacatagtgagaccttgtttcttccaaaaattaaaaaaattaaccaggtgtagtggtgcacacccctattcccagctagtcaggaggctgagatggaaggatcgcatgagcctgggaggtccaggctgcagtgagccatcatcatgccagtgcactccagcctgggcaacaaagtgagactgtctcaaaaaaataaaataaaatgacctggcatttgaggcagaaatgagcctaaaagcaggaggattggctgaaagtctgtttataaagcaacttaaaaaaaaaactgttaatatttgaatgacctagttgagcaactataacaaccggatgaaaattttttttaagactttaaaagggtcaaagggataagatattgactctaatggaatattggagaattctggaccaaggttagggagggaacaaatgcacagaacaagcttttgaagccagttttacagtggaaatatagaccaggaagaaagtggctaagaggtacagctgtgcttttcatggaaagtggacaagatcggcaccatgtccgagtctggcactacctcccactctggactgaaaccctaaagtgctgtaccttggattgggggtatagtttgcagcagcaatgggtgatttagaaaacctcaagcctctgttcgggactgccagtgcccacaagtgcccagcggaagcaaacaaaaatttctctgaaataagataatggcatcctagtcctcaaattatttttataaattttcaagtacaacctaagtagaaaaataaaaaaaaagataatgaggcacataaagagacataacaacagaagccaaaaccagcaaaaacaagaaaaacagacacactgaaaccctggatataccgtaaatgctatgaaacaaatatgcttattatgtttatagagataaaagccaatcttaaaaacttaagacaagtaccactaaattctagaattgaaaaatgtagtagtctataagaactgagtgagctgggtgtagtggctcatgcctgtaatcccagcactttgcgagaccaaggtggaagaattgcttgagcccaggagtttgagaccagccctggcaacgtagtgagacccccatctctataaaattaaaaaaaaaaaaaaaattagccaggcatagtggcatatgcctgtagtcctagctattcaggaggctgagatgggaagatcactcgagcttgggaggtcaaggctggagtgagtcatgattgggccactgcactccagcctgggtgacagagcaagaccctgtctcaaaaaaaaaaaaaaaaaaaaagagtgaatgaggcttatggcagattagaccagagagaattaatcaactggaaaatatctcagaagaagcaatccagaatgcagcacagagagaccaaaaagaaaaaaaaataggtaagggacatacatttcattgatagatctttaattgaagtcctagaagaaatgagaatgaagcagaggcaacatgtgccggcctcatggctgagttttttttttagaactggtgattgacaatcaatattcaaaaagctcacagaaacccatgtgggatgcataaaaagaaatctacatctaggaacattattgtgaggcttcagaatcaccacaaagagaagaatatgaaagcagtcagaacaaaaagatttccttcaaagaagcgaccgttagactgacagcagactcctcagtgacaataagataccaaggcagtggtaatgacctattaaagttgcttatgggaaatacttgccaacctagaattcattacacagtgaaaatatccttcaagaattaaagcaaaatgaagacatttttcagaaaaacaaaaaaccggggattcaccacctggcagactgtttttatattaaaggaaaggaaattttgttccttagggaaaaagaaaataatcccacatagaaaccctaaggtgtaggaaggaatgaaaagcaaagaaagttatgaataagtgggtgggtacaacaaaatgaatgttgtttatatagagtgaaacaaacatcacatgggattttgaaaaatatatatagagagaattaaaatgcacaacaacaatagctccgttaaatagagttaagctgttatgtgggacttacattgattgacaggaaggtaaattaaaaattataatgtggagctggggacattggctcacacccataatcccagcactttgggatgtcaagatgggaggatcacttgaggccaagagtttgagactagccctggcaacatagggagactctgtctctacacacacaaaaaaaatttaactagccaggtgtggtgacatgtgcctgtagtcccagctactccagacaccgaggacagatgatcacttgagcctaggagtttgaggttacagcaagctttggtcgtgccacagcactgtagcctgggcaatagagcgagaccctgtctcaaaaaaaaatttaatgtagaacgttggtggttaaagatgcatgatataaattttaggataaccattaaaacactacaaagacttcctgtttatggtaaggtaatgttgggatgaaatgaaacaacaaaaatccgaaaagcaagaaaaaagaggaaaaggaacataggcaagacaagatgagatgagagtgatgagactaaatgtttgggggctaaatctgccccaattacttgaaaaaaaaaaaactaaaagtaaaagtaaaaaccacattaaatctaaatggaccacattctctacttaaaaaaatgctattaaccatgtgatcttctcagtcatgaggtaatctggtgactacccttcctcaaagccagttgggatattctttgaatagagtaaaacagtgtttctaggctgggagacaccagacatagttgaggacagaggtgctagaaaataggaagtttaaaagcatgtgcggtgatgctcagaggaggtaaaccccaccctcatgctcatagcttccaatcattttctctagttcttaactcttaaatgtgagaaatgcttgaagattactagtcatctgaagaaagtctctttattaaagattttcataaaagagaccaaagcagacaaacagaaaaagacatcttggggaaaaaaacaaggataatgggaagagaaggaaagttttaaaaattatcaatatcctcagggggacaaaatattatatcctataaagacagatttttattttttaaaaaaatagaaagcaaaacaagctcctaaaaataaagtttgatagcagaaagaagaaaaagatgagttaagtcacctaaaaagagagcaaaggacaggagaaggaaaataaagaaaattagagagccaatccaagaggtacaatatcagaaaatataaatgtcagggaacaagaacagaaaaatggagggaagtgaatcctcaagacttcatgaacatttcccaaaactgaaagactcgtgttttcagataggaagcgcctactcactgaatgctaaacatgatgaattaaaataatgcacatcaaggcacagtgttatgaaattgtagaccgttaggtataaaaataaggatctggctgggcacagtggctcatgcctgtaatcccagcactttgggaggctgaggcaagaggattgcatgagtccagaagtttgaaaccagcctgggcaacatagtaaaaccctgtctctacaaaaaataaaaaaattagccaggtgcgatggtacatgcctgtaatcccagctactcaggaagctgaggtaggaggatcgcttgagtccagggaggttgaggttgcagtgagcttgtgccactgtactccagcctgagtgacagagcgagaccctgttgccaaaaaaatttttttttaaaagggatcctacatgcatccagagattaaacgaaaacaatcacctgaaaaggctctgaactcagattgatgcttctcaccagcactggaagctagatggtattggaataatacctcacagttctgaaggaaaaatatttccaagccagaattctaaacctagacaaactatcaaatataagtagaaagaagtaaacaaacacattttcagaaatgcaagatttcaaaaaatatatatctcccatgcactgttcttcagaaagccttgggagaatgtaccctaccaaaagagggagtaataaactaggaaaagttgtatttgggaaatggaatcaacttagaaagaagcaaagaggcctgtaatgataaaggggttttctaggatgacagctccatagctggaatgggggacaaccagaccagaatggagctttagtagatatattctagagcaggaaattcgagaatatataaagtagctaaaatagaagaaaatgtagacaattgagtgagagttcaagggtgaaataacaatgttaaatactaaaaaatcaaagtaaaggaaaaaggacaattattaacttcaggaaagacaaagttatgcagaaaaggaaaagtaaccatgatataaacattgaatattgattgaaccacaattatgctctaactatattgggaagaagaaagaaagctgaaaatatgaaagagcgctaaatatttactcctacaggaaagagtcagtgatctccaaaacagaaaatgcaagatcagcacaataagagaaggcaaaaaaaaaaagaaaaaaaaaaagagagagagagagaaaaaaaaatcacaagaaacataagttatttaagagtgagagagagaaacaatcagctaaaaaaaattgtcattgcctctgtagagcaagaagtggagtgttagaggtgggctgggaactggagttaaaacaagcgttgatgaattgtatgtatttgtcattttcataaatgtaaaaactaaactgagaaaagccatttgatatttctgaaattacttagcgaataagaattattaaagatcgtttgattttaactcagatttctgtttcttcttggctgttttctgtttggggggagctgtttgcgatgtggatggattaccatttatttgcctgaatataggaatttacttctttcataatttgaaaagtgaccatactagtaaactttaaaatgtgttctaggtgtggctttagctgttattctctgtaacacccggcatattagtgacagtgttttcctagaagctgcaaaggtaaatgttttaaatgttgtttattttataaaggatgaattataaagatgagtagatctgaaaattaaaggcagagagagaatgggttaaatctgccttattaatgaaaaggaagttactcaaattacttttatgatttgcctatttatgcataaaattaatttttttaatcatgacttaaatttttgtaaactgaatcctctcgttttaataacacttagactatacttgcaatttgtatatctgaatatattgtgacagcatagataactccttgcatgtttttaatggacaagtactggtattatttggagtgctggcctatgggagctccagactttgaagtatttctgaagaactcacattaatacaattaatgtctgttttcaaagtagccattgcaattaagccaagctctacatgtgtaatataaagcagaatataatcaataagtctttaaatctggttatttattgtttagtgatgaacagttttaatttctgcagtggtttaagtgtattccttcaagaaataagaggaattatattacctgttttactctctgtttccccaatgctttttccatttactgggtccttattctgttatttaaacaaacaaaagcaaaatgctgtttttctcttcaggccctgacaagccaattgacagatgaagagctagcccaagggagactttacccaccgcttgctaatattcaggaagtttctattaacattgctattaaagtaagtaataacttaaacttcttcacattaattttaatgacattttcttatacaagaaatacaggtttattaagataaatctgaaacatttagaaggctgcaaagaagaaattttaggcccatattcttactaccagaatataacacacatgattattttgggtttgttgccttctagtcttttttctttgcaaacacatacatgcatacacacatgcatgtagtcacttgtgcctttttgaaaaattgttttaaagaatagagataggggtcttcctgtgttgcccaggctggtctctaaccccttggcctgaagcgatcctcctgccttggactcccacagtgcttggattactggcatgagccacagcacctggcctgtgcccattcttataattggtttcttactgcactttttccccttaatatattgtaagtcttttccatgtaacttaataataattctcatgtatgtgatcattaatgctgcatggcattctctttattattttttcaaaatttgtttcatcatttctctgtttttggacatttaagtttttagcttcttattgttagaaataacactgtaggctgggcgcagtggcttacacctgtaatcccagcattttgggaggccgaagcaggtggaacatctgaggtcaggagttcgagaccagcccagccaacatggtgaaaccccgtctctactaaaaatacaaaaaaagttagccaggcatggtggtgggcacctgtaatcccagctactctggaggctgaggcaggagaatcacttgaacctgggagaaggaggttgcagtgagctgagatcgtgccattgcactccagcctgggccacaagagcaaaactccatctcaaaaaaaaaaaaaaaaaaagaaagaaagaaataacagcgtaatgaacatctgtctttacagataaatctttgtgtgtatttgtgatggtttctttttttttttttttttttttttttttttttgagacagagtcttgctctgtcacccaggcttgagtgcagtggcggaatctcagctcacggctcactgcaacctctgcctcccaggtttaaacaactctcctgcctcagcctcccaagtagctgggattacagatgcccaccaccatgcccagctaattttttgtatttttagtagagacggggtttcaccatgttggtcaggctggtctcgaactcctgacctcaggtgatccaccggccctggcctctcaaactgctgggattacaggcgtgagccaccacgcccgggctgtgatggttttttttttttttgggataaattctaagcttaagaacaaaggtttttaaggtgttttaaggcttctgatgcatattgtcaaatgagctcttcagaaaaagtactgatttacattgcagcaattagatatgagtgtatctttttccacactttttccaatacttagaattatttttttaatcttgcatatttaataggtaaaattgtttctcattattaaggcattattagtgagattgaagaattaatatatatatattaagtgtatatatactgtttgctgtggtgcagatattttcccacttgtcatttgttttaactttatagaattgtttgacatgtcttttaaaagttttttatggaattatttgtttattttgtggattctctcctcaccttttatgaatattaatgccttctgtcactccaaaatcataactgtctacttgcattttctaaaataaaacttttttaatctctctgggatttattttaatgtatgatatgagaaagggaaacattttttcctgagtagttaaccagttgccccagcattatttattgattaatgcgtccgttgtttacagttaattgggaattgaatctgttcctgggatttctattcctgaccatttttgtttactatctgacactgttttaaattttataatgtgtataatgtaacatttagtactttatctttcccatcattatgctttttcagtgttttcttgactgttctaaattgttttcttctggacaagtttttgtatctgcttttttaattttaaaaaactctgcaactttgtatgaaattgttgcatttataaattggtgaagttgggtctttcagtattgagtattctccaatcactatctctctttacttattaagatcttttttaaaaagtgtttcagtataattttgttttcttcatctgaatatggcatttttacttttttctaaatatttttaaatttctgtttttctaacaaagacttttttttctttccaagtatcttctcattgatcatttctaatatataggaaaaggtaggaataatactaatttgaaaacattcatttttatgaatttacttgatgaccagttttttgaacaatcttattttaatagtttttcatttcatttggaattgttgagtttttaattgtctgcaagtaattttttctttttttaatatgcatagtccgtttttctctaactataaatcagctgaaactgcagaatagtcttaagcaattaggttgataagggtattcttgtatttttttttcaatttagagacagagtctatgttgccaagctgatctcaaactcctaggctcaagtgatccttctaccacagcctcccgagtagctagaggcacatgccaccacacctggctaacatctttgtatgttaatattaaatatgatgctagcttttgattgaaataagtattttctactttttaaaagaagtagtcttctatttctagattactaagatttttcttaaacattaggattgactgtggaatttatcagccacaatttcaacttccatacagttgatcataaaattttatcattttgactattaaatttatttatttatttatttatttattttgaggccgagttttactctgtcacccaggttggagtgcagcgacgtgatctcagctcactgcaacctctgcctcccaggctcaagcgatcttcccacctcagcctcccgagtagctgggaccacaggcatgcaccatcatgtccagctaattgttttttgcatttttggtacagatgggggtttgcattgttgcccagactggtctcaaactcctgagctcaggagatctgcccaccttggcctcccaaagtgctgggattatagatgtgagccactgtggccagctttgactattaattttattattacattattttggtgcctgtaacctaagcaaagattgggaattggtaaaggatggtatgttcagggaataatagttgagcctgggggaacaggtagggaaatggcatggaagaaaatttgaaagttatattaaagccagctgtacaaatatacaaatgccaggctaaggagtatgattaccttctactgcaaaacagttgaagattttagagcccagaactaggatgatagagtccaactttagaatttatagaatgatattacaggtgggagagattttggaagatattagtcagttaagagattactgggccaggcagagtggctcactcctgtaatcacagcactttcaaaggccaaggcaggaggatgacttgaggctgtaagtttaagaccatccctggacaacaaagcaagatctcatctctaccaaaaaaaaaattagccgggcacagtgatatgtgcctgtagtcccacctactcaggaggctggggtgggaggatcacttaaacacaggaggccaaggctgcagtgagctatgatcataccactgcactccagtgtgggtgacagagcaagaccctgtctctaagaaagaaaaaagagagagaaataattggtatatccaaatgagaggtagtacatgaggtcatagaaggagacctctgcttaggattagtatagcaacagaggcccaggttcatgtctctgcgtttccccagaggcaggagtagagagtgtgctgtgtctgcagtggcataggcttttctttttaggagcaaataaggaagtggtgagtagaggaggcagagctttgtgtctgtccccaccccaaatagccactgattcacccctttggctctatgagcagggctgtgtgtgctcctctgacagccaccagtcaccttctgcatgcctccaggaccaaggggagctttctccaatctcatgccttgcccgtaatctttttctgtggttactaccagcctgtgggaaagagatttgcagtgagtgtgagccccccttatgtctaaagcttgcagttgttccagaataaaacactagctcacattgacctttggcagttccttaaaattttagctgacttcttattgtatgcatggtggccactgcctcattctccctcccatgctctgccacaagtgagagtttctgtgtctagtctgccgccttctctccttcattcatttatttataaatttatatttatttatttatgttaattatgctgctcactggcttcagaacacctcccactgcccctcacatcaggcaggccacgtgttcagctctccaaggtcggaaggaatgaggaaaaatgtgtttattccatcctcctggaagcaaaaatctctgcctgtctttttatatcattcctgtttttcctgtttagtacaaaaactgagaagagcaatttggtcaacaaactgtactaatgacatgttatgtttatttggcccttaggttttttgtttgtttgtttgtttttgagatggagtctcaactctgtcgcccaggctggagtgaagtggtgcaatctcagttcaacacaacctctgcctcccaagttcaagtgattctcctgcctcagcctcctgagtagctgggattacaggtgcccgccaccacgcctgactaatttttgtatttttagtagagacagggtttcaccatgttggccagcctggtctcataaactcctgacgtcaggtgatccacctgcctcagcctcccaaagtgctgggatcataggtgtgagccaccacgcccagccagcccttaggtttttaacctcagatctttattgcagttacctgccactgaggatctagcccttccctacttctttttcctagtcagtgataataaaatattagtaaaatatgttttctataatagaacagaaaacaattgaacacattttctatcacaaaatacactgagattgagttcttggtaccaaggattattttttaataaccatcttattctgagatttttcttttagaaagttgaaatatgaaactttaataatggttaccatttggaatgagaattagaggaggagagcgacatcttataattgtttgaattttttctaccatatgtcactacatttttttaagttaaaataaaacctgccgggcatggtggctcatgcctgtaatcttagcacttaggtaggctgaggcaggcggatcacctgcggtcaagagttcaggagcagcctagccaacatggcaaaaccccatctctactgaacatacaaaaatttaccaggcatggtgttgcatgcctgtagtcccagctactggggaggctgaggcaggagaatcgcttgaacccaggagatggaggttgcagtgagctgagatcgtgccactgcactccagcctgggtgacagagcaaggcttcatctcaaataaataaataaataaatccataacagagcaaggctccatcttaaataaataaataaataaataaataaataaaaccatgacttcagaactttactgtgtgagaggtgctgtgctaccctgtgaggaagtgtttcacattcctcattttatatcagaactgaggttcaagggcttattctcaccaccaatcatggtgtgtggcttgggtggagaatttgaaattcactcaagccacctttggtggggagtagtcgagcttactgttgagggtctaatatctagactcagaatgctttgggtttgaaacagctctcaagtaactaccttgggcaagttacttaaactcctctcattcctcatatgcagaatgagaataatgatagcacttatctcctggggttcttgtcgagagtaaaggaggtatccttgtaaaacacatagaaagtgcctggcactcagtgatagtggtgtcagttcccctgtataggttctagccctgacttcacctgaccttatagttctagtgtctaaatcctgatttataataattactatgcctcttaatccaaattctagagcagaaacctctctctcaccttgggttaggttttcttcctggtcaagttggctgtgattaggaaatagtctctgtgcccctctagaaaggccactctttcagcaagactgggaggaatgacataggctgggcaggttatctaaatgtatttactagaatgacacagtagaacttaaatgtgtttggttttatcttttaaactttccatagtttccaaatgttttgaaaggagtcaaagcaatgttattttttactgtgaaaaaagaagaatgccattcttctaaacttattttcctgtgttataatagtacgttgtctctctaataggttaatactcagagcctacacaataaccttacttatttttcaggttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacattt

SEQ ID NO: 37381 - DNA, 68769 bp, Homo sapiens; identical to SEQ ID NO: 37380

SEQ ID NO: 37382 - DNA, 17253 bp, Homo sapiens
catccaggcacctctcagcacagcagagctttccagaggaagcctcaccaagcctctgcaatgaggttcttctgtgcacgttgctgcagctttgggcctgagatgccagctgtccagctgctgcttctggcctgcctggtgtgggatgtgggggccaggacagctcagctcaggaaggccaatgaccagagtggccgatgccagtataccttcagtgtggccagtcccaatgaatccagctgcccagagcagagccaggccatgtcagtcatccataacttacagagagacagcagcacccaacgcttagacctggaggccaccaaagctcgactcagctccctggagagcctcctccaccaattgaccttggaccaggctgccaggccccaggagacccaggaggggctgcagagggagctgggcaccctgaggcgggagcgggaccagctggaaacccaaaccagagagttggagactgcctacagcaacctcctccgagacaagtcagttctggaggaagagaagaagcgactaaggcaagaaaatgagaatctggccaggaggttggaaagcagcagccaggaggtagcaaggctgagaaggggccagtgtccccagacccgagacactgctcgggctgtgccaccaggctccagagaaggtaagaatgcagagtggggggactctgagttcagcaggtgatatggctcgtagtgacctgctacaggcgctccaggcctccctgcctgccctttctcctagagactgcacagctagcacaagacagatgaattaaggaaagcacagcgatcaccttcaagtattactagtaatttagctcctgagagcttcatttagattagtggttcagagttcttgtgcccctccatgtcagttttcacagtccatagcaaaaggagaaataaaaggaccgggtgagatgtgtctgcatatgagcagtagaaagttgtcaattgtcccttttgaaaaactatccttttttgaacctttgctcagattgttatttgtaccttttgatgttaaaatgacctttatttatgaaattacaatagatttgggaaatgataataagtggtaagtttttgtttatttttaaatgttcttccctggcaaaataaagagatggcacctctctgtcagttttcttaatatgttgttctgaaagttttcttactcagtccaatctgagaacctctgcttttaagtcatcagacaaattcttgagatggctttttctgagaggctcttctgttcatcctggtcccttcttgcctaaaggtgagtctgtgtgtgtgtggggggggtgcgggggtgaggtgttgggggaggtcttcttattagctgggaagatggtatttgtgtcactttttgtgaaagtgggctcccaaatattccctgttgaggaagtgttctaatcatgaggaaataagcaagcaaatccagttgttggacaattagtttggactggtcaaagatgtcagtgccaaggaagaaagaaaaaaggggtggggaagggcttgttctatattaaagagactaaagaaatgtgttaaccaaatgtagtgcatgagtcttgattggtgtcttcatccaagggggaaaaaggctatgaggaacaggtttgggataactgaggcaatttgactgctcattattatgttactgtattaatgttcagtttcttggtgagataatgatactgtggttgcgaaggataaaatctttgttctatggagatacatgcttaagtacccagggtgaggcgtcaggatgtctgcaatttgctctcaaatggttgaagaaagactgcaaatatatagataatgagagaaagaaaggtaaaacaactgtggcaaaatattaataactggtgaattacaaactggtgaatctaagtatatggggagcttattgtactattctttcagtttttctataggcttgaaaagctttaaaattatgagaaaatatttcctaaaaagagccttctacgtgaaaggcaagctcttcatagctatggggttagaaaacctaagagccagagcctggggatgaccttgggcaagttattgaaccctctgcatcttcatttcttgtccataacataacaaagaaaattcctgctgtgaataatttttgtggggttcacatgaaatacctataagatgtaaaggatttttaaaaaatgtttagattgttagaattagaagagatccaattctgaattttacaaccaaggaaagtgaagtcctaagatgctaaggggccaaggttgcccagctggtcagtggtagagcttgagacttgaatctgtggagacaattgaaagaatcatcattaccagaagtgtgatgaggcattacttatttcagactgttgaatgaagttacattctcaataaaaactcctgcatgtgtgtatgtgggtgtgggtggtgtgtgtgtgtgtgtacaaaaatagtggcaatgttttgcctttttttttcttttgtggtcatttaacaagtctttggggatttattagatgtgtttcctaattttatattttttcttgatctttccagctactccacttttgaaataagggcaacatcccattatattgaacaccaaacatggaagttcttttctagtagtagatgtttttcatgagcaggaaattacattagtacaagaatgtggaactggaaagggacctaatgagcatccggtaccgctggctgatttttgcagatatggaaactgaggcccagagaggttattcagcttgtccatggccatctaccagttagtggcaaagctcgaattctggcctcttcctctgaagttcagtgactttctttctttttttttgagacagagtttcactcttgttgcccaggctagagtgtaatggcacgatcttggctcactgaaacctctgcctcccgggttcaagcaattctcctacctcagcctcctgagtagctgggattataggcatgtgccaccatgcccggctaattttgtatttttagtagagacagggtttcaccatgttggtcaggctagtctcgaactcctgacctcaggtgatctgccgacctcggccttccaaagcactgggattacaggtgtgagccctccctgtacatggccatgaggttcattgactttcaagaccttcagctgacctctggtttatagaccctaaaggtaaaagacagaaaggtacaggaatgcttggaacaaaagatctgtttcaaggccagatctagggaaaagggggcattctggaggctggaatataagtctaggtatgcttttttgcaggagtggcaagaactaggtgtgaaggtttgggtagagaagcttagtgaggctgagtggacaaaggtaaggcctgagaaggcagcctttctgtattccacctgcaactcaaattgttaccaccactttcttgatcatgtattaatagttgttatgtagaaaaaaattccttataatcatagaaatcacttgtttatacatacacataatatgacatattttactacataactattactacaaagttatatataactttttcttctctgggcttatataaattttcatatatatacatatataaattttatgtatatataatagtttttgaaaagtagaaaaaaaatacaattagccaagtgtggtggctcacacctgtaaccttagcactttgggaggccgaggtggacagatcacttgaggtcaggagtttaagaccagcctggccactgtggtgaaaacttgtctctactaaaaatacaaaaattagccgggtgtggtggcgggcacctgtaatccagttactccagaggctgaggcaggagaatcgcttgaacctgggaggcagacgttgcagtgagccaagatcacgctactgcactccagcctgggtgacagagcgagactccatctcaaaaaaatatatatattacatataatacatataaatatatataattatatatataaatttattatatatataataaaatacatatataatttactagaagataaattagagttggttattactgtcacaagagaaggactgctttgtttgttatttagcccctgctttggactggtctcctgttgaacagagcctggaagagggcttgtgtgcagttggtttatatggaccatgatcctagagaagagaagttgagacaggggaaagtgagacagggaaggcaggaaagccacaaaatgggggccttctccagctagtcaccacagtgggcaatggaggctcaatcccatcaagcccttcagaggggctgtgtagactgcaacagaagaggggaggtttacgcatggatctgataccctcttggccaagggctatcccatggagtatattgcgcttccctgatactcagatgtggggacgaggtttgttcttgcagactgattttttttttttttttaagatggagtctttctctgtcccccaggctggagtgcggtggcacgatcttggctcactgcaacctccgcctcctgggttcaagcaattctcctgcctcagcctcccgagtagctgggattacaggtgcacactaccacgcccagctaacttttgtatttttttttttttccagtacagacagggtttcaccatgttggccaggctggtcttgaactcctgacctcaagtatccacccatcttgacctcccaaagtgctgggattacaggcatgagccacggcgcctggcctgttcttgtagactttctatgcagaaagtcagagaagctgggccacggtggctgaggcgaggtccccgcaggtgataactgcaagaggcaggttgcctcagcaatgactgcaaaaaagtgggcaggatgtgaggggagggtgaggggagaaacctgaggtgttcaacacaagtgctgcagattccctttcctcacctagaataggatggggatgagaatccctcatgggagtcatcatgcaaattagcagtcacacagggaagcacccagtgcagcgctgagcagtggccacccagtgaataaaatataactagaaaggcttattttacttgagttccactattgtttttgttttttgttttgttttgttttttgaagatggagtctcgctctatcaccaggctggagtgcagtggcgtggtcttggctcactgcaacctccacctcctggattcaagcaattctcctgcctcagcctcccaagtagctgggattacaggcacacgccaccatgcccggctaatttttgtatttttagtggagatggggtttcaccatgttggccaggctggtcttgaactcccgacctcgtgatccacccgcctcagcctcccaaagtgctgggattacaggcatgagccactgcacctggccagggttccactattgttttaaagcatcattcaataatcaatatgtcaacatgtgcataacattttaataacatgcgttgattctagagacagtacaagttagagcagtactcaggacaatagtctattagctagtcttcactttcctaagatgtttctgacaacctgtagataattaggcatagcttgttttacttcattcctttcatttatgtaatatggactgaactttccagtgatagaaaatatctatgaaaattattacaatgcctatgtctacaggcaaacgagttaataaattcagtttccgggttgaggtctctaaaatgccaagtctataaagaagcgacggcagagaacacagaacatttccagaattttgtaatagacatgaacctttaaaccacagaaggactgaatttaacattttaaaaaacctagaaaaaaaacagctgggcgtggtggctcacgcctgtaatcccagcactttgggaggctgaggcaggcggatcacgaggtcaggagttcgtgaccagcctggccaatatggtaaaaccctgtctctactaaaaatacaaaaattagccaggcgtggtggcaggcacctgtagtcccagctactcaggaggctgaggcagaagaatcacttgaacccaggaggcagaggttgcaatgagctgagatcatgccactgtactccagcctgggtgacagagcgagaccctgtctcaaaaaaaaaaaaacaaaaaaaaaaaccttaaaaaataaaagccccaaaaatgctaactatctgacacagtacagcccttaatattttcacagtctctttttggttttcctccacattcacaatgaaatgttagtgattttaaaacattccagagaaattttagtgttgacacatctttattgagggccatttcatttatagttacttatgtaatcatccaaacaattcagctcagcatactggggctcagagaggtggagtcatttacccaaagtcacacagctgggacatggcagagctgaactaggagctatgacttccggcttaggtccaggcccctttacgagattgtttccctgcctttgggttttgcatcctctattctgggcttccacccgcatgccagatggctctattcctggagtctgaccattgccagatgctcctggctgacatgacctagaagaagccagcaggctcataacttaaccatcgcccctgccaaatgggaactggccttgccgtcatcctggaagccattccctgacattttgttttattgcagttcatgtttattccagctaatgcacataaggagtggttcctgcaaggcacaatctgaagggctccttgctcagagccgtaagggccatggtgggattcagcagggaacttggcaccagccaggcacttttgctgcctcttctttgccagtgagggtagaagaactgataagaggattgagtgcacagcccaggagctgagagtttacaaggcaacccactgggacctgagctcagccccaggagtgggtcaccccacaaagtgctgagcagcatctttgagactcttctgaagcctccagtagccatctgggtccagtcgggagatagaaatcacacagtgggttaagctggggaagtttactttaaagaattactaaccgtgatgaaagagcaactatagatagacgtgaactccataggcacctagggctgagggagggtgccggacaagcttggaaggggaaggtgaggttcagcacatcagcttgcagagaaggtggctaaggtgtgcaggcctcagctggtctgcagctgcaataggccgcctcccagtgcaggtgaggagggcaacctgcaacgtgtggcaagggcatggtgggagtcagggcaggcacaggcaggaggcctccagagcactgaggtccgtgtgcagggactctgggttccttgttgggagggctgtggaaaggttatggccaggctgtggctgtgaggtcacagaagaacttcgctctgggtccgtggctggggtaggactccaacaaatgtcctcacagtcataccacctatggacgcaggacaggaaaactgcagacctttttcctcccacgatgtccctccagcgccctctactgagatagttcaacatcgcgctcacttcaaagctcttgttcttcagacagcatacatgggagggtgcattcagctctgagaggcaatgcgtttataactgacacacctcctcagcacaggatggaagagttcgcagctgccatggcctcggaagacatgggttcaagtcccagcgataccacttagctgtgtgaccttgggcatgttacttaacctctctgaacctcggtttcctcatttgcaaaaggggatattaatgttcactttcaggaccattatttgaaagtagtgagtagcaagcacccagcacagtactggctcataagagacacttaataagtagtagcgatagttcaactttatcaggcgctatctgcagtcctaaagcctttctctatttctctgaaactttgaaggcaccagatcacatttaaaaattacataaaaattacttgaaatgggcaaagagctataaatgccgacaaaccatcttgtttcacaaaaaaaaaaaaaaaaaaagctgttttttagagttgcaaagccagtacatactttagctatccacaaggaagtcatctgtgaaaatgcctgacttttttgggtttcactttcttccttccctctatagcaaaaggggcatttctttcttaattttctccccactgactggtaggtaggtacccctacttttcttagtatacatcttttctcggtaagttgttaaattaaataaccagcataaaatacatcattttgtatgtgtaaaggggccagatgcaggggagggatggctcgcctgaatttaatatttttttaaaaacctaaaaaaaaaagccctaaaaatgttaacgatctgtcacaatatagcccttaatattttcataatctctttttggttttcttccacattcagaatgaaatgttagtgattttgaaacattccagagaaattttagtattgacacatttattaagggaccctcccatggcaactgtggatggcatagctgaagtgtagggacaaggttggggcagtcctccagactttgtgtacagatggcatgcagtatttctctctcctcacattgcctgaaaccaactcctttttttttttttttttttttttttgagacagagtctctctgtcacccaggctggagtccaatggcacaatctcagctcactgcaacctttgcctcccaggttcaaacgattctcctgacttagcctccctagttgctgagattacaggcatgtgccactatgcccggctaatttttgtatttttagtagagacagggtttcagcatgttggtcaggctggtctcgaactcctgacctcatgatccacccacctcagcctcccaaagtgctggaattacaggcgtgagccaccatgcccagcaactcttatattctgagagttgagacaatgaaagaaaagaaatttgagttgtcctgaggcagagtctgcagtgatccaagaagaggtacagatgaaaggaaaccagctcaattcaaggaacttgcttaatgccctgattttgaaaaattgtcctggcaagactttgccacatcgaatgagcctctgcacattgcaggaggctggcagggccagggagcggtgggctgctcctaacagcctgggtgtgtgttctgggcctaagagagaaggcatggcaatcggcgaggcagcatcagagaggaaggttacagatggttctgccacctgtgtacaggaaggcggtcactctctcttacctctccctggcagcacagaagaacagggaacctcgggcaccctgtccctctcccccataggcagcaccaagtccctgccggaggtgtgtgttgcctgcacagggggagaagggaagcagctggtactggtctcaggtcgatctaaggaaactccatttgacctagtgaatcagtccctgccctggataccctcctaggccaatgcaacctttagaatgaagaacaaaggggtttcctcacccctgcacaacctcagatagggagaaggagacgcagggaatgaaataaaagtttccaggactctccaggagccattcagattgtccaagaaactggtttccgcagcagcctggaataaacccattttccttctcgggtatgaggactttgccagattatgatttccttaagggcatggactgattgtgtctttttttttttttttttaaacatagactagcctattagacaaacttgtgtcttagacacctttttttcttgagcacctagcacagccttgcactcaataggtgctccaatgatgtgactaaaaggatggataaatagctctgtggatttgaggctaggaataatgaaggcctgccatgtcccggggggtactcccaattgcccctggagtttggaatgcacattgaggatgtcctcagttacatatacattttggcttatgagtctttctttttttaattttttttttttttaagacagggtctcactctgtcacccagactggagtgcagtggcatgatcatggctcactgcagccttgccctcttggactcaagagtcatcttcctgcctcagcctcccgagtagctgagaccacagactgcaccaccacacccagctaactctttaattttttgtaaagatggggtctcgctatgttgcccagcctggtcccaaactcttggcctcatgcaatcctgccacctcggcctcccaaagtgctgggtttacaggcatgagccactgcgcctggccagcttatgggttttaactacttacatggtgcactctagactgagggatatcccagggatggaggacccacccacctccagggcattaacacttttagggaggctaacaactgcagccacacagaggcaggggtggagaggagagaagggtagctgggatcaggggcaggcagctgcagcagctactgagctggctcactgtgggcagcatggctgtctggcccagcctgcacctgagagctagctgaatgttttcttcacctccttccagggagaaattttttccagtactataatttgttgaagctgaaccccagcaactcaaacaaggtaccctgactctggagatgtgaaaatgtaaaataatgtgtggctttgatgaaatgtggtagaaccagaggattaagacttctgtggtgatcctctctgcctgaaatctaaatttaggagagctgagcaaacaaatgatcaaaggcagaacatgtcttcccgaccctctcggctgtgtaggcgctccggcctcaggggatgcactgactttcctcccactgtcctgaacacctgagaatcctgagcggggaacaagttgctcaaagggcagagaagtgactcagaggttcagcaagagaaaagcccagtgtattaagcatgtctttttattctgatgctttgctgtctgggccttgcaaacgtgagagggactgcccctcccaggggtagccagttcctacggttagcaaaggactcacctgggaggacagctttcatatgcaaaccaaccaatccagagcccacaccctgtgaccacctccatctggctcaaactcaaggccactgtccccctgacctaatcacccagggcctggtaccagacaattagagataactcctgtgaccccagatcctgctgaaattattcaaactccccaatcctaaacctgcttaccctgcctcccctttctttccttcccatggaaagaataaaggcgctttcccacattttcccctggtgccctcttctggagcaaccctggtgcttccccaggtggcctcctgggcttagtgtgcccccttcctcttgggctctgtgagtacaacaacttgtaaagataatttttttttagagcagttttatgttcacagccaaattgagagaaaagtacaaacagttcccagatactactggcccccacacatgcacagcctccccgattatcatcatctcccgccacagcagttgttacaactgatgaacctgcatcagcacgcacaacacccaaggtccacggtttaaattagggttcatttttggtgttgcgccttctatgggtttagacaaatgcatagtgacatgtgtccaccattatagtatcatacacagtattcattgccctaaaaatcgtctgtgcctcacctagtcatcccttcctcacccaacaactgctgatctttttactgtctccataattttgctttaacttgcttttcagtgacaattgcctcctgggatgttggccttgccacacctgaataatcatcaaacctgcattttatttgtttttatgtgtatgtgatgggttttttgggaggttggaggggaggacagggtctcactctacgccagggctggagtgcagaggtacgatcactgctcaccacagccttgacctcccggtctcaagtgatcctcccacctcagcctcccaagtagctgggactgcaggtacacatcaccacccaggctaactttttgtagtttttgtagagatgggatttcaccatgttgcccaggtttgtcttgaactcctgggctccagtgatctgtctaccttggcttcccaaagtgctgggattacaggtatgagccactgggcctggccaaactgcattttaaaatagccaagcctgttccttgtgactattgcctcatccttgtattcaagactgctgtaagatcataatcctaagcaagagtagagacatgtagcacaccatgatcacttactgtctaaccaatgctgcccacccgcttcccttctgtatggctcaccacccccaccccaaactcctataggaactctgcacacactccctctccattatgcaaaactggtctcagaaaggaatcagacagaatatttctactgaaagtataaagcttaatatgttacttcttacaagaatatttgcatataacaagggaaaaaaccttaagtcatgcagtaaacttttatcttttttttttttttaacaggagtctccctatgttgcccaagctggtcttgaacacctgggctcaagtactcctcctgtcttggcctcccaaagtgctgggattacagacatgagccacacttctttttttttttttttttttttttttttcttgagacagagtcttgctctgttgcccagactggagtacagttgcacaatcccggctccctgcaacctttgcctcctgggttcaagtgatcctcaacctcctgagtatctggaactacaggcatgtgccaccacaccctgctaattcttgtatttctagtaaagatggaatttcaccacgctggccaggctagtcttgaactcctggccttaagtgatccgcctgcctcggcctcccaaagtgctgggatttcagtgtgagccactgtgcccggtctctttttttttttttttgagaccttgagaccgggccttgctctgttacccaagctggagtgcagtggcaggatcatagctcactgcagccttgaacttctgggctcaagcaatcctcccacatcagcctcccaagtacctaggactgcagatgcttaccaccatgcccagctaatttttcatgaatttttaattattgaaattcagacatctaagaagatgctgaggactgtctccatattcctgaaattacgactcacctattcacaaaccagcccttctagtggaattaaaatattatttgattttgaataccctactctaaggtaggcacattgccctgcaatttattatttatgaggtttttaattatggaattgttcaaatattcacaaaagtagagagactacaatgaactccaatgtagccatcactcaggcccaactgttatcagcacagtccaatcatgttttatcttcccttctctgacccccaacccatccccagtccttatctaaaatcaaatctcaaacaccatatctttgggagcctatttatttagttagttagttttcagacagagtttctttcttgttgcccaagctggagtacaatagtgtagtctcggctcacagcaatctccccctccttggttcaagcaattctcctgcctcagtctcccaagaagctgggattataggcacctgccaccacatccagctaattcttttgtgtttttagcaaagacagggtttcaccatgttggccaggctggtctcgaactcctgacctcaggtgatccgcctgcctcggcctcccaaagtgctgggattacaggcatgagccaccacgcctggccggcagcctatttaaatgtcatcctcaacatagtcaatccttgggccattttttcttacagtaaaattttgtctctttcttttaatgcagtttctacgtggaatttggacactttggccttccaggaactgaagtccgagctaactgaagttcctgcttcccgaattttgaaggagagcccatctggctatctcaggagtggagagggagacaccggtatgaagttaagtttcttcccttttgtgcccacgtggtctttattcatgtctagtgctgtgttcagagaatcagtatagggtaaatgcccacccaagggggaaattaacttccctgggagcagagggaggggaggagaagaggaacagaactctctctctctctctgttcccttgtcagagcaggtctgcaggagtcagcctttccctaacaaagccctctatcctatcacccacacttgggaggctgggctgggctgcacagggcaagatgagagatgtgttgatttcatccacttgattgtcatgtagaattagatatacttgagaagttacatttttcagtagcgccttcatatctttattttagggacaggtatacaccaagcaccatctcagccacaatctgttactaacagtatgttttctgaactttggccacttaggaaaagtacagtttggctctctccaaagtgttccctgaaagtccaactttatgactaatactgtgatttccagaaactttgactatccatgttattgacaatgattactagcactgaagggcatgcatgcaagtaggggttatgaaatatttaaaacacggttctctaagatatgagcagcaaagtgtttctaccttctatgagggaaccgaaggtgccattaaaagtagagaaatctggaccaggcatggtggctcatgcctgtaatcccagcactttgggaggctgaggcgggcggatcacttgaggtcaggagttcaagaccagcctggccaacatggtgaaacactgtctctactaaaaatacaaaaattagccaggcatggtggcagtcatctgtaatcccagctacttgggaggctgaggcaggaaaattgcttgaacccaggaggcagaggttgcagtgagccgagatcacaccactgccctccagcctgggcgacagagtgagactctgtctcaaaaaaaaaaaaaatacagacatctgttgtgattctggtaactctaaattttcaaccgtctcttcactacatttaaaaaattattttctaaaccaaattagccaggtgtggtagcaggcacctgtagtcccagcaactcaggaggctgagatgggaggggtgcttgagcctggaaggtcgaggctgcagtgcactgtgattgcaccactgcactccagcctaggtaacagtgcaagaccctgtctcaaaaaataattattttcatgtttattatattaaaatgatgtatgaaatatgtgactcatcagggcttgaaaaactttgttgtatggagattattcttatgagttgatttttctctctcctaccttatagtaatgaaataaaccaggcatgaaagtcacaataagtaatacaatgaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttaccc

SEQ ID NO: 37383 - DNA, 61642 bp, Homo sapiens
agctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcagtaagtgccacctccgcccgttgtagggcagctggggcaggctgggcctggaccgggtccccctgggccgtccggaacgttctgtctgtccccgcgcgcctgttggagggcttcggcgcagagttgccccggtagtcccgaacggcgtgcgcttgcagtcgcctccctcgggacctgtcactcgtcgacgacgtggactggaaggggagagaaagagccaggggccgctgctggtgggggcaggggcagtcgtctccctgcaggccctgggggagggagtgcagtacaggtgatgctgctgtcactcaggtccgcgtccgggtccggcttgtgaggggcgtgccttcggggtgggagcgtgtgggctaggccttatggagagtgggctggcgctcaggagaccccaccctcgtcccctgcatttttctcaccttcctcctccataatcaacctcgctgcaagctttccctcttatgcagcctcccccgccctccgttttttcccctggagggagatgccaccgtctgatacaggcgaggggaggaagatgagagtattgccattgcagatgctgggagaaatttctcgggcggctgtccagtggaaagctccgtgcggggcggagaaagaacaggggatgctgttcctgagagacttgtatttcaggagcctttgcaggtcctggatcagcagagggttgtgtgtctgatgttctaacttttttcagggctaccataggctttaaaaaccttatgtggagtttctttatatcactctccttagttactgtattccttcttctgatgataattttaggataggatgagtgctgtgtcactttctttttttaaatcgaaatatagcgtccccgttttgttgggagactacaagggccgcagtctataataaactcactggtcagaatttatagcattattcgctactatgcagtaatcatatcttgtcacatggtatttttaattgtcctgtgttacttagcttttcatgtgtttgtcttatttctcaactcgatttgtaatttccttaacggctggcaccattaaaaaaaattttttttggccgggctcattggctcacgcctgtaatgccagcactttgggaggccgaggcgggtggattacctgagttcaggagttcgagaccagccaggccgacatggtgaaaccccatctctactaaaaatacaaaaattagccgggcgtggtggtgcctgcctgtaatcccagctacttgtgaggctgaggcaggagaatcgcgtgaacccgggacggggaggttgcagtgagccaagatcttgccactgcactccagcctgggcaacaagggaggaaactccgcctcaaaaaaaaaatttttttttgaattttctctaagaatttaacagtcatccctttttttcataaatgcccattaaatgtccgttatatgcctaaatctgtgctagacagacaaaggtaattgagagaaattaggagtactgtttggcacatggttggtactttttttttttttttttttttttgagacagagactccctctgtagcccagactggagtgcaatggcgcggtcttagctcactgcaacctccgcctcccaggttcaaacaattgtcctgtctcagcctcctgagtggctgggactacaggcgcctgccagcacgcctggctaatttttgtatttttagtagagaaggggtttcactatgttggccaggctgatgtcgaactcctgacttcatgatctgcccacctcggcctcccaaagtgctgggattataggcgtgagccaccgcgccaggccggtacttgatatattagtcattttggatttttttttggtggggggacaatacttaatgtggaaactgagtctttagtgtttggtaagagagaatgttgattattttttttttttagacagggtttcactgtcacccaggttggagtgcagtggtgtgagctcggctcactgcaacccctgctttctgtgctcaagcgattttcccacttcagcctcctgagtacagtggtgccaccataccaggctaatttttagggttttttttttttttttggtagtttatgagatggggtcttgctatgttgcccaggctggtcttgaactcctggactcaagcaatttgttggactcaggctcccaaaattttgggattacaagagtgagccaccgcacctggccatggtgaatgtttagatgtcaacattttttttttttgagacagagttttgctcttgtttcccaagctggagtgcaatggcgtgatcttggctcactgcaacctctgcctcctgggttcaagcgattcttctgcctcagcctcccgagtagctgggattacaggcacccactaccacgcctggctaatttttagtatttttagtagaaacggggtttcactatgttggccaggctggtctcaaactcttgacctaaggtgatctgcctgcctcggcctcccaaagtgcttgaattacaggtgtgagccaccacgcccagcctagatgtcaatattttgtcaagcattgtcaggttcattttatggaatgatgcttgattggaaatggacatttatgtgctacaacagtagtatgaagtatgatttgggttctcatggatggcacataagctcaatatgttgtaaatattttttacgaaatcccttaacatgatctcagtgccttctattgcagtatatgtacctgaaacattttgtacacaaattgtgattaagtaattttccaccggtaggttatcatagtaggcacttggctgtggcagaaatttgtaatcaatcaggctcttaaagtctctccttttttgggccaaatttgtggtaagccaagactagatagatcttttcccggtggtttcataatcactttaatgtattgcattactgttcttagctgaaatttctaaggatgtttttctgtcaggaaatttaataaggaatatttaatatacatagatgttgattttgcaaatagttttatactagatttatgattggtaagaggaaattagagtagaatagttgtttagcctcttttgtaacacttgtgcaactttagtttcaacttcttgctgaggtaattctagctaatagatttctttttattagcttattataaaagtaatacttgctcatgtgaaaattgtaattgacataaaatttgaaaatattgccttccttcctcattattctactgtgtatattcttcctaaattaaaggcttttaattgaaatcttagaaaaatataaaaatgtgattgtgttgatgttgaaatgaaaaggggcctgcttactagaaggggaaggaaattacatttttaatggttttttttttttgagacagagtttcgctcttattgcccaggctggagtgcaatggcacgatctcagctcaccacaacctctgcttcccaggttcaagcaattctctggcctcagcctcccgagtagctgggattacaggcaggcgccaccacacccagctaattttgtatttttagtagagacaaggtttctccatgttggtcagctggtcttgaattcccaacctcaggtgatctgcctgcctcagcctcccaaagtgctgggattacaggcatgatccaccacacctggccaatagttttttttgttttgttttgttttgtttttaagaaatgaagcttaatataatttgttaagaatattttgttttccttttgtattaaaatctatcataataggactgtggttgtatgatttcatagttgatgcatcatttatagaatatttcagattgtaatggtagatttcttatgtcatggcttatattataaccactcttaagtaacttagaacagtgactaaaacttgagcatgcttcaaaatctcctgaatcacctggagagcttttcaaaatacagattgccggagcttgagaatttgtatttctaacagatttgtaagtggtgccactgctggtccagggaccacattttgagaaccagtgacatggagaattgaaaattataaggttgaattctgccagcatatcagctaaatcagttttatgctttagaataatgttttagaaaaagtctatagcagtcttgccctatagagtgcttggtgatgttctctatattgtccagtgtggtagctactagctacatgtggcatttaacatttgaaatgtggacaactgaagaaccgaaattcaattttttaaaaaattaacttaatgaaataaccacatgtatccagtagttaccatattggacagcacaggtctctagaaatgaaaaaatacaattattttatgattatggactggtaatgtgctcgtgaaacaaattagcttaatttgaaaccgtgagcctgcttaatccagggaatgtgactatttaaataatgtttatattagagtttacttcctactcgtattgagataatttcaagccatggtaaaatttaggaagatagccagagtaggtgaggtgatgttctggagcaggggtatttaaaccagagggtttgtgggatgttaacttaatggataggcttcaaatgctatagagtagtccctcccttatcccatggttttgctttctgaagtttcagttaccccaagtcaactgaggtctgaaaatattaaatgggaaattcctgaaacaagcaattcataagttttaaattgtgtgctgttttgagtagcgtgaggaactctctggacgtcccacttgatcctgcccgtgacatgaatcatccctttgttcagcatatctatgctgtctacacctgcccgtttgtcacttagtagcctatttggttagcagtgactgtcatagtatcacagggcttgtgtccaaataatccttattttacttaataatggacccaaagtgcaagaataatggtgctggcatgtaatgatacttgttctattttattcattatttttgttaatttcttaattgtgcctaatttataaactaaactttattataggtatgttacgtataggaagaaaacaacatacagatggtccctgacttaacagtggtttgacttacaagttttttactttactggatgtaaacctgtcataataaacctgttataagttaaggaaggccgagtgcggtggctcacacctgtaatctcagaactttgggaggctgagtcaggaggatcgcttcagtccaggagtttgagaccagcctaggcaacatagtgaaaataacatttgtcattttctctacaaaaaataaacaaaattagctgggcattatggtgcatgcctgtagtctcagctacatgagctacgtgggaggctgagatgggaggatcacttgagcccgagaggttgagggtgcagtaagccaagatcatgccactgcactcgagcctgggtgatggagcaatactttgtctcaaaaaaaaaaaaatgttgagtatctgtatgggctgtatgggctttggtattgtatgcggtttcaggcatctattaagggtcttggaccgtatttcctgtgggtaaagggaaactactgtactgaccactgaaagcaattgttcttttatctatttttatttgtaaaaataattcagtccattcccctaatgatcaattgtttctacttatgtttcttttgcattcttgattttgtcattttacatatataatgtttatggaatttgtcatttagtcagctgatattttagtgctttctatatgacaggcactggggatacagcagtgaacaaaacaaacatccactccctcttgtagcttctaatgggagcagccaagtatagtatgtcacatgataagtgacaaagtagggagggaggacagagtgtgtggggcagtaggtttatagttgtagagaaggcctcagtaaggtatcattagaccaaagatttgctggaggagtagacacatatcacgcaggtagacttgggataagcattccaggcagaagaaatagcgaattccagatttggatttaggatctgggagaaaagattggaggcaaggatccaacaccaaggttttaggccttggcaactggaatgatttgccattttctaaattggaaatggtgagtgagtgagcagccacgtttattctgtgaggaggggactgtgggagatcagattattttgaggaatgcttttcttataagacatttaagtcgagatttttagtaggcatttgaatatgcaagaattatgatttgtagtttttatatcctaaaagcatttacttttgtaaataatgaaattattttctatctacagcaccagttcttagccactagtaggtgttgctagtagaaaagagcatttattctttccctttttttttttttgagacagagcctctttctgtcgcccaagctggagtgccgtggcgtgatcttagctcactgcaacctctgtttcctgggttcaagcgactcctccatctcagcctcccgagtaactgggactacagatgcacaccaccatgactggcttttttttttttttttttttttttttttttttggtagagacggggttttgtcatgttgcccaggcaggtctcaaacccctgggctcaagtgatccacccgcctcagtctccaatattgctgggattataggcatgagcccctgcgcccagccagcatttactcttaatattccactacttttgtatgcacatgggaaaaatagaaccagctggtaaaatcctaagaaattggagcctcaaagtccagaggccttctcattttgacttatttcaaaccagtcttatggataggtactagtaagtaaacttgaaatcctatgtatatatttaaatttaaattatataaaaataaataaaattggccgggcgtggtgggtcatgcctgtaatcctagcactttgggaggccgaggtgggtggatcacctgaggtcaggggtaccagaccagcctggccaacaatgcgaaaacccgtctctactaaaaatacaaaaattagctgggcatggtgacaggagcctataatcccagctactcggaggctgaagcaggagaatcgcttgaacccggggagtggagtttgcagtgacctgagatcgctccattgtaccccagcctgggtgaaaaagcgaaactgcctcaaaataaatacataaataaataaaattaaaaatttatatctttagtcatattagccacatttcaagagctcagtagccacatggagctagtgcccaccctgttggacagtgcagatagagaatagatctgccatcactgaaggttcttttggattgcagtagatcttgatgcttggctgtattacattctggttaatgagatcttaggctgtaggaggggaaagattcgattgtgctgttacaaaaatatttttattaatattatatttagctttggttaaatgctttcagggtggcagtgtaaaactaaagattattggataagagtgatgaagataacaagaggatcagcatcttacatggtgctttgaagggatggaggtggtttggtttagcaaaacctttagggagcagtggtgtttaaatttgaagaaatgtcatgtagtagagggtcaaaccaggacaaatgggaggcagattttggctcattataagtaagtattcacaaagctatcctaacaatcaaaaagttggctttgaaaaagtgttttctgtcaccaaatatgttgaagcaaagaatggttgaccatttcactgtaagggatattgtagaagggattttgtcatcagatttgaatgtacactagatctctaaggacccttccaaatccaagattctgtgatttttttccccagtggtcccttgtacctagattttatgatttaaaaaatattttattttattttttgagacagagtctcactctgttgcctaagctggaatgcagtggtgtgatcttggctcactgcaacctctgcctctccggtttaagtgattctcgtgtcttagcctcccgagtagctgggacttacaggcacgtgccaccatacccagctaatttttgtacttttagtagagatggggtttcaccatgttggccaggatggcctcaaactcctgacctcaagtgatccacccgacttggcctcccaaagtgctaggattacaggagtgagccactgcgcccaaccaattttttttttctttctttctttcttttttttttttttttttctgagacagagtcttgctctgtcgtccaggctggagtgcagtggcgcaacctcagctcactgcaacctccgcctccccggttcaagcaattctcctgcctcagcctcctgagtagctaggattacaggcatatgctaccacgcctggctaatttttgtattttttagtagaggcgaggtttcaccatgttggccaggctggtctcaaactcctgactttgtgatctgcccacctcggcctcccaaagtgctgggattacaagcattagccactgcacctggcccaatttttttcttttttttaatagtgttatggattgcatgaaattacttgtggagtgtatgtgttttagtagccagctacagaagtttaacattaacttctaatgttacctgcattttaggttttgtataacattgtagtttgttagagatgtaaaggaatccaaggaacatatcctttgagaaataacatctaaatactatgtatcaattaaaagttattaaggtatagtgaaagatccattttattttttttccccattgattggcagaggaaggtacatattttaaaataatctctggtacttagagaatatgctttaccgtaacttgccatcacataaaattcttccttaattatattgtgaattttttttttcttttttgagacggagttttgctcttgttgcccaggctagagtgcaatggcgcgatctcggctcacgacaacctccaccttgtgggttcaagtgattctcctacctcagcctcccgaatagctgggattacaggcacatgccaccatgcccagctagtttttgtatttttagtagagacagggtttcaccaagttggccaggatggtctcaatctcttgacctcgtgatctgcccggctcggcctcccaaagtgctgggattacaggcgtgagccaccgcgcccggccatgttgtgaatttaaaactaattcctttcacattttttcagtacagaaagtacctgggagtgtctcagcctctacttagcatctatcatgcctaatcattctgaatgggaagaaaaaggtgaaagttttgttaatttcttattgtttttccagacatgttgatagcagagaagaaatgtggggtagatggttaacagctatccaagtcttataaactaatataataaggtaatatttcttttatttagatgtaaccttgtaacaagcttagaaagtttctatatgacttgaaatctatctgcagcttattttctttctttctttctttcttttttttgagatggagttttgttcttgttgcccgggctggagtgcaatggcgggatctcagctcactgcaacctccgcctcccttgttcaagtgattctcctgcttcagcctcccaagtagcagagattacgggcacctgccaccacatctggctaatttttgtatttttagtagagacggggtttcaccatattggccaggctggtctcaaactcctgacctcaggtgatccacccacctcggcctcccaaagtgctgggattacaggcgtgagccactgcgcccggcctattttcttacctgtattttcagtgcttataccaacacaggccctctttatttttttatttctgccagagttttcagcattttagatcatatatcttagaataatcactgattctttcagactgtcatcagattaactcagcagttcttacaaatgcctttcatagccatccctttcaccatattttcattgataccatcccagcccaggttcgtagttgaaacttacgagtaacatacctggtgtctgattggttgtcatacttttcattttccctcctttcagatccaatccattctacacattatactgattttttcctagtgtactgatttctgttatgtcactttgctgcttaggcttcttaatgcttactgtatcaggtgtaaacaccttttgcttacctttccaggcctttttagagtcttatatagcttactcccatgctccaactccaatcctgttctgcaggctggtcttatttgcctcttcatatgccttgtgcatgagggtacattgttcagttgctataaaaaaagaccaaaccacaataccttaaacaaaataagtttctctctcccatagcagtccaaacagttcaagactaatatggtggttccatggtgctgaagacctagactcctctcttgttgctctgctctttccctcatctacaaggttaaagatagtttaccttcaccatttccctcttccagccaatggggaggtaagcaggagaaaaaggaaaacacccattccttttaagagcatgatctgggccaggtgtagtggctcatgcctgtaatcccagcactttgggaggtcgaggtgggcggatcacgaggtcaggagatcgagaccatcttggctaacactgtgaaaccctgtctctactaaaaatacaaaaaatagctgggcatggtggtgcatgcctatagtcccagctacttgggaggctgaggcaggacaatcgcttgaaccagggagtcggaggttgcagtgagccaagatcgtaccactgcactccagcctggcacagagcaagactccgtctcaaaaaacaaacaaaacaaaaagagcatgttctggaagttgtatccataatttctacgtatgttccattgacaagaacttaattgtaagagttcacataatcacagggagactaattgggaatgcacccaaataattctatcactatatactggattatagaggatgcaggtaaaaaagtgtgtgtgtgtgtgtgtgtgtgtgtgtatacacacatatataaaactgatataactatatgaaggaaggggataggtttgtgttgtgtaaatactcatccatcttggcaggaggtcagcagatgatgtctaaagtagataaaacatgaaatacacacacacacacacataaaattttatcactatgaaagtaaagcagtccttgctgtatcttgctaattgtaagggtgatgtgtgtgtgtgtgtgtgtgtgtacatatatatatacacatacatactatctatgataggagaattgagaatattaatttttaatcaagtaatatatgtacatatttaaaagatacagaataagatgagcttataatgaaaaacaacattcttcgccattcccagactcattgcttagagtgaaccacttttaactgtttttggttcttgtgattatcttcatatctctaaatcatatgcttaaactgatgtttcatgttttatctactttagacatcatctgctgacctcctgccaagatggatgagtatttacacaatacaaacctatccccttccttcatatagttatatcatagtttttggttcctcttttgtggttacctttgtaactttaagtaatagactttaacctctgtttcttgttccataatttataaactgacactacctcttaacccatctacttggtaagaaagggtattagggagttcccgctctcatttcctaattgattgacagttcttttacattgtcaaagttgataacatttacattttgttttgagcagtaaataaatcttctgcaccttattgttgatttcaaaagttgaaaatcagtagccatcattaatatttatgactgtatccatactttgctgaacgatgtagtgtattgagtttattccttgccctttgtttcctatattacagacctttctgctattgaagactgtcaaatgtttttcctttgttttttaatgcttcatcagttgctttaaatcttgctacattttagttttccttatatgtaaatcataactcttgtatagtgtttttgttttttttcctggaatttgatttatcctctgtgcccgttttcacccacgcttcaagttgggaaaagaaacatatttttcttaccatgaccctaattttttcaaggtttttattatttggctgatagcttggattctattgtagtctcctttttgaatcctgttttcatttggatcagttgcatatttggaccaacattagccattattataatcatttaatgagggtctttagaccctagggcggcaagcagatcgggtatgggtggctctcaagctgttctctatttcagaaaagcctaatggtaattgcacatttacccctaattagcctgtacatgcaaagtaaaacatcaaattacttttctgtttgttagaaatattttagagtgctggtaatctatgatatatatatatatctatgatatatatatctatgatatatatatctatgatatatatatatctatgatatatatatctatgatatatatatctatgatatatatatctatgatatatatatatctatgatatatatatatctatgatatatatatgatatatatatctatgatatatatatatctatgatatatatatatctatgatatatatatctatgatatatatatctatgatatatatatatctatgatatatatacctatgatatatatatacctatgatatatatacctatgatatatatatctatgataatctatgatatatatgatatatatatctatgatatatatctatgatatatatatctatgatatatatgttatatatatctatgatatatatctatgatatatatatctatgatatatatgatatatatatctatgatatgtatatctatgatatatatgatatatatatctatgatatatatgatatatatatctatgatatatatgatatatctatgatatctatgatatgtatatctatgatatatatatctatgatatgtatatctatgatatatatgatatatatatctatgatatgtatatctatgatatatatgatatatatatctatgatatatatctatgatatctatgatatatatctatgatatctatgatatatatatctatgatatctatgatataaatatctatgatatctatgatatatatatctatgatatctatgatataaatatctatgatatctatgatatatatatctatgatatatatatcatagattaccaatgacagaaaaattatttaatagcttagtaaatatataatagtttggtttaagcatcttttagaacatgggatcctgggcaaaaataaataataagaaacttgtgaaaattttggaaaccacccagtaatgcctaaaaaagctttattctgagacatgatgggttcagctttttaataaatggctgatggcatgctattaataacaatttagagtttttagtaacttccatatgccttcatatctgtagagccaaagaagctcacataaatttgatagaagtatattatcgagcttgaaggaagtgatttctttaatttactttgatttttagaatgtgcctcaagtaaaatctttaagatgtcacactttaagtatccatctagagaagaatgaatacagtgaatatgatgatggtttcaaaaattgatgaataattggcagtgttgagtgaagctgcctaacctgaaaaaaataaagctggaggtagtcctgatttatctttatgtaaaaaatggttgactagatagaaattcaatatattctttgtggcttcagagaataacactaagagtgtcatgtgagtgaattatgaaaagggagattcatcttaatacagggaaattgtctaataatcagagtggtctgaatgagctagtaagaaccacaataatggaactcttttagaagagaatatggtaccaatttatgaagttagactcaatggctcctaaagcctcttgtgactttgagagtctatgaatcaccctctgggatttgaattaatttcaggggaaatgaaccactcaagaattattttgggaaatgaattagtagaactcactaagctatttgaatatgttagtagcagtatagtgaagtgatcatagaaatctaacatcttaatttgaataaccctaccccttatttgctctgttatcttggactacttaactagtctttctaacctcaatgttatgatctgtcaaatgaaataataatagtgcctactttataggcttatttgagacaacataagattctgtttattagtactgtatctttcacatggtaaacattaagcgaatatcactgctattattactctgcttttaaaactttaaaaaaaaatgctttcaggctagggacaggggctcacacctgtaatctcagctgaggtgggaggatcacttgaggccagaaatttgagaccagcctgggcaacatggcaagacccactctctaaaaaaaaacttttaaaaattagccgagtgtggtggcatgcacatgtaggcctaggtgttggggtggctaaggcaggaagagcactggaactcaggagtctgaggttataataaactatgatggtgccactgcactccagcctgggcaacaaagccagaccatatctctttaaaaattaaaaaatggggccaggcgcggtggctgaacgcctttaatcccagcactttgggaggccgaggcgggtagatcacgagatcagaagatcgagaccatcctggctaacacagtgaaaccccgtctctactaaaaatacaaaaaattagccagtcgtggtggcgggtgcctgtagtcccagctactctggaggctgaggcaggaaaacggcgtgaacccgggaggcggagcttgcagtgagccgagatcgcgccactgcactccagcctggcgagagtgagattccgtctctaaataaataaataaataaatataaaaaataaaataatgcggccaggtgcggtggctcacgcctgtaatcctagcactttgggaggccgaggcgggcggatccacgaggtcaggagatcgagaccatcctggctaacacggtgaaaccccgtctctactaaaaatacagaaaattagccgggtgtggtggcgggtgcctgtagtcccagctactcgggaggctgaggcaggagaatggcgtgaacccgggaggtggagcttgcagtgagccaagatcgtgccactgcactccagcctgggagacagagcgagactctgtctcaaaaaaaaaaaaaaaaaaaattaaaaaatgctttcagtgttttattctaattacctttttgggtagcttgcctatgcttcttcgggtagaaataatattttctatttgggtaatttatccaaaatttatattttaaaatggaaagaccatataagtttgtctttgctagtttattactatttacattgttttctctatttgatgtgccttttttgctaattttaaaaaatattcattgttacttggaaagtttgtatttataccctttatagtgtcgttaattgaccttatttttttattttttattttttattttttatttttttgctaggcatgatggctcatacctgtaataccagcactttgggaggacgaggaaggtggatcacctaaggtcaggagtttgagaccagcctgaccaacatggtgaaactctgcctgtactaaaaatacaatattagctgggtgtggcggtgggcatctgtaatcccagctacttaggaggctgaggcaggagaattgcttgaacccgggaggtggaggttgccgtgagtggagatcgcgccactgaactccagcctgggcaacaagagtgaaactctgtctcaaaaaaaaaataaatttttttttttttttactatctggtttatcagtatgaaatggtatgctttgattccttctattacctgtacagcagtcagtgatctaattatactttcccttttttcctcctcccattgtttttagttgtattctttctactttgtcagaacatgtaacatttaagtgctattatttcacccatgttcctatccttatttctgtctttgctatacaattgggtatgtgtcctttgccaacatatccctggttatctcttggttaaatgaaacacatcctctagaagattcctcagaaagggcttgtgtgtacagcattctctgagttcctgcatattcaaaatggtttttttccttcctatggcctcgatatttgaaggacagcttggctgggtataaaatcgttggcttacacttaaaaaaaatcagctttattgaggtataagttatataaaaattcaccagttgtaagaatacaatttgaaaaatgtgacaaacagaaagtgtaacccccaacttcattatgatgtggaacatgggtcagcaaactacaggccacagacaaaatttggcctgctgcctggttttataaatttttattggaacacagccacactttcatttatgtagtgtttctggctgttcttgcatcacagtggtagtgcttagtagttgcaacagagattacacggcttgcaaatcctaaaatatttactatttggacctttacagttgtttgctgatctctgctatagaatgtttctttcacccaaaaagttttctggtgtctctttgtaattaatctcctcccttctcctatcctctagcaactacagacgggccttctaccactatggttttggcttttctagaatgtgttaaaaatggaatcatgtagtctcctcacctggcttctttcacttagattagtgcttttgagattcattcaagctgagtgtggtggctcacatctgtaatcccagcactttgggaggctgaggtgggtggatcacgaggtcaggagttcaagaccagcctggccaacacagtgaaaccctgtctctgctaaaaataccaaacttagctggatgtggtggcaggcgcttataatcccagctacttgggaggctgaggcaggagaatcacttgaacccaggaggcaggttgcagtgagccgagatcacgccactgcactccagcctgggcaacagaggaagactccttctcaaaaaaaaagaaaaagaaattcattcatgttgggtatatcagtaattcactcttttttttttttctgctgctcttcaactcaggctcaagtgatcctcctaccttggcctcccacagtgctggaattataggcatgagtcaccgcacccagccgttcactcctttttatggtgacttgcactttctttccttgaatttcttgaaaatgctgccttattcttactttgctttgaatcttgctcttaatttttatttttatttattgagacagggtttcactctgtcacccaggctagggtgcagtggcatgatcagggcatactgcagccttgacctcccaagctcaagcaatcctcccacctcagtcccctgagtagctgggtctacaggtatgcgtcactacgtccagctaattttttaagttttttgtagagatggggtctcttcgtgttgcccaggctggtctcgaactcctggactcaagtgatccacccaccttggctttctaaattgctgggattacagacgtgagccactgcatctggcttgtttgttgctcttaagaaatctgtagtgacctaattttttgttcgtttgtttgttttgagatgacgtcttgctctgtcacccaggctggagtgcagtggcgcgatcttggctcactgcagcctccacctcccaggttcaagcgattctcctgcctcagccttctgagtagctgggattacaggtgcgcaccaccacacccggctaatgtttgtatttttagtagagatagggtttcgccatgttggccaggctggtcttaaactcctgacctcaggtgatccacccacctcggcctcccaaagtgctgggattacaggcatgagccaccatgcccgacctgtttgtttgtgttttgagacagggccttactctgttgcccaggctggagtacagtggcatgatcacagctcactgtagcctcaacttactgagcttaagtgatcctgccacctcagcctccaagtagctgggaccacaggcacatggcaccacacctggctaattttcaaatttttttaaagaaacggggtctccctatgttgcccaggctggtcttgagctcctaggcttaagcaatccttttgccttggtctcccaaagtgctcggattacaggcatgagctaccgcacctggcccctaatttttaaaattcttattataataggtgatttgatcttttagtcttgaatttttttttttttttttttttttttgagatggagtctcaccctgtcactcaggctggagcgcagtggcatgatcttgactcactgcaacctccgcctcccaggctcaagtgatcctcctaccttagcctctgagtagctgggatcacagacatgaaccaccatgcacggctagttttttttttcttttttaatttttttaaagacagagcctcgctctgttgctcatgcttgagtgcagtggcatgatctcggctcactgcagcctccttctcctgggttcaagcgattcttgtgcctcggcctccttaggagctgggattacaggcatgtgccaccacgcccagctaatttttgtatttttagtagagatggggtttcgccatgttggccgtattggtcttgaactcctgacctcaagtgatccgcctacctcagcctcccaaagtgctaggattacggacgttagccaccgcgccagcctggctaattatttttgccttgatgttttgagaatttttttcctttcctttaaaatctaatagtttcattagaatgtattttgaagttaattcttcctggtaatatgtttactccctggcacattttcttagagtatagttttaaatactggttttctttaatcagcagaaatgtttttatttgcatttagttttctttttacattagatttgaatggcattggtttgattggtttttttctttttcctacttttaggcattttgtggacagagttcattgtgtaccccctcctgttagtatagcatcctgcaccttctttaatggatgatgatattggtagtggggaggaaaaggggagttagcacctatttgtgcaggattcttttttttttttttttttttttttgagactgagtcttactctgtcacgcaggctggagttcagtggcacgatctcggctcactgcaacctcagcctccgggttcaagcagttctcccgtctcagcctcctgagtagctgggattacaggggtgcgccaccacacctggctaatttttgtatttttagtagagatggggtttcaccatgttggacaggctggtctcaaactcctgaccttaagtaatttgcccgcctgggcctcccaaagtgctggaattacaggtgtgagctaccgtgcctggccttgagacaggggtcatgctttctcacccaagctggagtgcagtggtatgatcatacctcactataatctcaaactcctgggctcaagcaattctcccacctcagcctcctgagtatttatgactacatggttgtgccatgatccccagctaattaaattttttttttttttttttttttttttgtggagacagggcctatgttgccttgcctggtctcaagctatcctccctgttggcctccccaggctttgagattataggcatgggccgctgcacctggccttaatctcagctaattgttggggaaggcaaatatatattattgatcttgctttccttcctgagaaattcacgtctcctggctctacaacagtcaacagtatggtctggtcttcatcctgcctctgtgactgctcatcatctttcatggctctgttttctttgcatatcttttagatgttggctttgtcttctctacttattctctggccactttgaattcactttgattgctttagttgccatccataataaatagaaatctttattctagatctctttcctgagctccagatccatgtgtccagctgactacagaatatctccagttgtatgatctgaagcccctaactttttaccccttaactttgatccttctacaggatttcttaaattggtaaatggcatcagcgtatcaatgattacctccactcccatccccaaatccagtcagtcaggtatatattacctaccaaatataactcattatccttctagttttctgtgtccttgctgttactaaagaccaggttgggctgggcacggtggctcacacctataatccagctttgggaggctgaggtgggtggatcatgaggtcaggagatgaaggccagcctggctaacacagtgaaaccccatccctactaaaaatacaaaaaattagctgggcgtggtggcatgcacctgtagtcgcagctacttgggaggctgaggcaggagaatcacttgaacctgggaggcggaggttgcagtgagccgagatcgcaccactgcactccagcctgggcaacacagcaagactccatctcaaaaaaaaaaaaaaaaagccgggtccagtggctcacacctgtaatcccagtgctttgggaggccaaggtgagcagatcacaaggtcaggagatcgagaccatcctggctaacatggtgaaaccctgtttctaaaatacaaaaaattagccaggcgtggtggcgggcacctgtagtcccagctactcgggaggctgaggcaggagaatagcgtgaacccaggaggcagagcttgcagtgagccgagattgcgccactgcactccagcctgggcgacagagcgagactctgtctcagaaaaaaaaaaagaaaccaggttgccattacctgggccattacaacaacttccaatcattctctcttccagttcagtctctatagcacagctggtgtaattattctaaaatatctctgatcatgtctctctcttctgaaaatatttgcctcacttgtttcagaaaatggaatcatcaagacagataaagtatttgaagtgatgctggctacagaccgctcccactatgcaaaatgtaacccatacatggattctccacaatcaataggtaagctttagatttctgaaaatatcatagttttcatcatttactttatgatttttggaagtagaaaaagcctgggacacagatatttatctattattaccttcttaatttgaattttatgactcagcaagtttcataatcccaaacatacctattttaataaaattatgtatgtttttctgttttctcgaacaatatataatatgtataaagaattaaaaacattttttgaaataaaatattttagtgaaaaaaacttttgtatttggagacggagtctcattctatcatccaggctggattgcagtggcacaatatcggctcactgcaaccttcacctcctgggttcaagcagttttcctgccttaacctcccgagtagctgggattacaggtgcatgccaccatgcctggctaattttttgtattttagtagagacggggtttcagcgtgttgcccaagctggtctcggaactcctgagctcaggcaaaccacccgtgttggcctcccaaagcactaggattacaggcatgagccaccacaccctgccgtaaaaaaaaacttttaatgaaaacttacagtattagccgagtgctgagttttctttaggggccttagtgttgactaaagattagttttcaggttaggattaattttttaaatcaatatttaaataagtgtgcttaagttattaatgacttctctgctttatttgccctgcttttttggcttgtgtttgtttttagaaagtcctgtatttaactccttctcctgaagcaggttttgctgaactgctgagccttggcagtgggcgcctttgaggcttagaagtgcctcaggattctgtcagtcggctgccatgctatcttcttttgacgcactataacagtcagcagagaagatcctggggagcttctgaaccccgaaggcacctgctaccaccgctcagtgaaacttgcttcagaggcagaaagaagcaggtaaataagttttgagaaagcaacaccacaagaaaagaaactaaaagttaagaaccacgaaaagattgtgtgaattaacattagatgataagataaagaataaaatgaagtattttattggtcttttaagctactttttcagttattctagtttttttttaagttgacagaaatatgaagcaatttaattttgcacagactttgtatacctattacatatgaaaacttatttttaaaaaacaatctgaagtaaaaacaagccaaaaatatatcaactctcaacttactgaaattcttcctttcttagctgactctacaggagaagaaatttttagctgccgtactttagagggactgttttactagatgagcacgttaccctttggcatgattatattttctaattttaactgctgggtgacagtactctaatagaagtaagttttattttcttgagatcataaaaactaaaaaagaattattgtgaaagccgggcgtggtggctcacgcctgtaatcctagcactttgggaggccgaggtgggtggatcacgaggtcaggagatcgagaccatcctggctaacgcggtgaaaccccgtctctactaaaagtacaaaaaattagccgggcgtggtggtgggggcctgtagtcccagctactcgggaggctgaggcagtagaatggcgtgaacctgggaggcggagcttgcagtgagccaagatcgcgccactgcactctagcctgggcgacacagtgagactgtctcagaaaaaaaaaaaaaaaaaaagaattattgtgaaaaataacgtatggatggtagaaaagaaattatgtgaaatagtatatttttacagctgactgtatcagtagttctcttcttcttttgcaggtttccaagcaacaatcagtgctccacacatggtaagttaagtttgttcacttggttacaaatggattacatttttctctataatcattttctttagtaaaaaagatttaaagaaagttgtatcaatttatcatctatgagttatgtgaattggtaatgaacatcattttcttttttgaacatcttattcttaatacagggtctgtagaaggagttttgttttgttttgttttgttttgttttgttttgttttgtttttgagatggagtctcgctctgtcgcccaggctagagtgcagtggcacaatctcggctcactgcaacctcccacttccgggttcatgccattctcctgcctcagcctccccaggagctgggactacaggtgcccaccacgatgcccggctaattttttatatttttagtagagacggggtttcatggtcttagccaggatggtctcgatctcctgaccctcgtgatccgcctgcctcggcctcccaaagtgctgggattacaggcgtgagccactgcgcttggcccagaaggagctttttaaggtagaaactggcatattaaaagattttggtggttgtcagtatctgtgacatgtaaaaattgaacataaaaggttatttagtagacagttaattaatggagataatattttaaatagtataatggacattttatagaaatctcaagttgaatattatttcacattttatgtggaaaattcattagggagtggttaagtataagagccattaagctgcatagctccttgagaaagacttactttgagtgatctagcagttttaatctgttgggaattttcttgggttttatttatttatttatttatttttgagacaacttcttaccttgtcacccaggctggaatgcagtggtataatcatcacagctcactgcagccttgactcccgggctcatgcagtcctcccacctcagcctcctaaagtgctaggattacaggcatgagccactgtgcccaaccttttcttagggtttaaatgtcagtatttgaatgagtacttttgttttattttgtaggaaagaacaatagcttttcttttctttttcttttcttttttttttttgagatggagtctcacactgttgcccaggctggtgtgcagtggcgcgatcttggcttgctgcaacctccgcctcctgggttcaagtgattctcctgcctcagcctcctgagtaactagcattacaggtgcccgccaccacactcagcttatgttttgtatttttagtagagacggggcttcactatgttggccaggctggtcttgaactcctgaccttgtgatccacccgcctcagcctcccaaagtgctgggattataggtgtgagccactgggcccagtctttttttttttttttttgagacggagtttcgttcttgtgcccaggctggagtgcaatattgtcatctctgctcactgcaacctccacctcctaggttcaagtaattctcttgcctcagcctccctagtagctgggattacaggcacccgccaccacacctggctaacttttttttttttttttttttgagacggactctcacctgtggcccaggctggagtgcagtggcgccatcttggctcactgcaagctccgcctcctgggttcacgccattctcctgcctcagcctcctgagtagctgggactacaggtgcccgccaccatgccctgctagttttttgtattttttagtagagacggggtttcaccatgttagccaggatggtctcgatctcgtgaccttgtgatccgcccgcctcggcctcccaaagtgctgggattacaggcgtgagccaccccacccagccttaactttttgtatttttaatagagacagggtttcaccttgttggccaggctggttttgaactcctgacctcaggtgatccactcgcctttgcctcccaaaatgctgggattataggcatgagccactgggcctggccagaacaataacttttctgattctctgcaagtatttggggttggagaagctcttatttaaacttaatactaatataaattctatatgtatttatagcaaattgataattatactagaagaaaaaagcagacatttataaaaattgaatagtaatgtcttcttgaaacatgacagaaaacacagaagccattaaaaaaacctgatacattttgaaacttacatatctaggatttttgcggagaaaaaatgttataagcaaaaattaaagaggaaaaattggctgtgtgtggtggctcacacctgtgtaatctcaacactttgggaggccgaggcaggaatatcgctagaagccaggagtttgagaccagcctgggcaacaaagcaagactctgtctctacaaaaaattttaaaaattagttgggtgtggtggcaatgttcctgtagtcccagctacaagggaggccaaggcagaaggattgtctgagtccaggaatttgaggctgcagtgagccatgattgtgctactgcactccagcctggttgacagagaccctcatctcaataataataattaacgattgagggaaatattgtaatacatatgacagcaagggaaaatttcaatatgtagacatgtatgcatacatttgtgtttgtgtgtatcctgttaataagtgaaagaccggtaagcccaaaagaaaatgtgtaaaggacaggattgatagttcatcgtggccaggcgtggtggctcacatctgtaatcccagcactttgggaggccaaagtgggcgaatcaccagaggttgggagtttgagaccagcctcaccaacatggagaaaccctgtctctactaaaaatacaaaattagctgggcgtggtggcgcatgcctgtaatcccagctacttgggaggctgaggcaggagaatcgcttgaacccgggaggcagaggttgcgttgagctgaaattgcaccattgccctccagcctgggcagcaagagtgaaagtctgtctcaaaaaagaaaaggctaagatagttcattgaacagaaatacaaatgactttgacatttaaacaaatgaaaagatgtcatcttcacgtatttaaatttttttttttttgaggcagagtcttgctctgttgcccaggctggagtgcagtggcatgatctcggctcactgcaacctccgccccgtggattcaagcaattcgcgtgccttactcagccttcctcgtagctgggattacaggtgtgcactaccatgcccggctaatttttgtatttttagtagagatggggtttcgccatgttggccaggcttgtctcctgacctgacctcctgacctcaagtgatctcctgacctcaagtgatccacccgccttggcctcccagagtgctgggattacaggtgtgagccactgtgcctggccattaaaatttttttttgtagagacagggcctcactttgttaccccaggttggtcgtgaactcctgggctctagtgatcctcttgctttggccttctaaaatgttggattacaggcataagccaccatgcccagcctcatcttcacttatacttagtaaattgcaaattagcactataatgaggtaccagttttcacctatcagattgttagagattaaaaaatttgatactttgtattggaaatggaaaactggcagtcacatactttttttgtgtgggagagtacattgaatgtttttggaagacaatttggcagtatctatcgaaatgtgaaataaatataacttagatttcccagttttatttcaagatatttatcccataatatatacatgagtgcagagtgacttaagttatttattgacgtcttatttattataattacaaaaagcaatgtccacaaatggtggatggttaataaattacagtacagatgctccttgacttacatgggggtatgtcctggtaaacccatcataagttgaaaatactgtaactctaaaatgcatttaatatacttagcctaccaaacttcatagcttagccttgcctaccttaaatgtgctcagaacacttacgttagcctacagttgggcaaaatcaactaacacaaagtctgttttataataaaatggtgaatatcacatgtaatttattgaatattgtactgaaagtggaaaatagaatgcatgtatgggtacttgaagtacaatttgtacagaacgtgtataatttttacatcatcgtaaagtcgagaaatcatatgttgaaccactgttaagtcagggaccatcttaacctccatgttgtggagtattgtgaaactgttaaaagaactctgcaagtacaaatatgacaaagtcttcaagaaatgcagtataatacttacaggtggttttttgggtgggaaaaataagaatgaaacagtataaaagttgagtcccaaagggtatttagaatattctgtaatgtatgaaaatcacatatgcacacatacatgcacatatatgtttttctttgggaatgaaaactaaaaataatttcttctaagataggaattagcttatttaggatatatgggtggaattgagatctgattttcactctgtgtccttgatctgttatcaattccttcctttctttctttgctttctttgactttctttctttgtcctttctctttcttttcttctttctttttctccttccttccttccttccttctttccttcttttcttctttttttttttttttttttccacaaagtctcactctgttgcccaggctggagtgcagtggggtgatcttggcttactgcaacctctgcctcccggattcaagtgattctcctgcctcagcctctcagatagctgggattacagatatacaccaccaagcctggctaatttttgtatttttagtagagacagggtttcgtcacgttggccaggctggtcttgaactcctggcctcaagtgatctgcctgactcggcctcccaaagtgctgggattacaagcttgagccactgtgtctggcgtgttatcaatttctttattccttttgcttaattttttttaacattttaattttttattattattatttttgagatggagtctctctctgtcgcccaggctggagtgcagtggcacagtctcagcttagtgaaacttttgcctcccaggttcaagcagttctcctgcttcagcctcctgagtagctaggattacaagtgtgcaccaccacacccggctaatttttgtatttttagtagagatgggatttcaccgtgttggccaggctggtctcaaactcctgacctcaagcgatccaccctccttggcctcccaaagtgctgggattacaggcctgagccactgcgtctagcccttaattttttagtttttgttttttttaagacagggtgttgctttgttgcccaggctggagtacagaagcatgatgatggcccactgcagccgagacctgctgagcttaaaagatcctcccaccttagcctcctgagtagctgggactataggcacataccaccaccctttactttttaaaaacattttctgtagagatgaggactcactgtgttgcccaagctagttctgaaccctggagctcaagcgatcctcccacctcagcctcccaaagtgttagcattacaggtgtgagccactgggccgggctttcttttttctttaaaccatagattaggaatgacttttttgtatattacctattcaataagtgattaaaaagaaaagttatagtcttaagataatctgcaaacagtttgaactactactgaagggggaattaatgaattttataagtataatggtagaaaaatttattctttttcttgaaggtagaacgtaatatagccccaccccacccccccactctggtgcggggcccgggttgagagagaatattaactgcttatccctcctctatgcgcagagaggcttatctgtgttccatcgttttacattccttgaggcacagcgagttcttgcttccctccctagctcggctgtaaagtcacaaagttgataagcaattgctacaaaagcatgtattcccaaggatgtaaaacatatggtgtaacaaatgtaaaagagtaattaactgcctttgatctcgcttctgcaagtacccttcctgcagcacgtaactccctaactcctgccacaaactgcttaaaaggtgattgatccctttgttcagggatcagactttctggaccctagtccgactgcgccagtgatcaccttaataattagacactctcctgaactgtgctcagtctctcccgtctctgatttgtcccacaacactacctaaatgaaagatttatatagaagcatgaatgtgactgggcggggtggctcatgcctgtaaccctagcactttgggaggccgaggcaggtgggtcacctgaggtcaggagttcgagaccagcctggccaacatggcaatatcccgtctctactaaaaatacaaaaattagccacgtgtggtggcaggagcctataatcccagctactcaggagcctgagacaagagaatcacttggacctggggagggtgcaggttgcagtgagccaagatcgcaccacttcactccagcctgggcaaaagatcaaaactctgactcaaaaaaaaaaaagaagtatgaatgctaaaagtcattttggagaaccagtatctagcatggttgggaaattgactggagtggtatgctttcaggtattaagggaaatactttgtgatttttttctttcccctgaagtttggtctgggtgtccagttcattgctgaacaaagcatagcagttacttcatggcaaaagatgcattttaaaacaacaatacaaaacagctttattaagatacaattcttggctaggtacagtaccttgagcctgtaattccagcactttgggaggccgaggccagaggatcacttgagcccaggagtttgagaccagcctgggcaacatggtgagatcccatctctacaaaaaataaaaaacatttagctgggcgtgatagtacgtgcctgtggtcccagctattctgcagactgaggtggaaggattgcttgagcctgggagatggaggctgcagtgagtcatgataacaccactacacccctgcctgagtgacagatcaagaccctgtctcagaaaaaaaaaaaaaaggtataattcttatactgtagaattcatccctttaaagtgtagaattctgcagtttttagtttattcagagttacacaaacatcagcactctctaatatgaggttttcatcactgcagaaagaaaccttccttatacccattagcagtcagatcccaacccctgctctgctcaggtcctggcaactactaatctattatttgtttctatagatttgcctattctagacatttcatataaatagaatcatataatatgttgccttttatgactgactttttaaatttagcataatgttttcaagattgatccctgttgtagtgtgaatcagtacttctgtcctttttatgactgaataatatccgattgtatggatatacaacatttatctattaactgttgagggacatttggattgtttccagtgtttggctattctaaataatgctgcagtgaacatttgtgtacacatttttgtgtgttttcatttctctcgagtatttacctaggagtggaattaccagatcatatatgaaaactctatgtttaacattttgtggaatggccaaaccgtttttcaaagcagctgcaccattttacagtcccactagcaatgtatgagggttccagtttctctgcttccttgttaacatttgttattttctttttttaaaagaattttatccatcctagtgactatgaagtggtgtctcattgtggttttgatttgcatttccctaatgatgaatgatgttgagcgtcttttcatgtgcgttttggccatttctgtatcttctttggagaaacatttattcagtctcttacccctttcttgtttttttttttttgttttttttttttagataattaaaactttttttttttttctgagacagagtctcgctctgtcacccgggctggagtgcagtggtgccatctcagctcactgcaacctccgcctcccaggttcaagcaattctcctgcctcagcctcctgagtagctaggattataggcatgcaccaccacacctggctaatttttgtatttttagtagagacaaggtttcaccgtgttggccaggctggtcttgaactcctgacctcgtgatccgcccacctcagcctcccaaagtgttgggattacaggcgtgagccacggcgcccggccaaaaaattttttttaaagacagggtcttgctatgtcgcccaggctggtctcaaactcctgagctcaagcaatcctcctgcctgtgcctctcaaagtgctgggattacaagcacgagccaccataactggcctcttgaccatttcttaattgggttatttgtcttttcattgttaaaactgtattttatataaatgcattaaaatttttaattgtgttaaaatacacataacataaaatttaccatcttaaccattttaagtgtaccatttagtagtgttaagtacatttacattgttatgcaatcagtcttcagaacacttttcatcttgcaaaactaacactctatactcattcaataacaatttcccacttttctcattctttctttacctcagcccctggcaaccaccattctattttctgtttctatgaatttggttcctctaggtacatcatataagtggaatcataaagtgtttgtctttttgtgactggcttatttcacttagcatatgtcatagcttatgtcagaattttctcccaaagctgatgcatttttaattacttatattttctgagccatctatgactgttaataaggaaaacttgtgtatctatgtatgtatatagtcacatgaaacatctatatgaatgtttatatatatgcacataacagtaagcatacagtgcaagatgtgaatagggtaaaatatttttaattgtattatatgaataagcagttgtgatcttgaatcatttattgcataaatcttagcagtattataagacaagcagaaagtgaggatgcaaagagaaatgacatctacatctaatgaaccttaaaatcacaagcttggaattaactataatcctggaatattttccaaacctgtaaagaaaaatgtgatgcgtgcagtggtgaagagattaaaggcaatctgttaaaatggtatcctggtagcagtgagcacacctggcatccaggtttgggatcctaaataccactgcttactaaaagagtcaagtgctccttggagtagtgactgacatctgtcaagtgaggaagtactcaaaggctgaggaggtaatgtcagaaggacatacgagcagatttgaagaggctcccaaaggccaaattggagagaatttgagaatcaacaagaataatgatggtaacagattatagcacagtgaattgaaaaacaaaaatttgtgagtctatggagacttaaaaaaaaacaaaaagagcaagacagggaaaaaagcgaaaatgatttttttcagaaaaacagaagaatgttaatgaataaatgtggaaggaataatgaaattttaaaaatcagtattttggctgggtgcagtggctgatgcgtgtaatctcagcacttcaggaggccgagcgggcagatcccttgagcccaggagttcaagaccaccctgggcaacaaagcaagaccctgactctacaaaaataaaaataaagatcactattttgttatcatcaatgtaatgaattaggcaaagattattaatgaatctaaaaccattaggaggaagattgttggagaacaaaaatactcatgtagtctcaaattagtactccacatattattattattttttttcaagtcatagtcttgctgtgtcacccaggctggatgcagtggcgtgatcttggctcactgcaacctccgccttctgggttaaagcaattcttctgcctcagcctcccaaatagctgggattacaggcatgcaccaccatgcctggataatttctgtagttttagtagagacggggtttcaccatgttagccagcctggtctcgaactcttgacctcgtgatctgcccacctcagcctcccaaagtgctgggataagaggcataagccaccgcacccgtcccacatgttattaattataaagaaaaaaatatgccttgaaagtagagtgatctattggtgaccacatttactgagtggttgaggttgacatgtccggtggtgtggtggtccaatattatatacttcttaatgtgatgctcttagggagttgcatagcaagacttgcgtgtgttcttgctagacgtctttgatctgaatctaaccctgaggaagcagagacatctagaatgtggtgcattatgtgtgggacaactggacaggactctttttttttctcccccctgagacagggtcttgctctgttgcccaggctggagtgcaaagatcatagctcactataacctcaagctcttcagctccagtgatcttcctgcctctgcctcccaaggagctgggactataggcatgtgccatgacccacactcagataatttttaacttttttgtagacatacggtctcaactgtgttgtccaggcttatttcaaactcctggtctcaagttatccttccactttggcctttcagagcactcggattataggtataagtcaccatgccttgccaggactccttaaatgagtcagtgtcctgaagaacagagcaaagtggtaggtggagggagataattgggggaacattctagattggcaaatgtaatgcatgaaccttgaatatattgggggaaaaaacagccatttaacacatatttgtgtgttacccctaaaagggttctgtggaacattaaggactttctggtttgaaagtttgaaatgtcttggattatgtgaggctgtatctattcaaggccttctctccatatataagttgggggaaaagatagctttaactttttaaaaattctttttttaagctcccaagtgcttggaaaccttagctttaaataaaaacacaacttcttattatggaaaattatggaagagttccagtaccatatatacaaataaaatagtataatgaacctataaatcacccagctttaataatgaccaacaatttactaatcttgttttatttaactctctctttttttttttttgaggcagagtcatgctctgtggcccaggctggaatgtagtagcgcaatctcagctcactgcggcctgctgggctcaaatcatcctctcacctcagcctctcgagtagctgggactacaggtgtgcaccaccacatccacctcatttttgtatttttgtagagatggggtatcgctgtgttgcccaggctggtcttgaactcctgaacttaagcaatccacccacctcggcctcccaaagactgggattacaggctatgaaccactgctcctagtgtaactctctcttttgctgaagtattttaaagcaaatcccaaacatacataatattatttcatccctggatactttattataaatctcaatgactttaaacataaactacaatgtcattatcatacctaacaatgtttcttaatatcttatgtctactccacgttcaaagtttgccaggtgcttaaaaatttttatagttaattcgcttaaatcagtatccacacagagtctatacattgcatatttttggtcttgtttcagttttttaaagtatcttttaatttttaaagaaagacccctttctttttttaaatgccatttgtttattgactaaagtagttcatttgttatatagaatttcccatattctgaatttggttaattgtttcctagtggtggttgacttattcttaaaactttttttttcaggaacacttcctaatggtccttcctgttgcatcatatcaggaggtccataatgtctggtcatccacttttagtgactggaataagtagttgttaatttttttttaattgttccatggaatagggcattttcgttctatctttctctttggcattggctgttttctttttttttttttttttaatttaaatgtggtatgtttattcagttctttttttttatttttatttttttttattgatcattcttgggtgtttctcgcagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgatgactcttaacgagcacgctgccttcaagcatctgtttaacaaagcacatcttgcaccgcccttaatccatttaaccctgagtggacacagcacttgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatctcttccccacctttcccccctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggctgacccccccacctccctcccggacggggtggctagccgggcagaggagctcctccttcccagtaggggcggccgggcagaggcgcccctcacctcccggacggggcggctggccgggcggggggctgaccccccaacctccctcccagacggggcggctggccgggcgggggggctgacccccccacctccctcccagacgggacagggcggctggccgggcgggggtgctgaccccccccacctccctccaggacggggcggctggccgggcgggggctgacccccccacctccctcccggacggggcggctggccgggcggggggctgacccccccacctccctcccggacggggtggctggccgggcgggggctgaccccccacctccctcccggacggggtggctgctgggcggagacgctcctcacttcccagacggggtggctgccaggcggaggggctcctcacttctcagacggggcggctgccgggcggaggggctcctcacttctcagacggggcggttgccaggcagagggtctcctcacttctcagatggggcggccgggcagagacgctcctcacctcccagacggggtcgcggccgggcagagacgctcctcacctcccagacggggtcgcggccgggcagaggcgctcctcacatcccagacggggcggcggggcagaggcgctccccacatctcagacgatgggcggctgagcagagacgctcctcacttcctagatgggatggtggccggaaagaggcgctcctcacttcctagatgggatggcggctgggcagagacgctcctcatatcccagacggggtggcggccgggcagaggctgcaatctcggcactttgggaggccaaggcaggcggctgggaggtagaggttgtagctagccgagatcacgccactgcactccagcctgggcaccattgagcactgagtgagcgagactctgtctgcaatcctggcacctcgggaggccgaggctggtggatcactccggttaggagctggagaccagcccggccaacacagcgaaaccccgtctccaccaaaaaaatacgaaaaccagtcaggtgtggtggcgcgcgcctgcaatcgcaggcactcggcaggctgaggcaggagaatcaggcagggagattgcagtgagttgagatggcggcagtacagtccagcttcggctcggcatcagagggagaccgtggaaagagagggagaccgtgggtagagggagaccgtggggagagggagagggagagggagcgggagcgggagctggctgttttcattgataaaatagttataatttttttttttttttgagacggaatctcgctctgtcacccaggctggagtgcagtggcgccatcttggctcactgcaacatccacctcccgggttcaagcgattctcctgcttcagcttcccagtagctgggattacagccgccaccacgcccggctaattttttgtatttttagcagagacagggtttcatcatgttgggcaggctggtcttgaactcctgaccttaggtcatctgcccgcctcggcctctcaaagtgctgggattacaggtgtgagccaccatgcccggcccaaatgtttttaaatctttgacataatttctgacttacagaaatattatgcagatagtacagttcctgtgtacttttgtccacacagtcttaccattggtaaagcaaatctcaccatttgctttatcatttattctctctccctttatcccctctctcctctgtgtgtgtgtgtgtgtgtgtatgtgtgtgtattatatttccgtttttctgagctctttgagggtaaattacaggcataatgctctttacctttaactttttttgagatggagtcttgctctgtcgcccaggctggggtgcagtggtgcagtggcacgttctcagctcactgcaagctccgcctctcgggttcacgccattgtcctgcctcagcctcccaagtaactgggactacaggcgcccaccaccacgcccagctaattttttgtatttttagtagagatggggttttactgtgttagccaggatggtctcgatctcctgacctcgtgatccgcctcggcctcccaaagtgctgggattacaggtgtgagccactgtgcccggccaatgctctttacctttaaaaataaggacattctcttacatacccatagtacaatttttgaaatctggaagtcagcattgatataacactattagccaatttatagaccttattcagatttcatcaattattctgataatattccttataggaaaagaaaatagtagattgtgagttttatttgattgtcatgtctttttagtttcctttaaagaatgactgagaaatggttccttattcttttatgaccttgaaaaccttgaaaatttttacgaatatgggccatttattttgtataatgtccctcaatttgggtttgtttgatgtttcctcataattcaatataggttatgcatttttgcctggcatatcccagaaatgaagtatcttagcagaggcatttgatgtcagtgtgtcccataattgtggtgttaactttgatcatctgattaaggtagtgttgacccagtttttccactggagaacttttttctgaactccattgtaaaattactatttttccttttgtgattaataattatctggggcaaaccctttgagattatgtaaatatcctgtttatttttcaaatgttagtccactagttttagcttccatttatgatttttacctgaatcaatcagttattattgagatggctgcccaaaggctgattttcttaattttttctatgtgcattcattatgtatctatatatttgttgggaacggttttccctatttttcatttatatatgtatagaatgatgtattaatttatcactatagattaatggatgggtatttttatcaaccaagatctggtagtaaatgtgtttactgctattggatctgatttttttttttttttttttttttttgagatggagtctcgctctgttacagcccaggctggagtgcagtggcatgatctcggatcactgcaatctccccgtcccgggttcaagcagttctctgcctcagcctcccgagtagctgggattacaggtggctgccaccatgcccagctaattttcttgtatttttagtagagatggagtttcaccatcttagccagactggtcttgaactcctgacctcgtgatctacctgcctcagcctcccaaagtgctggaatgtcaggcctgagccaccacgcccagcctgatctgattatttttaataatgagaatactggctgggtgtggtggcttatgtatgtcatcccagcactttgggaggccgaggtgggcggatcacctgaggtcgagagttcgagaccagcctgaccaacatggagaaacctcatctctattaaaaatacaaaattagcctttgtatttttgtatttgcttatatatgcaaagaatctattccttcctttttggaaggagtcacaagaaactagtaatattggttacctttacagagtgaaacctggatggttggaaatgggagtagggtggagacttttcacttataaatcttttaatttttttactgaattaattaaaagttaaaaattcacacactggaggtctaaaattactgaaacacatgatctgaatgtaagaattctaatcaaacagtttacttaagtaatacctgggcagatagccaagataacttggttatcttggtagatgacaatagtagaaaaattggtagaaagttggcaactttatttatataccatgatgtgtgtactttagtcttaatgaatattttgttttcttttggcagcatgcatatgcgctagaacttctatttgatcagttgcatgaaggagctaaagctcttgatgtaggatctggaagtggaatccttactgcatgttttgcacgtatggtaagagttttatttctcactctggccccaacagaagaatattatatgatttggctgtatgtttttttaactagtggttttcatgtttatttgtttgttaattctattaggatagcagttggaatgagcatcacttaggattttgttgttgttgcaagtgacagaacatgcaacccaaactggcagagctaaaagggagtttatttagttcatataacagaaaagtctaggggtgtatacggtctgttgtgtggctggatttagaagagcagatgttgttattgacgatagggttctctctgtttcttgatttggctttactttcctccacatgttggtgtcattatccggtaagctctacccttgtaatcacaagatggtggccagtagctcccaaactaccttcttccaagttctgatttggcagaaaagaatagaataagcctggttttcttttcttttttttttttttttcttcttaaaaacagaggttttattgcatttggtccacagttggtatttcaccttatctcatggtgcagggaccctgggtaggggactctctacagtacttggtggggcatgtggctgggggagacagagcagtatagctggtcaggcccagaaggggagaaggaaggctggaggctccttaaaacctactgagggaccagacgcggtggctcacacctataatcccagcactttgggaggcttaggcaggcagatcacatgaggccaggagttcgagaccagcctggccaacgtggtgaaaccccatctctactaaaaatagaaaaattagccaggcatggtggagcacctgcagtcccagctattcaggaggctgaggcaggaaaatcccttgagcccaggaggtggaggtgcagtaagccttgattgcaccactgcactccagcctgggcaacaacaacaacaacaaaaacctactgaggcacagtgtggggggtgggcttagcatggagagggggtcaggcttagccccgacaactcagaattctacttccttgtacaggcctcagtttccccaccgggccctgggacatgtctgagggtcccagggaaatccagtcactcaggagcctgagatatttagcatcgtagctgggccccgtctcccaggggactcatttcccagcaccctctccactgtccctgcccagaatgagcctggtttctaaacattcctgcagatttaccaggatgaaggtaaaacttctgcattagaaaaagtgctcttagaaaaataatgccttgttatacttctgccttttctcatcagagtcttatctggtcaatggctatccagagtattaactggggacccactaatatatgttggagtaaaggttgatcattgcttagatcatcacatcagtttgatttgagaaatatcgtgcctggaggacagattggaatattctgatctagttaaattgggagttgtggatccaccttggactagaatccatgtaacttgctataaatgtataatcagcagacttactagaatgtaagctccagggagttggaaattttgtctgctcttttttatcatgatggtatcctaaacatctaaaacaatgcctggcacataataaggactcatattttctcagatgttttgctcattttgtagaggttaagtcctcattaatggatatcagtgattttttttaaggttagaaatgccatttaataaatgactcattctctatacttgacatgtttatagttttagaggatgtattcattttaaaaaatcatttggtttctgagttgtttttcataaaatggcattaatgtttttcacacatttaccatgtgtgaaagtactttgtgttttaagcactagagcctgtgttctaagtgctaccccatttttatgatggggtttatgcctttttcctccccattttgtactgaggaacctgattcatacaaggaatgataggccgggtgtggtggctcacgcctgtaatcccagcactttgggaggccgaggcaggtggatcacctgaggtctggagttcgagaccagcctggccaacatggtgaaaccccgtctccactaaaaatacaaaaattagctgggtgtggtggcacacgcctgtaatcccagctatttgggaggctgaggcaggagaattgcttgagcccgggagacagaggttgcagtgagctgagatcacgccactgtactccagcctggccaacaaagcgagactttatctcaaaaaaaaaagaaggaacggttaacttgccaaggtatgtatgtatgtaagtgatgacacttagacaagaacccagatagtttgacttcaaagcctttatgtgttaattttttaaatttttatattttttcttgaaacatttatacttaatattttaatttacaaataaatatgcaaagaagggatttttgttgttgttgctttttgtttgttttctgagacagggtctcagtctgtcatccaggctggagtgcagtggcacgatctcaactcactgcagcctctgcctcccaggctcaagtgatcctcacaccacatcagcctcctaagtagctgggacttaggaggcacatgctaccacacctggctagtttttgtattcttttgtagagatggggttttgccatgttgctcaggctggtctcaaactcctgggctcaagcagtctacctgcctctgcctcccaaagtgctgggattataggtgtgagccactgtatatattttcatgttttctactaaaagcagtagaaacaagtgtagaaattccttcccatcaggcgggaggcagggtgtgtggtggctcagtcctgtaatcccagcactctgggaggccaaggcgggcagatcacgaggtcaggaatttgagaccagcctgaccaacgtggtgaaaccctgtctctactaaaaatacaaaaaaattagctgggcatggtggcgggggcctgtagtcccagctactcaggaggctgaggcaggagaattgcttgaacctgggaggcagaggttgcagtgagctgagatcgtgccactgtactccagcctgggtgacagagcgagactctctctcaaaaaaaaaaaaaaagaaattcctccctgtcaaattctttatgtaacattttaatatttaaagttatactttagatggaatttaaataaaaaattattgtactactattaaatattggtaattttcttcaaagttctagatttaatctaagaaagatataatttttcttagtattacaagttttattcaatgagagtgatagttgagaaagttgtatatatggtaaataatttatgataaactgagtgtttagcaatctatagaagccttaagctatttttgttttctctttgtagaatatgactttcgataaggaaaaacttcaataatactttagaaaaacaaatttagcccaatgagctactgaattgttttctcttttccaggttggatgtactggaaaagtcataggaattgatcacattaaagagctagtagatgactcagtaaataatgtcaggaaggacgatccaacacttctgtcttcagggagagtacagcttgttggtaagtatcagaaaactttaaaaatttcttcagaggatttttattttcagaagatccaatgcaagctaaataatactcagaggtaattattgtatttttttttacaatcacttttaagtactaaaaaataaaaacgattatttttgctcacctagtgtgtattttgcagccatctctttgtgagtttaattttgtattttcctattaacctctgagattgaattttttgtaatgtgtctgaccattaggattttgtcttttgtgaagtacctgttcagatattggattgcttgtatttttgacttacagggcttctagccctttgtctatatatataaatacatttcttctcccatctgaggtgtgccttttcatcttattggtacccttttgataatagaaattcttaattttaatgtagtcagacttaccaatttttttcagtgctttctgtgtcctttttaaggatactctgagaccatgaagatatgtctcttattatttcttagaacctttatcatttttagcttttcatgtttaggtttttgatcttcctgatgttggtttttgtgtatgtgtgaggtaaaggtgcagttatatgtttttgtgtatgaatatccagttgtattccccagacacactcagttttgtttaaaagataaaatattggccaggagcggtggctcacacctgtaatcccagcactttgggaggctgaggtgggcagatcatgaggtcaagagtttgagaccagcctgaccaacatggtgaaactccgtctctactaaaaatacaaaaataagctgggcgtggtggcgcacgcctgtagtcctagctactcgggaggctgaggcaggagaatcgcttgaacccgagaggtggaggttgcagtaagctgagatcgcaccactgaactacagtctggcgacagagctagagtccgtctcaaaaaaacaaataaaataaaataaaggcccgggcagctctagtagccacagccatcccctagagggatctggctgaggaggaagtggaggtgttgcttgccttggcctttgccctgatcctgtgtggacactgaaaggggaatacaggagtaaaccacaccaaaatgagtctcatgttgccagtgagggacatgagagatcaagagatagacgaaggtcaagtgacagatcacgggattcatctcatgaaagaacagagtctcaactcacttcttgtattagaaacgtttcttctctggctggatgtggtggctcatgcctgtaatcccagcactttgggaggccaaggcgggcggatcacttgtcaggagttcgagaccagcctggccaacatggtgaaaccccgtctctactaaaaatacagaaataagccaggcatggtggcaggcacctgtaatcctagctactcaggaggctgaggcaggagaatcgcttgaacctgggaggcggaggttgcagtgagctgagatcacgccattgcactctagcctggcagacaagagcgagacttcgtctcaaaaaaaaaaaaaagaaatgttaacttctccaacacgacagcgccatgttgcatgagaaaaagatcacagttcctctcgtccaagcagtccttgttctccaaaagcctctccagatggttccattagcagtactgggaacagcagtagaaacactagtcagtcaagtttagataatagctgttaagatatctggggagatggtgtttgtatttgagaatgcaaaagaaggagctctgaatataagaacataagaacaaatagcaccaatagtgagtaacactatatttgttgtagacccatccgtttctactgcacagccaaatacagtgttgggcaggatgtttgtttggatctggccgagaacacaactttacacaacccaatgagaaaggagagtatgaagtagcagagggaattggttccactgtgtttcaatctattctggattactataaaataggaattacctgttgtcctgatggcataactgttcctgaattgagagaagcatgggactatctatgtatgtcttttgaatgtagtactattaaggtactatatcttaagttaacttaaataggtgctgctgccaaagtattcctccagtaaaattcatatagtttgctgcccataaggagcaaaaaatatttatcttgggcttatttgaatgattaggatgagatttaaaacagaacttttcagttccgttatctccagtgccgtttcatgctttagagtgagtcacgtgcagggagtgtgaacgtcagaggtggtttattatccagtctgccttatccttaatctgttcacagatatttatttactaatgctttcgttcttaagagttgtgggatagaggctgggcgcagtgtctcacacctgtaaacccagcactttgggaggctgaggcgggtggatcacctgaggtcaggagttcaaaaaaaagagttgtgagataggaaaatgaagcgcttttcatttactaaatgattgttaactccagtttttcatcaaaataaaattccattgttttaatgtttctgaccaaacaaaaaataaaataaaatgagttaaaaacagcaaaaaagtgaatatccagttgtcccaggatcatttattgaaaaatctatcctttctccattgtaaacctcctgtactagaattcttcacattaagtttgatctaaacaggtttttaaagcatagctgtttttctttcagtgggggatggaagaatgggatatgctgaagaagccccttatgatgccattcatgtgggagctgcagcccctgttgtaccccaggcggtgagtcgggattttttctgtttgtgtgtttttattcaactaaaactctacaagacttaaatagaaaagacttctagatgatgttcaaaatataattagacttttatatcatacattttggttacatttagctgttactcttttcttttttcatatgcaaacaattgtataaatgacatgaaaattactaaaccccagtttgtggcgctcatatttgatccaggtaagaactaggacaacagtagaattgggaaaatccctctggagtttatgacctgataatcaggttttttttgtttgtttgttttttgttttttgttttttgtttttgaggtggagttttgctcttgtcacccaggctggagtgcagtggcccaatttcagctcactgcaacctccgcctcccgggttcaagtgattctcctgccttagcctcccgagtagctgggataacaggcgcccgccaccacgcccagctaatttttgtatttttagtagagacggggtttcaccatgttggccaggctggtctcgaactcctgacctcgggtgatctgcccgcctcagcctccgaaagtgctgggattacaggtgtgagccactgcacccggccagtttgatgttttttaaatagcagaatatgtaaggctgtatttggtgtatgggagatatgagaaagtatttgccatacattatattctcacaaagcttgtattctagaagagatatgtcatatatgtaactgggaaattagcgatatgataacatataattaacacaggatatctattggaaggaaaataaaatatgcatatgagggagagaattgtgcagtgagtggtcaaggagacatcacacacggatggaacttgaactgaatcttaaagaatagtaggatatatggccgggcatggtggctcatgcatgtaaccccagcaccttgggaggccaaggtgggaggattgcttgagcctaggagtttgagaccagtctgagtaacatggcaagaccctgtttaaaaaaaaaattagccaggcacagtggcgcatatgcctgtagccccagctactctggaggctgaggtgggagaattgcttgagcccaagctgttgaggctgcattgagccatgtttgtgccatggcactgtagcctgtggtcctagatttctgttacatatggcttttgcgtagttcttgactagatgaccggggatgaaggtgacactgtttcttctgtctagtctcatccgtttttttggtaggcttagatcagttatgggaagatgaaagttgtataatttgttctggtcattgacttgctgcttattggccaagtgactgggaaaatgacttaattgctttggccctgttgattatctgtttaaaaaaaaaaagtagctcacgcctgtaatcccagcactttgggaggctaaggcagatgaatcacttgcgctcagaagttcgagaccagcctgggcaacatggcaaaactccatctctacaaaaaatacaaaaaattagatgtggcaggcacttgtagtcccagctactcaagaggctgaggtgggaggatagcttggattgcgtgagcctgacaggttgaggctgcagtgagccatgcttgtactactgcattccagcctgggtgacaaagtgagaccctgtctcaaaaaaaaaaaaaaaggtagattgaactggtggttttacacattttaactgaagtattaatataatgtagaaaattttacaagtcataaacgaacagctcaatgaatttgaacacatgaccaatgggtttttaacttttcaaaaaaaatattgataacctagagtgaacagttaaaatctgaaatagaactgtgcttaaatgaggcgggtgggtgcagggcccatttctccctactgggaccctgaagtgatcttgaaagatatttctagatttaattaaattgaatttaaatattgtagtaatacttgcaagtattataggggtatgtatacatctgatttaagatagatgtactgaaggggctttccagttttaagatagcagaatgaagatgtttatgccttcttttggatatcaccccaagataaccagaaaaacagaagcataaactccatactcaattaactaggagactatacctgcagtcctgaactccacagtgtgtgaagatagaaagcagatggaataatagctgacccaggagggtagaggaagtagaaactaaagagactacagagtgaaatattatgcatacgcagtttgcactgcaaaactctgaaaaggcttaggaattggtggcatcaagaccttgaaaatcataggtaaaacatgggtctgaaaagagggaatgctgcttgagactctgcatgaggaataatcagcactaatctctacgtaagaaattttctaaaaactgatggacataattctaacacaaagaatttttaaaataagaaaaaagaacaaccatatcatttatattcagaatattaggggataaagagaagattctgaaagcctctagaggccaggtgtggtggctcacacttctcagcagtttgggaggccaaggaaggaggatcgcttgaggatctgagtttgagaccagcctgggcaacatagcgagaccccatctgtacaaaaaaattttaaaattagccagatgtggcagcctgtgcctgtagtcccagctacatgggaggctgaggtgggaggattgcttgagcccaggaagttgagatttcagtgaaccatgattgcaccactgtattccagccgaggtgacagagaaagaccctgtctctaaaaaaaataaaagcttctagaaaaataaaacagatctcctgttaaggactggtaatcagaaaggcatcagactgcaaacagcattagaattcgtaagtcagagtaccaaaccatcaaattctgagttgaaaattatttccaacctcgaattctgtatgcacacacatcaccaagatagttttaggtttgcaaatctccatctctttcttttaatacattccatgcactatttcacaaaatgcttctgaaggaactttcttaaatgattaagatgtcttaaaatgtcttaaaatttaatgtattaaaatgccatttttgtcatccaaaaatgaaatgagggaagagacagatagtaggaaaaaccaaaagaggaaaccacatagggcatcttaatcaggcagaggcatggaagtttgcaggattgttacaaagggaagggcctggatggaagctgtgcagcaggcctggagaataaccagctcagatttggagcaagaggaggaaaggaaacaatgattggatacttcttgactcagcagcaaatcatagttacacagtcataactagaaatgattttaataaaaaatgattggttggattgggggaaggaagcaaaatgtagattaagggagttcaatccttatctagcgtatgttttgaaatataaaggtaaatactagaagacatagctaaaaggatttgaaatgactggatttagagagcaagggtggggtagggagaggaagtcagctgtttttcattataagccttgaaattgagaaaaacaagaagatagacttgcagacaaccaaaactttgattgagggcaccctttcctgaggtaataaatatccaaagtaaggtttctggctgggcatggtggctcatgcctgtaatcccagtactttaagaggccgaggagagcggatcacttgaggttaggagttcgagaccagcctggccaacatgttgaaagcccgtctctattaaaaatacaaaaaaaattagtcgggctcggtggtgggcacctgtaatcccagctacttgggaggctgaggcatgagaattgcttgaacctgggaggcggaggttgcagtgagccgagatcgtgccactgcactccagcctgggtgacagagcgagactcagtctcaaaacaacaaaaaactacaacaaaaaacaaaacaaaacaaaaaaccagagtaaggtttcttctttaatgttttttattaatagtgatgcgtaaagctatatgaaaatggtaacatgatttaaaagttttctgactgtaagagcttccattgagtactcttggttcttcattgacaggagtgtcctcattctaacactgcagggactccagccctaccttccctccttatggtaccagtaaacctcaattgaatcgtataactagggttcccttatcccttcagtgatgccctagattctacaataataggatagggattccttgctgattttctacacttcctctcctcccctcctccttccttcaaacccacaaagattcaaaacaggcacacaggcattagaattctatgctctgcctttggcccgccaagaggatagttctatattagttggttcagttcaaacattttgagcactacagttgtaccaggtactgtgttagatgctaaagacacaaagatgaataagacacagtccccatcctcaagagcttgtcgtttaatagaggaggctgatagttgagtaataatataacaatcaaagtatgtacagggtgagtatcccttctccaaaatatttgggaccagaagtgttttggattttggattttttcagattttttcacattttggaatatttacatatacataatgagatatcttgggaatgggaccaagtctaaacataaaactcatttatgttatacctcttatacacatagcctgaaggtaattttgtataatatttcaaataattttgtgcatggaataaagttgtgattgcattttgactgtgacttgccacatgaggtcaggtgtgaaattatctacttgtggtgtcatgttgatgttcagagttttggattttggagcatttccagtttcgggttttcagattattgatgctcaacctgtatatactatgtatttatttttaagacggagtctcgctctgtcacccaggctggagtgtggtggcgtgatcttggctaactgcagcctccatctctgggttcaagcaattctcctgcctcagcctcccaagtagataggactacaggcatctgacaccatgcctggctaattttgtacttttttagtagagttggagtttcactgtgttggccaggctggtcttgaactcttgacctcaagtgatctgcccaccttggcctcccaaagtgctgggatcacaggcgtgagccaccgtgtctggccttaatttgtatatactaaataaagaacgtttctgctttctgcctatggacactaaaagttgtttataatgatgtcaaatgactattaatataaaatctgggccgggcacagtagctcacgcctgtaatccaagcactttgggaagccgaggtgggtggagtacttgaggttaggagttcgagaccagtgtggccaatatggtgaaaccttgtctctactaaaaatacaaaaattagctgggcatggtggcgtgtgcctgtagtcccagctacttgggagactgaggcaggagaatcacttgaacctgggaggcagaggttgcagtgagctgagatcgtgtcattgcactccagcctgggcgacagagtgagaccctgtctcaaaaataaataaataaaataaaataaaatctgtaacttggtgatgtatgtgcttttttttttttcttttagctaatagatcagttaaagcccggaggaagattgatattgcctgttggtcctgcaggcggaaaccaaatgttggagcagtatgacaagctacaagatggcagcatcaaaatgaagcctctgatgggggtgatatacgtgcctttaacagataaagaaaagcagtggtccaggtggaagtgattttatcttctgctctttcttcttccacacatgcaaggtgaaagggtgtggattttaagacattagactacaagagctgtttttggttgtcacctttatgctcctccattataacgtcagaaattcattacattaaaaatgtgaaaaatgttgcatggtctgcccttattttggtttaacatatatatctttgggaaagggagggtgagacttggttggcacaaaggctttttttgtttgtttgtttgttttttttttagagagactttcagcttcaattcagtactttgtaaggattttttcttcattatcagccactctgtttttatgtttttaaattatttttatagcactggatgggcatggaaacaatgagtttggtctgtaaaagaggccaggcggagtggctcatgcctgtaatcccagcactttgggaggcctaggtgggcggatcacttgaggtcaggagtttgagactagcctggccaacatggtgaaaccccgtctctattaaaaatacaaaatcagctgggcgtgatggcacaggcctgtaatcccagctactcgggaggctgagccaggagaattgcttaaaccctggaggcggaggttgcagtgggccgagattttgacactgcactccagcctgggagacagagcaaggctctgtctcaaaaaaaaaaaaaaaaaaaaaaaaaaaaaacaaggggccatcatttcctgccctgtttattgtaccaacaaggagaaagaaggggaaagataacggtcgtctcagttttctaaaatgtcagaataccagagaggacattctacctctcagcttggtttatctgtttcaaccaaatcatagatacctgacagcccatgcctatttttcattcagccttgtttaagagtcaccttctccccattctatagaataggccagccactgtttaagctattctggctaaattcctaggaagaggcaaggattctacaagttacccaatgagtgcccaggtctcacaaacccacccagagggtcagcagcatgcagcaactttcagcacagcatggtttataaagaatgtccacttttgttttatgtctcagcataatctgaatattttgtttgaagccaagatttctcttttcctccccttcccactcccttccatgagagagagtgacatcagtacataacagtgccattagctcaaattacttgaaattaaatgccaaaacaagaacggctttacagtttccttgtcttagcatcttatttttatttgacataaagattcttattttaaaataattagtttcttaataagtaaaaggggtgataataagtttaatagatctctcaatgttgtttttattcttcaccaatagctattttctgtgaattatacgtggagcacagccactggaaaaaaaaaaaaaaaaaaaagcattttagtccaggcattttgggaggctgaggtgagccaatcatcttaagtcaggagtttgagaccagcctggccaacatggtgaaaccctgtctctactaaaaacacaaaaattagctgggcatgttggcttgcatctgtagtcccaggcactcaggaggctgaggcaggagaattgtttgaacccaggaggcagaggttgcagtgagtcgagatcacactactgccttctagcctgggtgacagagcgagactctgtctcaaaaaaaaaaaaaaaaaaaaaaattaaaaaggcatttaaaaaattactggttttttcaactggaatcagatgtagttattaacaactaactaaaaccttccttcactttgcttctagtatggtttatacaattacataattgtgagattattgtagtataaaaggggcaaatatgttactgaaattactgaaatttgataagaagagttgattttcattagcaacttagaaatttttctttttatatacaataaatattagtgttgaacatcttgcctataatttataatttataattatgaaggaattataaaaagggaattttgtttttatgactagaggtagatttactgtgaagctaacaaagctgaagctgcagagcccttgcttgtctaggttttctctgaccctgttcttaatttaatttaatttaaaaaagtgttttttttgagacggagtcctgctctgttacccaggctgtgtagagcagtggtgcaatctcagctcactacaacctccgtctcccaggttcaagcaattctcctgcctcagcttcccaagtagctgagagtataggcgcccagctaaattttgtatttttagtagagaaggggtttcaccatgttggccaggctggtctcgaactcctgacctcaggtgatctgcccgcctcggcctcccaaagtgctaggattacaggtgtcagccaccatgcctggccctgttcttaattttatattatgcatagtcttactgattttttttttaacttcataaaaaggttcccctgttttctaattatataaaccttaggcccccacaaaacctgaatccacctttgataaaaccaaactatttgtattaagaaatttaaaatagggccaggtatggtggcttatgcctgtaatcccaatgctttgggaggttgaggtgggaggatcacttgaggccagaagttcaagagaagcctgggaaacatagtgagacctcgtatctactaaaaatttaagaactagccaggcgtagtggtgtgcacctctagttctggctacttgggaggctgagataagaggatcacttaagcccagaagcggcagtgagctgtgatcaccacagcattccaggctgggcaacagagcaagaccttatctttaaaaaatatatttagaataatttttaaatttatggacaattagtcatctgctaaacattaaatgtatacctgcttttaggctgggcgcagtggctcacgcctgtaatcccagcactttgggaggccaaggcgggcagatcacaaggtcaggagatcgagaccatcctgggtaacatggcgaaaccccgtctctcctaaaaatacaaaaaaattagccgggcgtggtggcaggtacctctagtcccagctactcgggaggctgaagcaggagaatggcgtgaacctgggaggccgagcttgcagtgagctgagatcgcgccattgcactccagcctgggcaacagagcgagactccgtctcaaaaaatgtatacctggttttctttttgaccttcaaagttttttaaaaattgaacaaatttaggctgggcacagtggctcacgcctgtaatcccagcactttgggaggctgaggcgggcggatcacgaggtcaggagatcgagaccatcctggccaacatggtgaaactccatctctactaaaaaaacaatacaaaaattagctgggcgtggtggcaggcacctgtaattccagctactcgggaggctgaggcaggagaatcacttgaacctgggaggtggaggttgcattgagcctacattgtgccactgtactctaacctggcgacagagtaagactctgtctcaaaaaaaaaaaaaaaaaattgagcaaacttacatgttcgcactatcagaaaaaaaaaaaatttctccaggtgtaccaggaggactttctaatttttctgttgtagatgcttttctttggccatttgttcagttgctaaatatttttcagcgtgaggatcttcttaatattattcgtgaattcaaccaatatgcatatgccaactaggccaggcactgtactaggtgccaggagtcatcagctgtgaatttgaaactgactgctctcatggagcttacagtaacgtaggagatgcaaagaccaagatgaataggcagttatagggtagtgttcagactcgcggtagggagccaggcattgaagtggtcagaattacatttcagaaagataactctagctgttatgtagagactagcctgggaagggacaaaagtcgagtcagaaacaggaagtggttatagcaattcaaggatgaaatgatggtctgcattaaggcagtgttagtaaggatagagagaagtgggtggatagctacatctaaaatactgtcactgttttctgggaattatcatctaaaaagttccctagtcaacttcttgccaggctacgtgatttctgttctttcaaactttccgtttttgtttttgttttgttttattttgttttgttttgatacagtctctctctgtcacccaggctggagtgcagtggcatgatctctgctcactgcagcctcaacctcctgggctcaagcgatcccccctgcctcagccttctgagtagctgggaccacagggtgtgccaccatactcagctgattttcttgttttttttgtagacaaggggttttgccatgttgcccaggctggtctcggactcctgagctcaagcgttccacccacctcagcctcccaaagtgctgggattacaggcttgagccaccagcctcaaactttcttcaggattactttaactcattataatactttcctaggaaccttctcttgtgtctcaccagctttccacctttcttactgaggaataatccagagctaattgcggtgctctgatgagggtgagatcccatttttgctgaggcgatgtggcagaaactgtatttttaaaaatgagaattagtggacatgtggaattctagtaccaagtaaagatccaaacttgaatgtagacttgagtctttttacacttggaaagatgtcacttgtaattttggtggattaatagaaggggagacaatgccagatctataggccagagacctagaatctgtggaattgtgttcatgactatggacatgtaatagttgtattagttgctacagaaagttaatagttcttaagtattattttattttaaataaataatttatatgtaaaaatattttgttaatcttctggtaaaagttttatttttatttatttatagatatttttgagacagagtcttgctctgtcacccaggctggagtgcagtgatgcgatcttggctcactgcacctccgcctcctgggttcaagtgattctcctgcctcagcctcccgcatagctgggactacaggcacgcaccacgaggcccggctaatttttgtatttttagtagagacggggtttcactgtgttgaccaggctggtctcaaactcctgacatcaagtgatccacccgcctcagcctccaaaactgctggaattacaggtgtgagccaccacacccagactatttttgtttttagtagtcacaagagttagtgtaattggtccatctttagtttgtgaaactgaggaatgttcaagtttattattccataagctctttgtttattgatgtcttcttaaagtgccttgcatctatgaaaaagatgttaggaattgactgcatttccaagactgacagtattggtgctaagggatccaattgatcccgtgttccatattctatattgttcctttttaatctctttacatatgttccagtattgtgacatacattacatccttaaaagcagggatatattctgttacttttggaattctttttgtctctcatagtgcttcgtacaaagcaaattgtacaacacttttattaccttggaagatccatgaaattattagaaaacgttcatggattttgattgttgtttccttatagtatatcttttcatttattcttggtaaagaatgtataagactaaatgttagtatcatagagttaataaaatctaataaataattaaattatgtataattatatactagtagaaatatatacagttattaacctaatgaatatatttagcatagtatatagcaattttaaagagcctttctaaaaatttagtacatactattttttattgtaaatgatctatacatgtaagtcagataaagaaatggtcatacagaattttgaacattggggaaaatttaataacttgaaagttacatggattttagagtattaggcttttaaaaaattgtgcacgcgctggcagcaagtttttgtttttccctagcacctctaattttaaaattcaggtctataaacctaatttcttttccttttttaaagtattttttagacagagaggatagttggaaaaatggtacctatgttgttgagggggcattaatttatttacagtatacttaatgtcttgcagcaggtaaattgtagtaaattattattattattattgttttctgagatggagtctcgctctgtcgctcaggctggagtgcagtggcgtgatctcagcttgctgcaacctccgcctccctggtttaagcgattctcctgcctcagcctcccgaatagctaggattacaggtgcatgccaccacacccggctaattatttgtatttttagtagagacgaggtttcaccatgttagccaggatggtctcgatctcctgacctcatgatccgcccgccttggcctcccaaagtgctgggattacaggtgtgagccactgcccctggcaaattgtagtaaattatttaaaaataacaatatctttggcttgggcatggtggctcacacctgtaatcccagcactttgggaggctgaggtgggcagatcacttgaggtcaggagttcgagaccagcctgagcaacgtggtgaaaccctgtctctactaataatacaaaaaaaatttagccgggtatggtggtgcctgcctgtaatcccagcgactcgggaggctgaggcaggagaattgctggaacctgggaggcagaggttgcagtgagccatgatcacaccactgcactccagcctaggtgacagagcgagactctgtctcaaaaaaaaaaaaaaaaaaaaaaagccaaaacaagaaaaacaatatcttcagttcatattctaaaaagcagaagtgaattttactttatgaatagagcactttgcaaataattctttgttgaccaaatattttaatgcctgcatgagttaagtaaaagctgttctatgagaattataacattgttatttggaagaatatattaagaggaagcagacttatgatttgtcatttaatagataatccaatactataggataaaggcagcttattggagaaatgattttaaaaatattttcttgcacaatttacaaaatttagtttaaaaaaattgtccagtaatttacccccacttacttgtgaaattatgagctctttatttcttcttcccttcaaatttatcttaacaactttttcaaaacttttaactttaatttttattgccaacaagttgctaggatagtacaaataactcctaaatctcttcatccagagtcatcaattattatcatttttctacatttctttcccctctttctatatatacatatatgtaatttttttcctttttcttaaaccacttgagacttaattatcaatatcatgcttctttacccctaaagttcttgtttttgtcactcacattaccttcagctatgaggcttgtgggcttctctcgtggttttattcattttttcacttttaacagttttactgaggtataactgagataccatacagtttattttagactgcatttttattccttccttcctctcactggcagttgctggtacagtgctgcacctggctgagtgaatggtttcttttggagctgataaagctgccttatgaaatcagctgacaggtatattatacctacagatgatgccttttctctcagagcgcttgggttgagattgacccactccacaattgctagtggacattctgagcaaaagaccacatttctgtccaattttgtgaatgtaactatcaactcatttgaactctaaaacacttaagttgtcattttactatagtgtaaagatgaccgtagatctaaaagatattttttctgaattttgacattgaaggaagaaatctatttttagaaatcaaaaatgaagaactcacgccctttaggttgcatacttggttctggagtggcatggaagatgtttggaatggctgaccctctgttgctttcacttgggttgtttgcatttttattttttaaatatattgcttggtgatcagcgcatttttattgacttaatagttgtgtctaaactattataaagccaaattgggtagtgtgtaactcctactaatgtatttctctcttttttcctcacagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacacttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaagaggc

SEQ ID NO: 37384 - DNA, 33105 bp, Homo sapiens
  misc_feature (683)..(683): n is a, c, g, or t
  misc_feature (841)..(841): n is a, c, g, or t
  misc_feature (1117)..(1117): n is a, c, g, or t
  misc_feature (1435)..(1435): n is a, c, g, or t
  misc_feature (1461)..(1461): n is a, c, g, or t
  misc_feature (1463)..(1463): n is a, c, g, or t
  misc_feature (1495)..(1498): n is a, c, g, or t
  misc_feature (1503)..(1503): n is a, c, g, or t
  misc_feature (2117)..(2117): n is a, c, g, or t
  misc_feature (2126)..(2126): n is a, c, g, or t
  misc_feature (4540)..(4540): n is a, c, g, or t
  misc_feature (4588)..(4588): n is a, c, g, or t
  misc_feature (8524)..(8531): n is a, c, g, or t
  misc_feature (9505)..(9505): n is a, c, g, or t
  misc_feature (10050)..(10050): n is a, c, g, or t
  misc_feature (10202)..(10202): n is a, c, g, or t
  misc_feature (10226)..(10226): n is a, c, g, or t
  misc_feature (10279)..(10279): n is a, c, g, or t
  misc_feature (10717)..(10717): n is a, c, g, or t
  misc_feature (10852)..(10852): n is a, c, g, or t
  misc_feature (10875)..(10875): n is a, c, g, or t
  misc_feature (11013)..(11013): n is a, c, g, or t
  misc_feature (11223)..(11223): n is a, c, g, or t
  misc_feature (13775)..(13775): n is a, c, g, or t
ggttttcaggagcccgagcgagggcgccgcttttgcgtccgggaggagccaaccgtggcgcaggcggcgcggggaggcgtcccagaggtgagcgccctgcagcggcaggggatgggccgggggccctaagtcgtaggcagcgcggggcggggacgcggctgcctgcggaggtcggactcctctccgccctcctcccgggctgtccgggtctattttccagtctatgtccaactcgcgccgcctcactaggcggcgctctctgccccgcggcacccgcgagacgtggggtccctcggcccagggacggggtgagcgtgtcatgtgggtgccctgtgcccggcaggttggagacgaagagacctcggcacagacgaagtcactcacatcctcgctttgaaacagagcgggtccttcttgtgctgtctcgctgtcactctcgcccccaccctgtggaagaggcaggtggcttgtccccagtcactttcttccttggaaaagggagacagagggccatctccagcagggccatggaaatcccagaaagtcactgagctgctcaacaaaaggccctaaacaccccaccccacagcaccaggcagtgcacactggccaagactccgtggtaaatattgctggcctttatgttgagagggggaaaaaaaagcctgcctgtgaagatcatngcccagtggccatgctcctgtgaaaacacaattggaaagccatttcctaaggggcgagggtgggtctgggaccatgctgtggcttgggtgattggtggttgcaggagtgagggtgctgccctgggaaggcgctgaggccctgttgggtgggaatcganggctgcggctttctcccggaggagggagagcggtgttgttacctagtgttgggaacacatccgtccagcaccgtgaactgcaaacaagcagagtaaccctagtgtccttcagatactgttgctgagcagtcacctagtcaatgagatgatctgtttggacggcaagtgcatctgtaatgccgccctcttgctcagtgcctggaagaggcattggtgactccccgctaatgctaggggtagctaccgtgcaggagcagtcaggctcttgcagggccnatgtggtttcatcaattttctcctgcatttacccagcccctccgaattctgagaagtgcgtccaagatctcttggactccttgactcagttcacccttgttcttgtgggcagaaaacaattcccagtgtgccatgcacagccagtcagaagggaagccctggagcagggccctgggagaagttctgtggggctggatgctaattattcagttactggattgtggggaaattccaggggaggtcccagaggagagaccgtgctaaagctaattactaagcagtacaaaaataatctctctctctctctttctctctctntctctctctctctctctctctctctntntatatatatatatatatatatatatatatatnnnngtaantttttttttgagacagtctcactctgccgcccaggctggactgcagtgacacaatctcggctgactgcaaccactgcctccagggttcaagcgattctcttgcctcagcctcccaagtagctgggattacaggtacccaccactacgcctgtctaatttttgtatttttagtagaaatggggtttcaccatgttggtcgggctgatctcaaactcctgacctcaggtgatccgcctgtcttggcctcccacagtgctggcattacaggtgtgagccactgtgctgggccaaaaataatctaaatttcaacaatcagcatgaccatgcctgtgcgtatgaccctaattatcagtctgactgattcttccttccaaaatgatggcagaggatcacctctttggatatttacagctctgagcaaagcaaaaagcatgtaggtgccattgtctgaatgcaaaaccagccatgccaggttttcggtgttgtttctgaggagggagcgcctctctggaggacggtgtttccagaacagtgcctccgttgttcattcccgtgcatcaggaagtttggctctgctgagtgttgaaagcaaaactctcctgtttatttgtctntgtatactnacagacttaaacagcagacagcactggaatgtccagttactgcatccagatgtgtttgtttcactcttaacattgtggaaaagaatgcagaaggcagatccaaagcttcaatcagatttctgaagcttaagtgattcccagccttggtcccttaatgtgagagcaacagcgtatagtgtcttccgctctctgggacaaacccaagtttgaggcatagtccctgctgtccaaaagctcctaggtctaagtaggaagacaaaaccagcacctgtgaaacaattagagcgcaattaagtgcgaaagtatgtggcagcatctgctagctcaaagaagacagctagtgcagactgactgggaaaggaagagagagcttcacagagccagctggtgttcagcttgacttaagaatgaccatcaagggcttggccaggcctaggaaaggaagcatgaggatatatgaagctcagaataatgaaaggcacttgctgcccagagccaattcaaattcctgccttccgggaattctggctgtgggtcctgccactctcttcctcacccagccatgatgcccttcttatagcattctaaccatgcctttttttttttttttttgagacagagtctcactctgtcacctaggctggtacgtccatttgtgtgatcttggctcctgcaacctctgcctcctgggtttaagtaattctcctgcctcagcctcccaagtagctgagactacagtcacgtaccaccatgctcagctaatttttgtatttttagcagagatgggatttcaccatgttggccaggctggtctcgaactcctgacctcaggtgatccacctgccttggcctcccaaagtgctaggattacaggcgtgaaacactgcacccagcctgaccatgcgttttttgtgtgcctcctttactttatgcctactctcctatgctcaaaatgctctgctgaccaatcccctacattttttaagaagcagctcaaatggcaccttctccagtgaagacttccctggcaggcccctacccgagtgtttgagcagagttggagggtttctcctttgttctccattggtccttgcatagacctctgttgaagctccgtattgtccataggagttaagggatctttgactcactcactgaagcagagctgtgtctcacttacatagggctcccctgagccgaatttggtgtctggcacataagaggcgtttgataaatgattcttgattgaaattcaagcccttataggtaacagtgaagtgccccaccaacttggagtagaaggcacaggttatgtgttacaaggagtctcagattggataaattagatggagccaattcctagaggccttgaggagtctgagtgtaatgcagtggtggtgctcaaaactcagagcaccccctattgccttcactatagaattctagagtcttcttgatctgcccccagcatatcctctttagcctcatcttccaccagctcccaccttgagcccacaaatctaccttctgagccactgcagccccaggtagctccccaggcctaggctctctcttctcctttgtccatgctgtttggcagccttggccaggaatgcctactgctctccctagctaattcctgatcattaatactccagatctgaatcccctatgtgcagaggcccctcaggctgggttttcaaattctcctctgtgctccatagcaccctgcacagcctctaacagcatttatcacaccctcttatggctgctggttacttggccatctccctgctgggatggctccctgaaggcagtgattgagttaatccttgatgtatcccccatcagctaacattgttcctaggagatggtgtccaataagcattggatggtaggctgaaccagagtgataaaaatatcaaacgaaggacaaatctagagacatctggaaggggaaaactagaatttggtgatgagttatataaagagagtgtattagtctgttatcacactgctaataaagatatacctgagtctgagtaatttataaaggaaagaagtttaattgactcacagttccacatggttggggaggcctcacaatcattgtggaaggcaaggggggagcaaagtcacatcttacatggcggcagccaagagagcatgtgcaggggaactcccatttataaaaccattaaatctcgtgagacttattccttatcacaagaacagcacgcagaagacctgcccccaggattcagttacctcccactgggttcctccctcaacacgtggggattatgggagctacaattcaagatgagatttgggtggggacacagccaaaccatatcaaagagtaagggacaaggttttttcaaacctatgaggcaggtggagatggtgtgctncaggtgtaggattccctggcctggggagaagtccacttatatgtctcngagtactacgcaaaaatttttttgtttcctggaggattttcaaaattcaaaatatcaagtcactttgagacatattgagtctgatgttaaaaaggaaatgttctagagtcaactgaaacacacactttaagtacaagtgaggtcaggcctagagaaagattttgggagcatagtggcaacagtttaacttgtgaaagcaaatgtggtcactgatggaagaagcctgaagcagagaacaaggtcttggggaaacctagaagccatgggggtgggaaaaagaaaagtatctgttggaaaatagaatgatagaaagatagggaaaactaaggaagccaaaggaagagatatttcagaagaaataggtggccaaagctgcccaatgctaaacaaaacaaaacaaaacaaaacaaaacccacaaggagattcatagaagaaagaggctgggtacagtagttcatgcctgtaataccttgggaggccaaggtaggaggattgtttgaaaccaatagttcaagaccagtctgggcaacatagtgagacccctccacccccacccccacacacaaaaattatctgggcatggtggcacatgcctatagccccagctactccagaagctgaggtgggatgatcacttgaaccccggagttcaaggctgcagtgagctctgatcgcaccacttcactccagtctgggtgatacagtgagacctggtctcaaaaaaaaaaaaaaaaaaaaaaaaaaatttaaaaagccagacctgaggaggttaaagagaggctagttactgagttactgggcaatggaaacattgggtggggtttttagactttttgtctgaggaatttggccataaaagaaagaaggaaggaggggtctgctcaagagaagactttctgtttgttttatggtaagagagatctgcctccctttgaccacactagggaaggagctcatttatgctaaaggaatatggataaatattcatattgttcacttggttatatttcatttaaaccttcctctcctcctttcctgtcctctgcaagtgccccatagaactttccttctggggaattgccaaagtcatggtattgctaaatccagtgacagggtgttgcaacacagaaatcattggttctcacttcactggcctgtaatgagactccctcaaatgcttccaaacaactttccttcctaatagtgctagtcaggcattttctcttttactgtgcacaaattaataacacagtaaaagcagcaataatagcaaatgcatagatagcagttactctgagctacagactattgtgagtacctttgaggggtaagtggtgaaccagtattcaagcttagcatatttgtcttcagggtccatgtacttaaaccactatgctaaattcaagataagtaagtttgtattttaccatagattgatgttcatgttcctgacactactacaagattcatactcctgatgctactgacaacgtggcttctccacagtcaccaaaccaggtatctctctggacccaggttcactgtgggttggactagctttaatagtcaataaggccagggacaatggcacacgcctgtaattccagcactttgggatgctgaggcgggcacatctcttgatcccaggagttcgagaccagcctgggcaacatggcgagacccacttctacaaaaaatagaaagattagctgggcatggtagcatgtgcctgtagccccagctacttgggaagctgaggtgggaggatcacctgagccgggggagttcaaggttgtgccatgatcatgtcactgcactctagcctgggtgacagagtgagactctgtctcaaaaaaaaaaatttaaaaaacagtcaataaataatttgatagtcaacaagcaatctgccacatgcaaagtattgcaagggaccaaaaaatataagctatatgtcccatctcatttactcttcataaccatcccattttacagtcagggaaactgtctggatttgaactcagaagaccatgataaaggcaaaatcagaagtcacttttagtcctgagtttctggggtctgagattcctcctcatcttggtcagagatataactgggttcagatagcttcaagactaccttttcttttatttcccaacctgtgaaccaaaagggtagtgagtgtgaatctctagcatgcacagatgtgcaagaaatactgcctctcctctattttctagatattaatattagtttagagccttcatctcatctggccagcaaccatagaaatcaccccaggttgtgtcactgtgtcacaatttcagatctcttatgcattgccaagatcccaggggctcgggtgcaggtatctcctgctcccccatctggtccactcgggttaccactgaaggcactcttgtgcctgtcttgcctagcaagtcctcactgcttccagaccacatagctaactcactggggtcctgccagagtcctgtcttcctggtgctgacagaccccttttcccttcctgtcttcctgtttctagaagcatgtctctctgctttacccatcagcacaccccacccctcttcccccaacttggcaaagactttgtgtccccaacctaaggccctgtttggaaaatcaaagccagaagaacttgcaggctattcctggtagggttctgacatatacctgccctggaccaatgactagggagctggctacagaggtggaggtgagcctaggaaagcagaaatacaaggagagggggaaaaaaaagtcaaatctcaaaatatctagccgcagacataagctcctctgagggtaatttcttgaggggggaaaaagttgctatttaaagctaggatatatgtggttccatttttttcatcggtacattaataacatcattttccactatgtatcttcaagatccggtgtaacagccttgcaaatttgccagaatgaagaaggaatgttctgcttcagggaggattggccctggtctatgattgctgtcatgatgatactcagcaagtttccttagataacttcagagttaacaaggatttaaaaatgcttccatttcaaactcaccgttatacatatgcagaaactgaggacaatgaaagttagagttgtctaggatacccagactgtggctgaaggaggactagaaccgatatttatcctctcccagcccagcatttttgccatggtctcatgtatctcgaaagtaaccaccactagcaagttggagccaaatcaactagctgactccctgccctgactcagaatggagcatagccaccctgggcagcctgcccaggcagattccacatgcagtaaacctccttcgggtcccaggacactgggcacagggtggggacctgtgcttccagcaggggtgcgctccccagcctcacctgtccctgcttacagtccctcaggcaacaccagtgaaatcatcttcctctcagggcatcctcatcctggcctgagtgccccccacctttccttctcaacctcttcagggcttaccttgcatcagggggtgtctccagcagctgcagggtgcattggattttatctgcctgggaagctttctcttgattcctttgctagcccagcacagactacacatccctctcagaacagttctcaagtgtttgatactctctcttcacattcccatttcgtatctaactgatcaggttaatagggttcctagttgccggtcaccacccccaccccagctgtttccaatttacatcacactccaaatgatttttgcagcgcttagcagattgtctgtgtcattactttcagggatgctatactggacttccctactctcatctgctccagccccctgaccttatagttgcccagctttcctggcaattgactttgcccatcaatacacaggattnnnnnnnntagcatccagggaagatgtcggagcctcagatgttaattttctaattgagaatgttggcgctgtccgaacctggagacaggtagggatgttcactttctgggcgagccaccttttcccgacgattttaaatgttgtgctagttgttcgtttttaataatcactaaaaattatttctttcaatcagatgctttaaaattgtgtgctaaagagttataatgtgcaaacaacggggaagccattctgtacctaaaccatgtgttttcaacataacttttcagagtatcagcgcctttgcttgctgctgtttttgctgttttttgatgctgggaaccaccacctaaagatagtaaagaaaacacaggaagctttccggtaactcatgctaaagaaacacaaaatcaccccagtgccttgagaaatttcctttccctctctaactttccccttcagtgttctaaagggaaggcgtttctggtaaggtgtagttgcgtaaatgatggctgcctacttcagcaagcaagaactgttggagtattaagcatgggtaactggatattctggtttgggcactggaggatccctggaagccggaagcaggctgttgctgccggggtaggggcggcgggggtgggaggtagaaacttattgctgtgattttataggcagtaaactgatgcttagagaggttcagcactcgcccaagctcacacacctactaaactgtggagctaggattgaatccagctacaaatttagtgtcattgaaatgtctaaatgcactctactgcgcaagcgataggaacttcccagcggagctcagctcagggacgcttgcagctccccgcgccccgctcgactctccggccgcggctccgcgggctcctccccctcggtccctgccccttttgcgccctctgctggtctctagggaaagcgcatctcctgaaatcagaagtcgcacccaagctgtccngtttccttagctcctagtaaagcgatatgacccatccatcccctcctcctcaaagcctcacatgaatcttctttgaggtactctctgatgcttcactcttcagcgctgagaaaaatggggaggaaggggaagtgaatgtattagtatagccccttctcaaaaccaatcgtgcagcatcttagccatgccttatcctggaagaacgaggcagctcacgtgggcatgggggtaatgagcagggaggcaattacagactcttaggttctcaccgctaacagtgtggtcagtggaccagcagcagcatcacgtgggagcccgttagaaatgcagactctcaggtccttcagccacagccctgatgaatcagaatcaccgtttcaaggaggtctcaggcgggccgtttcaggttccgagctcgctttgaggctctgtggatgttttgcagcatattcaattttgttttgttcaaaggtcacagtgacaactaagtttgcagcgggattcaaatccgagctccacagtgtaataaatgtgagatcttaganaagtgcttaacctctctgagttaatcatctatcaaataatgaaaagcactataagccaactcttcaactttcaggacattgttcacccgaaacccgaaatccaataactgtgcactgtcttctaacacagccataatttacctagatgtacngcttagaaatgtctcactctcatngtgaccttagttctatctgtccctagagagccgcaagaccattttgtctggangttctctgctcactggacaatagggacagtggaattgtcctcatccttgtgcttgagtctttggaaaccaaatgaccccagaaatgtcatgaaagagatttttaggtcccagaggaactgaatggcttagacacccaccttctgaacaagaggctgggccagagatttctcaaggtcccaacttcaaccttggtgttctgtccgccttgatttacaaaatggtcttgatcttttccaattaaaattctatttagtagagatacacagaaagtttgcaattcttccacaagaaaactgctgtatggcatagaaaaatatctacataatattttttgtttcttcttcttaattagctttcctattttcccttaggaaaacaaaaagtcctttctcctgattcaccaaaaaataaaatactgactaccatcactgtgatgngattcctatagtctcaggaactgaagtctttaaacaaccagggaccctctgcccctagaataagaacatactagaagtcccttctgctaggacaacgaggtaagtgcttctggtaaaaatgtgtcatagtgtgtntgtgtctgtgtgtgtatgatacntatataaatatatgcatatttgtacatatatatatacatatgtacaaatatacatacatataaggtctctctgtcgcccaggctgaaataaagcagtgtgatcatagctcactgcagcctcaaactcttaggcttaangatcctcctgcctcagcctcccaaatagctcagactacaggtgcacaccagcatgcctggctaatttttctgttttttgtagagacaaggtctcactatgtggcccagggtggtatagaactcctgggctcaagcagtcctcccatcttggcctcccaaagtgctgggattacaggcatgagccaccatgcccagtcctgtcttcaaaanattaatggagaaaaatattgctggggtacttaagttgtgccaggtactacagggggatcctgcatgaatgaaactgagtgcctgcccctcaagacttacaatctagtgggagaaggcataatataataaaaatgccatgatggaaatgtacccagaataccaggggacggagataaagagtgcatataggccaggcatggtggctcatgcctggaatcccaacactttgggaggccgaggcaggtggatcgctggatcccaggagtttgagaccagtctgggcaacatggtggaaccctgtctctacaaaacaaaaacaacaacaacaacaacaaaaattagctgggcatggtggtacaagcctgtagtcccaactacttgggaagctgagatgggagcatcacttgagcccaggagattgtggctgcagtaagccctgattgcaccactgcactctagcctgggtaacagagcgagatcttgccgcaaaacaaaaaaacaaaaacaaactagtgcacatagaagtgtgagaagtgcatgtagaattctcatggcagaggtggcttctgaggtggcctttgacgggggagttggaatgggatgagcagatgagacattcacgagcattccaagccccaggaccagcctaagctgagagaatggggatgagggcagactctgagaatggcaagttagatctcgagcacaaggcagtgatgggatgccagtgtagatacagccaggaaggcagggtggctggagtttcctgctctgtgaaatgaaagggttcaagccctgagggcctctctagtcaaccattccagaattcacttagagtctgtggtggggaccctgaggtcatcctgaagagtttgagtgatatgagcatgaggagtcagtgaagacttctaatcagagtcatgccctaggaagccccctcagatagtaagtgaggggtgtgtgtgtcagggtcaggcttactatgggagactagcaaggtggtgtctcccatatctagaggggaggcagtggagccttgcagccaagcagtggctgcagaattggaagaaggggaatggatgctggaggcatcctgacgtgaaattcacagaactggccaccaacagcattgatgccctgcttaaagcttcttccagctgggaattaaggaaaccagaatgacctcaccctcctggttagattttaaggatatatacactaaagacagaaataaggatccatgagcaaagatgaatatcaggcagtgtctgaccagtgagaaaggtctcagaatggctatagccctaaatgctctgaatttgggggaaatgctacaaagatgcaaaatgatttttcaagctctgttcagataaggaagaaggaagcaacaagctcactctcagaagcagatggtgcaatggtataatactagcagataaccactccctggcaggagagaagtgatggcccaggtaggagagaaagaagcaagcaagtgacgtggggctgttctgaatctgcccaagtccttctcagaccggcccatccaaggaacccagagaactggcagaggagccctctgcacctggcagccttttctgcagggccacgaagagggagggaggcaccaggcaggatgtgagcaaatcatcatcagcagatatgccaacataatacattctaggtgctggcaacacagtgagtcaaagagaaccaaacaatacctggcctctggaacaaaattctgattcacaaaaagggacacaggtgggcttttaaaccacaaaccagcgagcttgacaacaactgtggacaaatttctagaagaggtttagtaggtggtctgcagctctgtggaacggtgcggggatccctgtatgtcagcttgtgtttctgaatggccagtcacagagaactcagcttgtttccatcctgacagggttacccttttctagcaactctaggaatttggcagggcatttgatagtctctcagggtacgccccagcccccacccattgctaatggaataaagactgcacataaaagtgcacataaaagggaaatttaggctacacttaatagacgtgctttgtattatggaatcataaagacctagagaggcaaacagaccctaatgagaccaccgggcatcagtaaataaatcaaccgttctgcagtgcacagaaacctcgtgtgctgattctctgagtcctctttagagaacagtagttagttgtcagacgtttagcccgctgtgttaatccctgatgctaatgactgttgctgctcaggcgtgtgatggctctgaggagaaacctgggtaggagctcgctttccattttgcccgcatgaacggactgcctgttcctggccgtggagtgcattttgcactcacgtttgcacgagtgagctgccctccctccctgaccttgttggcctgagtgtgactgcctggggcccagtcacacctccctgaccccagtttcctctcccagtggcgctgctgggtgctgttccccgggactgcggcagagccctcctcgcgggccngacacggtgtccggccgcacggatgaccggtagagggcagcagcgcgctccgggtcggtcgggagcagggccttcctagtccagaaaccgcggcaggtccgctgctgagggccagggcctggtgggctaggggcaagagcaacgtggtgaaccggtgggctcactctgcaggaagaagagaaagaggagacgtggagaagtcgtgctgaccacatggcgtatcggacactgcacatttatgtgggccccaatgtgcctggcgcatggtttctgcgacaggagcccagccgtcaggtgtagacgtgcaggaggctggcagatgggctagaaaagcaaggaggctcagcacttggaggtgtcgaaagagggtttgaagagaaagcccggagtgcctggaatggtggggaggcatgaagaggctgacaccatgaaaggcaaggacagttcaagggcactttcaaggccttcagggaatggtgcagagaagtgagcgcgcgcaacagctggagagggcggttgtgaggaaggtcggagagaaggccctcctgtcactggcagagggtcttgactgcaagttgtccaggttcttggcgttttgaacaaagaattggacaaaatacccagcaaagcaaaaagcaaccaatcggaggctaggaagaagctacagttatattcctatgcaaatgaagactcgacaggccatcagtctgatgggttgtggacagcagtcattcagaggctggagtgaacttacaaagttgcaaatgaagactcacctgcagtcagtctgattggttgcggacagccaatttcccatctgccacacagaaaaggacaaagggagtagcgtctggtccttttgttacttatgcatggaaagttaggattttcctttcaatttagttctgggaagtcggtgtgaaacagacttaggttccctgcctccagaccctattctactgcctcactcccacattgttccattgtcaggaataaacgactctgggggtaaggtggacctccagatgacgacgaaggtagaaggggaggagaggctgagaggctaacctgccactgggacccagggccaaggccctttgtgattgaggggaagtgaccacagatcagcagatgatgactgagagatgggctggagcaggaccgtggtccggtcctgaacaacacatgcagccatgcccagagatgctaggcttagaggctaacatgcagtagacagctgcgtggccttaagttacttaacatctccgggcttcagtttcctcatccgtaaaatggtacctacagtaatggtacccagtaatagtacctacaaaagactgggaggatgagggaagggagggagctcccagctgtgtggggaggagcatacaggcgagggtaaccccccatatggtattatagggatttgcgtctatttctgtcctccctccagactctagcctcatggttctcagacatgggtatgcatcagaatgacccagatgcattaaaaacactgccaggtcccagccccagagcttctgattcagcggggctggggtaaggcccagtaatttgcattgctcgctaagcccaggtgctgctgctgctgcttgttcccggactgcactgtgggcaccactgctctggagtctgcagagctccagcagggactcctgttgaggagagacgggcatatagtgggagcccaggcctaggacgagtaactctaggacaaacaaaaattccagatacagtgcaagaagaggtagtgatgaatgaaaaagcgatcactccagcagagctttcaagtcatggtggtttatgaagggagttagaattgcacctggggagcaagtgctgaggttaatggcagtgcaattccccgtctgttttattggaactgttgtcagaggcagaatgctgggctggagggactgtggccctagcaatgttttggacttgacaatgcccatttgttgggcatggttccggtgggatgctgtattatgcagctagagaatgtatttgtcctggaagagttcactttgttcactgccctcgagcctttatccaaggctaaacccacatgctgtacctacttttggaattggtccaggaattttatacctgtgtgaatgtggagaaactctctcagacacccatttggaaatgcattagtgtttttctcagtgagtcctccatgcttgctgttccaatggccctccaggtttgggcccagcacctgccaggagaagcattccctctatagcttccacctgaccacagccagcccaagccctgctcagaaccccaggcctgccagcgagcctgtgactggaattatctattagggatcaagcattaacttgacacaggagcagccctggctcagctggaggcatccgcatgctgtggtgccccaggaacagaggcacccccgaaatgcaggctgtgtgtttgctgcagagacaccatggcccataactccccaagcataagtgagcagctctgctgtccaggcaatgaagtcaagaaagggaaccaacccagctaatggctgggattaaagctaaatgaattcagctcaaatgaaagggatactgacccttctccctctggcctcattaacttaattaacagtgcttggcaggagtattgaagcctgcattgattgttctgtttctgtttttccccctcaaagccctagatacaagttaaatcagccttaataataaaaacccaatactcaacagccctcagattttcttaccagcccttcttcctctaagagaatcacttggtttctgagttggaggggatccattagaccaacacttctcagagcatggcctgagaccactagcttcagagtaactgggatatggctataaaatgcactttccaggcctcagaggcctgtggaactggaatattgagaagtccagtttgggtatttgtagtgggttttgggggtttaatttaatttttttaattgtggtaaaatagacatataattttcattttataaaaaatgtccattttaataatttttaggcagacagttcagtgacattaagtacattcactactgtttgtctccagaatgttttcatcatcccagactgaaactctgcccattaaacgctaactccccatcctcccctcccagcccctggtaacttctgctctgcttcctgtctctgaatttatctattctagatatcttgtaagtggattcatgcaatatttgttcttttgtgactggcttattttactcagcataatgtcttcaaagttcatccgtcttgtaccgtgtgtcagaattccattcctttttaaggccgaaaaatatcccattatatagacaacaaattttgttcatttattcattcattggtggatatttgggttgtttccaccctttgactattgtgagtgatactgctatgaatattggtgtgcaaatatctgttgagcttctgcttccagttcttttgggtgtacacccagaagtggaattgctgggtcatgcgacagttagttctgtgtttcattttttgagtcagtactgtttttaagcagcccacatggttctaagctgcagtcagggttgcagccagaagaccaggtgatcagactctctgctggtggagtcacctgaagactctgaacaaccctggatgcccaagccacactccacaccaactaaatttgtaattttttaaagtctcctggtgattccagtgtgtagccaagtttgagaaccattggtttccatcagtgattctcaaatttgagtgtgtataaaattcacacaatggctaaggatacagattcctgagagagcacaccaccacccccccaccaacaccacaacccccaccgccaccaccatcaccaccaaccaccgccaatcccaaagaggctcatttaatgcatctgtggtcagtctgggcttcctgggtctgaagacttcccaggtgattctagtgtgtagccaaggctgagagctactaatcttgttaagtctttcaatgaaacatgagaacactgagagtgtgaaaggtgacacactctgcccaagtccctgagctcgttaggttctgagtctgcactcattcccagggctgattttcaagacagtcccacgggttctccatactcagccttgcaggtgcagggggtagaatcttatatagaacctgcatcttttctactcttaatttgaactgtaatccttgaattagagtgtagtcagtgctgctataatgcttgttttggaatgtaaatttgtttctaacgtgattgatgtattagggaacaatattaatgtgttagggaagactattgatatgctggagaataatattaacatattcaagaatgtgaatttcacatttgcttatgtgcaatttcttgcatgtaaaggcagaaaactgcacccagctgtgccaaaacacaaaagaatacacaaaatacacctccaatattagtcagctacctcattctccatgtgtgatttgagccacatgcacccacatctgttgctgtaacttcccctctgatatcaaacaacccttcttcccccattcacaataactcactggcggagtgcggtggctcagacctgtaatcctagcaattctgaaggctgaggcaggtggatcacctgaggtcagaagatcgagaccagcctgtgcaacatggtgaaaggctatctctactaaaaatacaaaaattagccaggcatggtggtgcacacctgtaatcccagctactcaggaggctgaggcaggagaatcacatgagcctgggaagtggaggctgcagtgagctggattgcattccagcctgggtgacagattgagacttcatctcaaaaaataaaaataaaataactcacaagctgcaatctttcggatgtccacttccacaagcaaactgcaggtcattttcaaagtcaagtgctgtattatgtatttttaagaatttaacttggctaaaactgtgctaccttaagggggctccaatccttttttttcttttctttttttttttttgttttagacggagtcttgctcttgtcgcccaggctggagtgcagtggcatgattttggctcactacaacctttgcctcctgggctcaagggtttctcctgcttcagcctcccaagtagctggaattacaggcacccaccaccacacacagctaatttttgaatttttaatagagataggtttcccgtgttgtccagactggtctcgaactcctgacctcaggtgatccacctgcctcagcctcccaaagtgctgggattacaggcgtgagccacagcgcctggcccaatcctttctttataggccactgttaagttttcaagtgtgaaacaccctagctctatttttcccatgagccttgtggtttttattgtgtgattttgcatagtgtaatgacttgtaaaaaggaatgtatgtcacctgatagaagaactaactgtagatgtaattatacacattgctttttagcatccttttaacaatgagtgagcagctcactgcccccttgagaattttagttcctgtccctctctttcctccctctataaccactagatggcgcactcctccgctggggtcgggcgcctttgcagcggcaacctcaacagcgtggacgccgttcttgaactctcgtctcactgaggtttgattgggtctggaacaacttcacagcctggttctcctctttagattggatttccccaatcccagtgctcattcaagatttacttccgcccactttagctctggcttctttttggatggtacttcttcccaggctatctgcaggaactgcctcgctgcacacacctctgctcacctgctcacctggttcctctgctcacctgtcctgccatttaacccacagagatctacttcagagacaaaaatctcgttatttcatgcctttctgtacttcataaagaaatctgtctgcgtggtatctttgtaatacgacataagcccagacaatgttctttcacatccatttgttcagctggccttatccaccttacttacttactttcattttagcttccctattaggtacttgaaaattcagtatcctggaacatatttcgtttggggctgtctttcacttatctttaccacaaattcaaggtcacccagtttggtggcatgtttgggaaccggcattgagtcatccataaaaacaaagaatttaaactaaaaaatgtaactgttcttcagagctggcattctcactcccatgtctgcagggatttctctggtttcatgagatgagaatttccttctcgtgtttggataaaatagcagctgcaaaactgtcagcaacttggggtccaagtttgttctttcctgcaaatactggtagttcaatattggaacatatttatatcttagagtcacttaaaatcctcatttctgaaatcaaattttctattctcttttcttctagaatagagatcagcaaactacggtctgtgtttggactgcaaaacctaaaatatttaccctctggccctttagagaaaatgttttctatctcctgttctagagcctaaagtgtgattgtttaacagaaactaagggtcctcaatgtgacatggagatggacaggcctcaggaagtcagcaaatcctctgaaactgggttcaaaatttggtttgtgatgcaaatgtgcatttttataggaaaaaggatcaaagctatcatcagagtctcaaatgggtccaagacttcaaaaggtttaaaaacatgttgtctacttatgggcagtgtgactgagcatgagagcccaccataacatcctaggtgtgagcaatgaagccaacatgcttacatgccttgttagggcacttcagaatctacttcatactataagatgtggaaaaggttatgtggaacccaatacaaatatggtctttccattaccatttattttcctccttgggtgtcaaggcctgttctcccccactattcttgtctcatctgaagtacatcttcagactcttcaccccaggtaccactgagtaagggctcatgcttcctaccacacacccttatctctgcctcccaggattatatcagcttctagaatcacagccttccaattgcacgccaggaaccctggagctggatttagggcccattgcaataactgcctctcatctcatccattgtgacatctgtccctctcttcatagattctattctgccctttttaggttggtttatcatcatgatgcatatttgatattattgaacactgtggggtgtcaatgctaaatgtgtaattgaggatggcagggacagagcagagcacctcccatggcacctgagaaagcctgtcccaaaccttggaggtaggagggatggtgcttgcctttaggagtttcttctgaactgtaacaccctcatctgccctgattggtttctattttctttcaataattcttcattttatctattgagatcactttgaacttttatcccattttccaaaatgcagcctcctgcctgtgtgtgtcatctataaatacaaggtcattagctctgaggcccatttgaagccacaagaaattcactgagacagaaagtggctactttgtttgcattactcaatctcatcacctacaaaagaaacaaacactggccaggcacatgcctgtaatcccagcagtttgggaggccgaggtgggctgattgcttgagcccaggagttcgagaccattctgggcaatatggcaaaaccctgtctctacaaaaaaagtacaaaaattagctagcatggtggtatgcacctgtggtcccagctattcaggaggctgaggtaggaggatcacttgagcccaggaaattaaggctgcagtgagctgtaatcgcaccactgcactccagcctggacagcagagtgagaccctgtctcaaaacaaaacaatcacaaactatgtaggtggaaagaatacataggattcgcagaattcctggctttagtcatcagagtgcctgtaaggaatgtggaaaaagacctggaagctttacctctcggcactgcagcactgtcagacccaggcctctgttttataacaaatatttgaaatgacctctttattattttgaaatgacattcatagctgtaacataatccacctacatacataattttatagaaatcaatatactgtcctaacttggatataaaaaagaaataaaaggggaagtaatttataatgagttggtacatgtctcaatgtgtgaatgcttatgtgcaactagaagatgaaatgagttaaacactcacacctacttataaagaagatgcttggatttaggagaagtaaaataatattcaactgacccttcttaaacattttttttccaaggcagggtcttgctctgtcgcccaggctggagtgcagtggcacaaacacagctcactgcagcctcaaactcccaggcttaagctatcctctcacctcagcctcccgagtagctgggactacaggtatgcaccaccatgcccagccaatttttgcattttttggtagatatgggtttttgccatattgcccaggctggtcttaaacttctgggatcaagtgatctacctgccttggcctccccaagtgctgggattactggagtgaacctccacaccctgcctcttctcaaacttttttattacacttgacattttgaaatgaggactaagtaaatttgctcacacataaatgctaccaccatatgatgcagatgggcactgtttgtgacattgtttgattctccacagaggcactggccatcatgaagtgattttctgaaatggtgaataacactgtcaataaaaaaaagtcaaactctgcaaaatatttcgagagtttattccaagccaaatgtgaggaccatgacctgtgacacagccccaggaggtcctgagaacatgtgcctaaggtgttcaggctacagcttggttttgtatattgtagggagacacgagacatcagtcagtctatgtggggtatgcattggtttgtccgaaaggtaggacaactcaaagcctggggcttccaggtcataggtggattgaaagactttctgactggcaatttgctgaaagaatcaagtttttatctaaaggcctggaatcaaggggttgtgaagaaaggttcttatgcagatgaagcctccaggtagcaggctttagaaagaatagatggtaaatgtctctttcatgagaactaaaaatgtgccagactcttaattaaatccctcctggatcaggaaaagacctggaaagggaaggggattctctacagaatatagattttcccacaagagacaactgtgcagcgccctctcaaaatatgtcaaagaaatgttctattttggggtaaaatatttaaatttctttcaggtcctgctatctgttgtgttgatatctttttattttattttattttattttattttttttattttttttattttattttattttattttattttattttatttattttattttattttatttattttattttattttatttattttattttattttattttattttattattttattttattttattttattttattttattttattttattttattttatttttgagacagtctcactctgttgccaaggctggagtgcagtggcatgatctcggcttactgcaacctctgcctcctgggttcaagtgattctcatgcttcaacctcccaagtacagatgccaccaccccgcccggctaattttttgtatttttagtagagacggggttccaccatatcagccaacctggtcttgaactcctgacctcagatgatctgcccaccttggcctcccaaagtgctgggattacaggcatgagccactgtgccaggcctgttgtgttggtatcttattgctacaaagagtctgttctatcagtctgaagatctctgttttaatgttaacactggtcagttgtgcctgaattccaaagggaggagggtataatgaggcgtgtctgaccccctcacctttcccatcatggcctgaactagtttttcaggtttttttttggaatgtgcttggccaagagaggggtgcatcagtcagttggggagcttagaattttatttttggtttataacactttattaaggtccaaactaaacaaggtagtctttcctagattgacacagtagttgcattcctgaaaaattcagtatatattaaaaccgtgcaaaaactattttgttagcatgtaacacaaagttaggttctgaggtaattttgagcaagtttttgacccttggggactttgggcaggacatcctacagctgtgtggatgctggctgattctgcatggtacgggactgtcatgcacgtgtcaaccaaaaattaaattctaaggccccacaaccatctgaatggactttctttctcttctttttcatttcttttcttttcttttgagatggagtctctctctgtcacccaggctggagtgcaatggcacaagctcagctcactgcaacctctgcctcctgggttcaagcaattctcctgcctgagcctcctgagtagctaggatttcagacacgtgccaccatgcctggctaatttttgtatttttagtagagatggggtttcaccatgttggccaggctcgtctcaaacccctgacctcaggtgatccgcctgcctcagcctcccaaagtgctggggttacaggcgtgagccaccgtgcccggcccatctgaatggacttccttctaggtcagggcactctaaaatttaacctaaaagtctggtttaggccatgatgggaagtggaggctgaaaatgcctcattatacccgtcagcattaacatcaacacagaccttaagtctgatgagaggcatttatattatattctctgtagcctgctacctggaggcttcatctgcatgatcaaactttggactccacaacctcttatcacaacccagacattcttccctattgataactctttttttttttttttgagatggagtcttgctctgtcacccaggctggagtacaatggcacaagctcagctcactgcaacctctgactcctgggttcaagcaattctccttcctcagcctcctgagtagctaggatttcaggcatgcgccaccatgcctggctaatttttgtatttttagtagagatggggtttcgccatgttggccaggccggtctccaacccctgacctcaagtgatccacctgcctcagcctccaaaagtgctgggattgcaggcgtgagccaccatgcctggcctctattgataactctttcaaccaattgccaattagaaaaattttaaatctacctataaattggaagctccctcgcccctccagttgtctcatgcttctggaccagaccaatgtatatcttaaatgtatctgactgatgtctcatgtctcccaaaaatgtataaaaccaagctgcaccctgaccaccttgggcacatgttctcagggtctcctgagggctgtgtcacaggtcgtggtcctcacatttggcttggaataaacctctttaaatattttacagagtttgactcttttttattgacagcgttattcaccatttcggaaaatcacttcatgatggccagtgcctgtgtggagaatcacatatgtggcactcatatttagctcagaataaatctcttcaaatattttacagtttggctcttttcattgacatacattatcatgacatcttgattacaggggtgatacccacccctatcactgtgacaaccaaaaatcatccctgcaaaattacagtttcctaggaggcagctgtccccatcaagagccacggcttttagagtgttacagataaaatgcactgaggcaaaggtcctcgaacagatccaatccctttatctttctgttgatggcagtgttgttcattcaacatactctttcctttttttcttttcttttcttttttttttttttttttgtgaacaccatgcttctttctgtttgctgtatggagaatatagtctaccaggggacagagatgataagtattgagaggtgacagcgtgctggcagccctcgctcactctcggtgcctcctcagcctcactgcccactctggccgtgcttgaggagcccttcagcccaccggtgcactgtgggaggccctctctgggctggctgaggccggagcaggatccctctgcttgctgggaggtgtggagggagaggcacaggcaggaaccagggctggggtgctcacgggccagcgcgaattctgggtgggcgtgggcttggcaggccctaactcggagcagccaggggcagtgaggggcttagcacccgggccaggagctgcgaagggggccccgggtcccccagcactgccggccccgccggcgccacactcgaattctcgacgggcctcagccgcctgcctgcagggcagggctcgggacctgcagcccgccatacccgagtccccctgtggtgggctctcacgcggccaagcctccccaacgggcgccgccccctgctccacggcgcccggtcccatcgaccacccaaggactgaagagcacaggcacatggggtgggactggtgggcagctctgcccctagccctgacgcgggatccactaggcaaagccagctgggctcctgagtcaggtggggacttggagaacttttatgtctaggtagaggattgtaaatacaccaatcagcaccctgtgtctagctcaaggtttgtaaatgcactaatcagtgctctgtgtctagctaatctattgtaaatgcaccaatcagcaccctgtcaaaacggaccaatcagctctttgtaaaacagaccaatcagctctgtgtaaaatggaccaataagcaggatgtcggtggggccagataaggaaataaaagcaggctgcggcggccagcagtggcagcccactgcggtcgtctttcacaccgtggaaggtttgttcttttgctctttgcagtaaatcttgctgccgctcgctctttgggtctgcactacatttatgagctgtaacactcactgtgaaggtctgcagcttaattcctgaggccagcaagaccatgaacccacagggaggaatgaacaactccggatgggaagaatgaacaactccagacgcgccaccttaagagctgtaacactcaccgtgaaggtctatagattcactcctgaagccagcgaggccatgagccccccagaaggaagaaactccaaacacgtccaaacatcagaaggaacaaaccccagacacaccacctttaagaactgtaacactcaccgtgagggtccacgacttcactcttgaagtcagtgagaccaggaacccaccaatttcggacacagtatgataaataagcaaatagacaagacaagtaagggcttgtgatcattgctttgatggaaataagatggtttttgaaagagtaacacggcaggggatttatttcaaatagtgtgtgcaggagaagtctcgctgtggaaacactgatgtgagatctcgccgcagtaagagcagagagaagagggttcacatgaaggaagcagcacttgcgaaggtcctgaggctggaaagagtttggaatgcgtaccatgtgtgtattccaggatggctggtacttccaccctaggaccttggtgctggctgctcctttccctcaaacgttgggcctctccacatcctttccttacttctgttagacacctgctctaatctcattacatcagagacacccttcctgactcctctctataaacagcagccaccacccgagccatggcacccccatctcctttttcccactttactttcttccattgcatttacctctacctgtcagtacctatttcctcttccttttgttgtctatcacctcttccgtccaccagaatgtaagctccatgagggcaggcttggtccattttgctcacagctgtatctccagctcctaaaacaatgcctgaggcttggtgtgctggctcatgtttgtaatcccagcactttgagaggccaaggccagtggatcacttgaggtcaggagttcaagaccgtcctgggccaacatggtgaaaccccatctctactaaaaatacaaaaattagctgggcgtgctggcacacatttctaatccaagctactcaggaggctgaggtgggaggatcacttgaacccgggaggcggaggttgcagtgagctgagatagcaccgctgcactccagcctgggtgacagtgtgagaccctgtctcaaataaataataaataaaacagtgcctgacacataatgggtgctcagcaaatttttttaatgagttattgaggagaaaaactattcaagataatgttgacaagacagccaagagctgaatcatgtaagtactcacaggattttattccaagtacagcaggaaggaagggaagggccctgtacaaagaggaatgatataaaccagattatgtttttgaaagaacatgctggctgctggctggaaaatgaaagcaagaccagaaataagagagccagtgaggagtctccagtctggcccacgcaaagagatggcggcggcttacagtagggcagtggataggcttgggaggtggcaccaacaggacttgctgagggattggatattggggggatgtttaaaagaatgatgtttaaaagactctgctgtgttgtcaccctgagactctggatggatatggtgaagccatttactgagatgggggagaaattcagagtggtgataaacattctcaccaagtttttcctaacgattattagatgcctgagtttgaaactttgagtcaatccaggcatccatgcctacttctgatttgctgtagcttgtgtgccacagcctcccagtttctgtggaaaccccaccatacatcagccccagcacaaagcacaacctcgtcagagctagcccacctccagcaccgtgactgctccaggcttaatctctcctggtgttgacacttttgccagtgatggtgtctcatgggattcatgctctttataaaccattgccttcttcctatttctttcatttatttttcctctcattctcctgccctctgagctatataactcttcctttaccttccaacagaggcctttcattacatttaaagcaaatggaatgcatagtaggcaccaaagatggaggtgctgtgcaaataatagacaccaagctctctgcaggtggggtccttgtgtgttttctcttcatagcacccagcacaatacttggaacataagccagacacgttcattgagcaccatttctgctgcacccatgaaaaaaacactcaacccagacagatggttagctccccgacaggacttaagcaagtgggccagtctctgtttattgtcgtacactcacacaatcacacagctgccaggcgagcactaggcacttatcacacttttattaaaccgatcacatctggctctttgtggggtgccagaaagtgcccaatttctgcatgatgggatggactgtgtgtggagtaaggtcggataaatggagatgggccagtagcctagacaaattaagggagaaaaacagtgaatttattttccactcatcagccgagctttctgtgggctaggaacggggtacccggctgaagtgaagcaacattgtgtctcttcctgctgttttctccacctcccctcagcaaatcatgaatgaataaacaaacgaatgaatgaagaaacatagagttattataaggattaagtgaaggcagggtgcagtggctcatgcctgtaatcccagcatgttgggaggccaaggtaggaggatcgcttgagctcaggagttgaagaccagcatgggcaacaaagcgagacccccatctctatatttttattttaatttagaataataaataaaatttttttaaaagaaaagattaagtgaaatgttttttaagtacctagaatagtgcctagtatacagaaaattcaacgtaagtgtttgatagagagcaagaataggccaggtgtggtgactcacatctgtaatcccaacactttgggaggttgaggcaggcaggtcacttgagcccacaagttggagaccagcctgggcaacatggtgaaaccccatttctactaaaaatacaaaaattagccgggtacagtggcacgtgcctgtagttccagctaatcaggaggctgagatggaaggatggcttgaacccgggaggcggaggtggcagtgagctgtgatcatgccactgcactccagcctgggcaacagagcaagaccctgtctcaaaaaaaacagaaatagagtaagaatagttttgtctgtatctgccaacagccacgtctgtggagtcagaggaatgaaggggtcaaagggagcaggcacatcatagagaatacccccaagatctgaagaccccagtgcaatacctcgagcttaaatgcctgtgttttcattctcccttcttctccataggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatttccaggatgttggctggtttcttcataaactctctcaacagatactaaagaaagaaaaagaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaa

SEQ ID NO: 37385 - DNA, 15519 bp, Homo sapiens
gtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtaggtacaaggcaggtactccgggcctaggcggggaggccgcaggcgcctggagaggaccctggtggtggcggcactgggccgggggaggggacggagtgaagatggcgggtcccgcgcccgctttggcgccgaactaggccgcgcagcgggcctcagccgccgcgtgggagcgagggcggcgcctctgccttcgccgggccgcgtggcggggtttttcggtccccctccccctccgcagtttgcagcccctttctccctgcttcctgccggcgcgagcagccccccgccgcggcctttccgcgacccgacggccgccccccattgatttgaagttcacattcttcgaggttcacgcccccttggcccagagatttttttttttccccagccaaaaaatagtgagatgaaataacgggatcgagggagaggaatgttgctaccatttatctttgttgttgttgccgttgttaatatttgggggttttaatcagttggaggtgtttggagaaagggagcgttgagatttggggagttagatttttccagttaaatgttgcgagtagtttttcttatttcctggaaattctggtcaccctttgaaaagggaggtttgggaagcgtcagtcattaggacgttgacagctaagttagattaattcagacgtaccttaaataggctttgttctcaccattcccttgtttcgagttgccttcagattattttggaagagttcttactacaagatgaggctttttatttcacaaataatgaatctacacacagaaaataagtggtttgggtttttggtgtttcgtgggggttttttgctagctttgtgatttgcttttgtcttaaatttaagaaggaaagaaagcaataattctttccataaataattctttccataatttctaatagttacgttagcatctagagaaattttctctttacgtcatcttgacacttaactatttaagaagttcgatatttgtgactttttcagaccatatttatctactgttaagtgtgtaaatctgtcgctaaaattggggagtaaaaataagtgcttggtatttttcagagtgctagagtcgatttgatgctgtaaaagtaaaaaaaaaaaaaaaaacaaggcttatatacaacctaatgctgctgtaccttttatgaaaaatgacggctgtagataaaaataagttgtggtcattcccttgtaccatacatatgtctgctgttgtcctgttaatgtaaactgcatttttatcttccaaattcttggatcctagctttccttcatcaaaaagatatattgcctatacatcttaaggacttggacataaaaatttgaggtctttttatgatgttttaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatgtaagtggtaacatctaaaaagtagttctttttgtcctctaataaatgtctgtcttcaaatttttgaaaattaattctgactcacacattgctctcgttattaaagttaatccaaaaatggtaaaatatataaattcccattcatgcttctgaaactcatatcgatgattatatatgtgatttaaatttgaatgcactctggttgctactacctttaatgtaagtcctttaaaagttaatatgttcttgtgcttagcaattaaaatttggtattcttgtttgttaatttgaatcacttgatcaaaaacaaattgtataacaatgaggtaaacttctttaatattgtcccctaatttgctgtcctctgttgttacctcagagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatgtatcctacagaataactatttttcttttttttttttttaatgttttgtaagcagttaattttcaaaattattctggtttggtctagtgacaaaacctgtaacttgatttatgtgggcctttgatgttgtgattgtggtcttgtgtaaatgcactctctcttatgaagttaaagtgtaacaggatgtatattcttaagattaaattcagcatattttggttttggaccaggtggtcagatgccacggagtagcaggcagtgctctttggagtagcgtggggttctggggttaagccacagagccctgcttaaaggagagacaggtgcatgcactggggactacttagaaacagctctggtggtcttgtagggtcagaaccactagaaattttgtttatatatagattttaaagtggttgctggggacacatataaacccttaacttctttaacttagccctgtgaagactgctggccctgcgctgctttagcacaatgatcagttggccctgaatgagttgcagaaggccttctccctggtataggtacctaactgggacctatgggagactggtccctgacccagagtttcaggtgaccttacttccgttcctttcagtgagatcatctccctgcaacaagggtttgggttgtggacctcagactaggaaaagttcttcctgcttaaattcagtgagcctcaaacttttaagttagtggagtcctagtgagacttagggaaaagccaaaaactactcctgcagggccagtgatcaaggacagttgtgagaattggttgcaaagctccattacagagaaaataatagctatatctggcttagtaaataaaggtagcagtgcgttctggcttacaacatagacctcattttacctagtgttgggtggccgaggaatcaaggtcagtagtagtttgattcaagagtgtgtgatatttgaggcaaaaaaggctagtaattcaaagcaatctaaaggagaatgataattttaaaatacatattcagtaagtctatggttttaaaatagttgaaaagaaataagtaacaggcttatgaatttcatttttgaaaagaccataaagtacaaatttctccatgactgacatcagagtgatactcggctgcctctgctgctgctgtctcttctgtctgactccattcgcaatagccttttcttcctatccctggcttaccgagtaaagtagaaacttgccatcagcccaggattctgttttcgagggtagccccagagaggatgctctgttctcattaataatttttacagctctcaatataaatcctttttatacttattatattctgtctcttggggtaacaaagtagtgtacccattaagtgaacgtattccttctaattagtttagagcccagctgcattaaccttgagggatgttcagttacagtattcaaggttctgaactccccatcagcctttcccttttcatgttgaaagcccagttatttagaatttgtccttccatttaatctgttcataatggcctcgggaagacagagctggaaacctgcagtccttaattcctttcagaacaaaaagtgggaagtctagtaaggcagaccttttagtctctataataaaaaaataccagtatcggtctcaaaaaaggagtgtgtcacttcagggatattttaaatcacctctctaaatctgcagtcttgtgttgtctctcaaatttaggaaaaagaaatgtgcaaactagaatggggatttttgggatagaatgaaaacctatacctgtacctaacctagctctctttccaaaccatttatatcaaacactgtcttgaatgtgtacttggcctctgttaaaatgatggttttaggaaaggagctaggtttggacagaatagctatataaagccagcagttctcgtagtattattgctgacatgaccagggaggacaagcagcttagcttctcagatcaaaaacaagtaccagtagttcctgcttaaggctggtaaataatatcttgaaattctcaagttggaaaccagtctcaaacccatttctttgcaagaagttgtatatttagggtcatggttagggctttccagtctaggagtccttccagtggtctgtttcttgatagcatgcttttacagtctgcatggatgtaataacgcttttggtatagtgattgtcttgagtactgcttgactctggtcttgatgcccacaaatggctagcgtgcttgtcttcccatgcagtggaaggaagacagttaaatgaaatagtagtattagatatatatgaaaaagaaaacagcaaaataaatttgaagttaatgctttcctctcttgtaaggtaaggcatatactgcttgcttacacaagaactattggcattttctttttttcgtttgaaacaaatatgaaaaatagtattttggttttaagaaatttttattttagcatacaacatataactgacatttgttttttcttttttgtcttgtaaacttaattcttaaaacttaggaaaatttttggataggacaacttggtgattcagctataacagatcttatttcaataataactttactgcaatatgtattcatacattttcaaatgtgtgccttaggaaatcacaagtgcttttatagtgtgaagtgttaatgactgaatccaactgaatcaccaactagtaagtgggggtctggttgatgttctggaataatattgggagattgtgaattgttccagacataccaactgaactttcattcattatcaaagtttgcaaaacttcccaagccccttaacatttagcacatttgaggatgttcgtgatgctgaagacgctttacataatttggacagaaagtggatttgtggacggcagattgaaatacagtttgcccagggggatcgaaagagtaagtacccttatgcctgatatgtatgaaacattattttttagtgttttgagatttttttttaagaatttaagcaatttgtgtttctgttcaaaacccaaagggatcttttttttctttctttctttcttttttttttttgagacggagtctcactctgttgcccaggctggaatgtgtgcagtggtgtgatcttggctcactgcaaccaccacctcccgggttcaaatgattcttatgcctcaaccttccgagtagctgggattacaggtgcatgccaccacatctggctgatttttgtatttttagtagagacggagtttcaccatgttggccaggccggtctcgaactccccacctcaggtgatccacctgcctcagcctctcaaagtgctgggattgggattacaggcgtgagctactgtgcctggcccaaaatgatcatatttaagaaaatggagtatcttgaatatttcatcatgtgttccagattgtaagttttggggtaagtgtaagtaggaggtggagatgagaatgcctgaaatatatgtggactcttttgaaagttggttatgcaggcttaccagatgttcgctgcgtacttacaaggcaggaatacaggttttagagtcaaaaagacctgtgtgtgaattctggcttagccattatgttaccttgggcaagatactaattaagagattaaaataaccgcagggtgcagtggctcacacctgtaatcccagcactttgggaggccgaggtgggtggatcacaaggtcatggtaaaaccccgtctatactaaaaatagaaaaaattagccaggcatggtggcctgcacctgtagtcccagctgctggggaggctgaggcaggagaattgcttgaacccggcaggcagaggttgcagtgagccgagatcatgccactgcactccagactgggcaacagagcaagactgtgcctcaaaaaaaaaaaaaaaaatagctgctgaggagaggaggagctcttgagtactcaatgcaaactattggaactctagttcttgagttgggtaatagattcctggttatgcattgtgttttttatatgtactccaatacataaagtatctgcttcattgaattgaatgagataagaattgaagtgtacataaggcatttaggaatgccttattattctacttagggtcttagaactgtaatattactgcatgttgacactgcacattgttcataggccacctataaatattttgttaattgtgttcttaatgaatggaatctgtggtgggatcattccaaatcagcatatggttcagtggtcatttttttcagccatttgaaaatgtaaaatatgtgggtgtggtagctcacgcctgtaatcccaccactttgggaggcctaggcgggagaattgcctgagcccaggagtttgagaccagcctgggcaacaaagtgagaccccatctccacaaaaaataaaataaaaaattagccaggcttgatagtgcacacctgtggtccccgctaggcaggaggatcacttgggcccaggaggttgaagttgcagagagctgtgtttgcacaagtgcactccagcctgggtagcagcaagacccaatctcaaaacaaaaaggcactcacttccatttggagtttttaaaaatccttttatggtatggattcccagtgtcagaacagttaccaggtcttggctgataaactagatggtgagaagactttgaaaatagttggggatattagtattatttttaacataaaacagtcttctaatacactttcttgaaaataaatacgtgcctttttcaagatgaaaatttgcagttacctcaacccagccttggctaaatcacgttctgcatctgcatctcacaccaaaactacagacacctctaaaacagactccagggctgggcacggtggctcaagcctgtaatcccagcactttgggaggtcaaggcgggcaggggcagatcacctgaggtcaggagttcaagtccagcctgaccaacatggagaaaccctgtctgcactaaaaatacgaaactagcctggtgtggtggcgcatgctgtaatcccagctacttgggaggctgaggcaggagaatcgcatgaactcaggagacggaggttgtggtgagccgagattgcgccatcgcactccggcctgggcaacaagagcaaaactccgtctcaaaaaaaaaagactccaggctgggtgcggtggctcacacctgtaatcctagcacttcgggaggccgaggcgggtggattatttgaggtcaggaattcgagaccagcctggccaatatggtgaaaccctgtctctactaaaatacaaaaattagccgggtgtggtggcgcgtgcctgtaatctcagctcctcaggaggctgaggcaggagaatggcttcaactggtgtggggtggaggttgcagtgagttgagattgcgccactgcattccagcctgggtaacagagcaagaccctggtctcaaaaattaaaataattaaaaaaaaaagacaccaaaacacatacacactttttttttttggagacagggtctctgacccccaggctggcgtgcggtggtgtgatcacaatttactgcagccaccaactcatgagctcaagtgatttccccccttagcctcctgggtagctggaatacatgtgcaagccactaggcccagctaattattttttgtagaaatggcatattgctatgttgccccaggctggtctcaaactcctgggctcaagtgatcctcccacctcaacctcccaaagtagtgggatcacaggtgtgagccaccacccgggtcatacatactctctttgggatataagaggggatgcagggatttttttccctatttattgagggctttaatactgtttttaatatttttaaatatttctgttctttgtatttcctagcaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaagtaagtgtgctgtgtagcacagtgatctgtttaaaaaatgtatttgttagcatttaatttttttttactattttgtatacttttaattatatacattgaatgtttcattgagacaaaaaatactgtagcattttattttaaaagttttatggtttgcttttaattagaaactttgcctctatgaatagatatttgtcactgctttttctgatatgctttttagcagtagaccgactggaagaccacggcgtagcagaagccattccgacaatgataggtaaataactttgctttgaaaaagactcatgtattttttaatttcagagtgaacttttgctctaaaaataacaaatttgattaatatagaatctaatttttactctaattatatctctcctctgttttgaaagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtacgaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaataatgattaactggaattattacagtattgaatatgattctaaaataacaatggaaacagtcctttatagatttaggaatattttaaatcattgttgcactaggcacaactaacttttactttggaaatgatagaacttgccagaaaggtacatcttttacacagtagttaaaaattcattgtgtaatatcaaagttgtttcatgattgctcattaagcctcttgggttaactaacttaagaggttatttggtagtgttaagatgaaatttggatcagctaattccaagtttatattttcattattggatggatcagtaattctgctctccctcttataaacaagacgcattagggcttaacgtttatgacatgattttaaatcattttaaattgaatgttgatgagcaactaatattaagtgataacctctttggggaagtaggttaggtattttgtggtttgaattctatctactttatgacaattatagctaatttattaagtattcatgatgtgccagacacttgaaaaggctatgtgttaactcactcttcacaaaaccttatgagaaagatacttttattttccccatatcacagataaggaaactgaggcacaaagaaaagactgtaaggcagagccaggatttaagcccaggcctggtcccttagttttgggggggttttgtttgttttacagactataatttgagagaagtagattgaggagatagctcattgaaattgttcattttctgtatagaactagaaggcctaatttcatttttatttttacttgtgtcaacttatttttagacttggactattgagaatcttatatgttgttcctaaagcgacacacctaacagcttcaaaaggactatattacagttgaacccatggtagtttggatcctactgatacttgatgaggatctttacgtagtgttttatgttagttttgggtgatgtagttgagtcccccacttactgagtttacctactgtgtatgactgggctcaatgataaatagaatggttatatcaacactcaaatgagggctgacacacttcacctctccttttacttaagatctctctgcattttttttttttttttgaagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaaggaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgatttttgtcatcttttttgccacatacttaaaattttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctctatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattgctatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagcc

SEQ ID NO: 37386 - DNA, 13875 bp, Homo sapiens
gtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtaggtacaaggcaggtactccgggcctaggcggggaggccgcaggcgcctggagaggaccctggtggtggcggcactgggccgggggaggggacggagtgaagatggcgggtcccgcgcccgctttggcgccgaactaggccgcgcagcgggcctcagccgccgcgtgggagcgagggcggcgcctctgccttcgccgggccgcgtggcggggtttttcggtccccctccccctccgcagtttgcagcccctttctccctgcttcctgctggcgcgagcagccccccgccgcggcctttccgcgacccgacggccgccccccattgatttgaagttcacattcttcgaggttcacgcccccttggcccagagattttttttttccccagccaaaaaatagtgagatgaaataacgggatcgagggagaggaatgttgctaccatttatctttgttgttgttgccgttgttaatatttgggggttttaatcagttggaggtgtttggagaaagggagcgttgagatttggggagttagatttttccagttaaatgttgcgagtagtttttcttatttcctggaaattctggtcaccctttgaaaagggaggtttgggaagcgtcaatcattaggacgttgacagctaagttagattaattcagacgtaccttaaataggctttgttctcaccattcccttgtttcgagttgccttcagattattttggaagagttcttactacaagatgaggctttttatttcacaaataatgaatctacacacagaaaataagtggtttgggtttttggtgtttcgtgggggttttttgctagctttgtgatttgcttttgtcttaaatttaagaaggaaagaaagcaataattctttccataatttctaatagttatgttagcatctagagaaattttctctttacgtcatcttgacacttaactatttaagaagttcgatatttgtgactttttcagaccatatttatctactgttaagtgtctaaatctgtcgctaaaattggggagtaaaaataagtgcttggtatttttcagagtgctagagtcgatttgatgctgtaaaagtaaaaaaaaaaaaaaaaaacaaggcttatatacaacctaatgctgctgtaccttttatgaaaaatgacggctgtagataaaaataagttgtggtcattcccttgtaccatacatatgtctgctgttgtcctgttaatgtaaactgcatttttatcttccaaattcttggatcctagctttccttcatcaaaaagatatattgcctatacatcttaaggacttggacataaaaatttgaggtctttttatgatgttttaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatgtaagtggtaacatctaaaaagtagttctttttgtcctctaataaatgtctgtcttcaaatttttgaaaattaattctgactcacacattgctctcgttattaaagttaatccaaaaatggtaaaatatataaattcccattcatgcttctgaaactcatatcgatgattatatatgtgatttaaatttgaatgcactctggttgctactacctttaatgtaagtcctttaaaagttaatatgttcttgtgcttagcaattaaaatttggtattcttgtttgttaatttgaatcacttgatcaaaaacaaattgtataacaatgaggtaaacttctttaatattgtcccctaatttgctgtcctctgttgttacctcagagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatgtatcctacagaataactatttttctttttttttttttttaatgttttgtaagcagttaattttcaaaattattctggtttggtctagtgacaaaacctgtaacttgatttatgtgggcctttgatgttgtgattgtggtcttgtgtaaatgcactctctcttatgaagttaaagtgtaacaggatgtatattcttaagattaaattcagcatattttggttttggaccaggtggtcagatgccacggagtagcaggcagtgctctttggagtagcgtggggttctggggttaagccacagagccctgcttaaaggagagacaggtgcatgcactggggactacttagaaacagctctggtggtcttgtagggtcagaaccactagaaattttgtttatatatagattttaaagtggttgctggggacacatataaacccttaacttctttaacttagccctgtgaagactgctggccctgcgctgctttagcacaatgatcagttggccctgaatgagttgcagaaggccttctccctggtataggtacctaactgggacctatgggagactggtccctgacccagagtttcaggtgaccttacttccgttcctttcagtgagatcatctccctgcaacaagggtttgggttgtggacctcagactaggaaaagttcttcctgcttaaattcagtgagcctcaaacttttaagttagtggagtcctagtgagacttagggaaaagccaaaaactactcctgcagggccagtgatcaaggacagttgtgagaattggttgcaaagctccattacagagaaaataatagctatatctggcttagtaaataaaggtagcagtgcgttctggcttacaacatagacctcattttacctagtgttgggtggccgaggaatcaaggtcagtagtagtttgattcaagagtgtgtgatatttgaggcaaaaaaggctagtaattcaaagcaatctaaaggagaatgataattttaaaatacatattcagtaagtctatggttttaaaatagttgaaaagaaataagtaacaggcttatgaatttcatttttgaaaagaccataaagtacaaatttctccatgactgacatcagagtgatactcggctgcctctgctgctgctgtctcttctgtctgactccattcgcaatagccttttcttcctatccctggcttaccgagtaaagtagaaacttgccatcagcccaggattctgttttcgagggtagccccagagaggatgctctgttctcattaataatttttacagctctcaatataaatcctttttatacttattatattctgtctcttggggtaacaaagtagtgtacccattaagtgaacgtattccttctaattagtttagagcccagctgcattaaccttgagggatgttcagttacagtattcaaggttctgaactccccatcagcctttcccttttcatgttgaaagcccagttatttagaatttgtccttccatttaatctgttcataatggcctcgggaagacagagctggaaacctgcagtccttaattcctttcagaacaaaaagtgggaagtctagtaaggcagaccttttagtctctataataaaagaataccagtatcggtctcaaaaaaggagtgtgtcacttcagggatattttaaatcacctctaaatctgcagtcttgtgttgtctctcaaatttaggaaaaagaaatgtgcaaactagaatggggatttttgggatagaatgaaaacctatacctgtacctaacctagctctctttccaaaccatttatatcaaacactgtcttgaatgtgtacttggcctctgttaaaatgatggttttaggaaaggagctaggtttggacagaatagctatataaagccagcagttctcgtagtattattgctgacatgaccagggaggacaagcagcttagcttctcagatcaaaaacaagtaccagtagttcctgcttaaggctggtaaataatatcttgaaattctcaagttggaaaccagtctcaaacccatttctttgcaagaagttgtatatttagggtcatggttagggctttccagtctaggagtccttccagtggtctgtttcttgatagcatgcttttacagtctgcatggatgtaataacgcttttggtatagtgattgtcttgagtactgcttgactctggtcttgatgcccacaaatggctagcgtgcttgtcttcccatgcagtggaaggaagacagttaaatgaaatagtagtattagatatatatgaaaaagaaaacagcaaaataaatttgaagttaatgctttcgtctcttgtaaggtaaggcatatactgcttgcttacacaagaactattggcattttctttttttcgtttgaaacaaatatgaaaaatagtattttggttttaagaaatttttattttagcatacaacatataactgacatttgttttttcttttttgtcttgtaaacttaattcttaaaacttaggaaaatttttggataggacaacttggtgattcagctataacagatcttatttcaataataactttactgcaatatgtattcatacattttcaaatgtgtgccttaggaaatcacaagtgcttttatagtgtgaagtgttaatggctgaatccaactgaatcaccaactagtaagtggggttctggttgatgttctggaataatattgggagattgtgaattgttccagacataccaactgaactttcattcattatcaaagtttgcaaaacttcccaagccccttaacatttagcacatttgaggatgttcgtgatgctgaagacgctttacataatttggacagaaagtggatttgtggacggcagattgaaatacagtttgcccagggggatcgaaagagtaagtacccttatgcctgatatgtatgaaacattattttttagtgttttgagatttttttttaagaatttaagcaatttgtgtttctgttcaaaacccaaagggatcttttttttctttctttctttcttttttttttttgagacggagtctcactctgttgcccaggctggaatgtgtgcagtggtgtgatcttggctcactgcaaccaccacctcccgggttcaaatgattcttatgcctcaacctcccgagtagctgggattacaggtgcatgccaccacatctggctgatttttgtatttttagtagagacggagtttcaccatgttggccaggccggtctcgaactccccacctcaggtgatccacccgcctcagcctctcaaagtgctgggattgggattacaggcgtgagctactgtgcctggcccaaaatgatcatatttaagaaaatggagtatcttgaatatttcatcatgtgttccagattgtaagttttggggtaagtgtaagtaggaggtggagatgagaatgcctgaaatatatgtggactcttttgaaagttggttatgcaggcttaccagatgttcgctgcgtacttacaaggcagggatacaggttttagagtcaaaaagacctgtgtgtgaattctggcttagccattatgttaccttgggcaagatactaattaagagattaaaataaccgcagggtgcagtggctcacacctgtaatcccagcactttgggaggccgaggtgggtggatcacaaggtcatggtaaaaacccgtctatactaaaaatagaaaaaattagccaggcatggtggcctgcacctgtagtcccagctgctggggaggctgaggcaggagaattgcttgaacccggcaggcagaggttgcagtgagccgagatcatgccactgcactccagactgggcaacagagcaagactgtgcctcaaaaaaaaaaaaaaaaatagctgctgaggagaggaggagctcttgagtactcaatgcaaactattggaactctagttcttgagttgggtaatagattcctggttatgcattgtgttttttatatgtactccaatacataaagtatctgcttcattgaattgaatgagataagaattgaagtgtacataaggcatttaggaatgccttattattctacttagggtcttagaactgtaatattattgcatgttgacactgcacattgttcataggccacctataaatattttgttaattgtgttcttaatgaatggaatctgtggtgggatcattccaaatcagcatatggttcagtggtcatttttttcagccatttgaaaatgtaaaatatgtgggtgtggtagctcacgcctgtaatcccaccactttgggaggcctaggcgggagaattgcctgagcccaggagtttgagaccagcctgggcaacaaagtgagaccccatctccacaaaaaataaaataaaaaattagccaggcttgatagtgcacacctgtggtccccgctaggcaggaggatcacttgggcccaggaggttgaagttgcagagagctgtgtttgcacaagtgcactccagcctgggtagcagcaagacccaatctcaaaacaaaaaggcactcacttccatttggagtttttaaaaatccttttatggtatggattcccagtgtcagaacagttaccaggtcttggctgataaactagatggtgagaagactttgaaaatagttggggatattagtattatttttaacataaaacagtcttctaatacactttcttgaaaataaatacgtgcctttttcaagatgaaaatttgcagttacctcaacccagccttggctaaatcacgttctgcatctgcatctcacaccaaaactacagacacctctaaaacagactccagggctgggcacggtggctcaagcctgtaatcccagcactttgggaggtcaaggcgggcaggggcagatcacctgaggtcaggagttcaagtccagcctgaccaacatggagaaaccctgtctgcactaaaaatacgaaactagcctggtgtggtggcgcatgctgtaatcccagctacttgggaggctgaggcaggagaatcgcatgaactcaggaggcggaggttgtggtgagccgagattgcgccattgcactctggcctgggcaacaagagcaaaactccgtctcaaaaaaaaaaagactccaggctgggtgcggtggctcacacctgtaatcctagcacttcgggaggccgaggcgggtggattatttgaggtcaggaattcgagaccagcctggccaatatggtgaaaccctgtctctactaaaatacaaaaattagccgggtgtggtggcgcgtgcctgtaatctcagctcctcaggaggctgaggcaggagaatggcttcaactggtgtggggtggaggttgcagtgagttgagattgcgccactgcattccagcctgggtaacagagcaagaccctggtctcaaaaattaaaataattaaaaaaaaaaagacgccaaaacacatacacactttttttttttggagacagggtctctgacccccaggctggcgtgcggtggtgtgatcacaatttactgcagccaccaactcatgagctcaagtgatttccccccttagcctcctgggtagctggaatacatgtgcaagccactaggcccagctaattattttttgtagaaatggcatattgctatgttgccccaggctggtctcaaactcctgggctcaagtgatcctcccacctcaacctcccaaagtagtgggatcacaggtgtgagccaccacccgggtcatacatactctctttgggatataagaggggatgcagggatttttttccctatttattgagggctttaatactgtttttaatatttttaaatatttctgttctttgtatttcctagcaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaagtaagtgtgctgtgtagcacagtgatctgtttaaaaaatgtatttgttagcatttaatttttttttactattttgtgtacttttaattatatacattgaatgtttcattgagacaaaaaatactgtagcattttattttaaaagttttatggtttgcttttaattagaaactttgcctctatgaatagatatttgtcactgctttttctgatatgctttttagcagtagaccgactggaagaccacggcgtagcagaagccattccgacaatgataggtaaataactttgctttgaaaaagactcatgtattttttaatttcagagtgaacttttgctctaaaaataacaaatttgattaatatagaatctaatttttactctaattatatctctcctctgttttgaaagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggctgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtaagaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaaggaaataatgattaactggaattattacagtattgaatatgattctaaaataacaatggaaacagtcctttatagatttaggaatattttaaatcattgttgcactaggcacaactaacttttactttggaaatgatagaacttgccagaaaggtacatcttttacacagtagttaaaaattcattgtgtaatatcaaagttgtttcatgattgctcattaagcctcttgggttaactaacttaagaggttatttggtagtgttaagatgaaatttggatcagctaattccaagtttatattttcattattggatggatcagtaattctgctctccctcttgtaaacaagacgcattagggcttaacgtttatgacatgattttaaatcattttaaattgaatgttgatgagcaactaatattaagtgataacctctttggggaagtaggttaggtattttgtggtttgaattctatctactttatgacaattatagctaatttattaagtattcatgatgtgccagacacttgaaaaggctatgtgttaactcacttactcttcacaaaaccttatgagaaagatacttttattttccccatatcacagataaggaaactgaggcacaaagaaaagactgtaaggcagagccaggatttaagcccaggcctggtcccttagttttgggggggttttgtttgttttacagactataatttgagagaagtagattgaggagatagctcattgaaattgttcattttctgtatagaactagaaggcctaatttcatttttatttttacttgtgtcaacttatttttagacttggactattgagaatcttatatgttgttcctaaagcgacacacctaacagcttcaaaaggactatattacagttgaacccatggtagtttggatcctactgatacttgatgaggatctttacatagtgttttatgttagttttgggtgatgtagttgagtcccccacttactgagtttacctactgtgtatgactgggctcaatgataaatagaatggttatatcaacactcaaatgagggctgacacacttcacctctccttttacttaagatctctctgcatttttttttttttttgaagccaagtaagcaagaagaaaaatgagagataatgcttcagtgagagaggaaaggtgctacatagagtatgagctgttaagttacaacccaggggaaagacctgggaactattgtattattctcttgaaaatttggcccagtaagctgctacatccagttcaactaacaaaatcctgtataccacagagaagaataaagaaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcac

SEQ ID NO: 37387 - DNA, 24123 bp, Homo sapiens
gcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacggtgagtagtggcgcgcggcggctcggagtacctctgccgccgcgcgcatcggctcagcatgcccgtctctgtctcctcagggcgcaccttccccaagcgcggccagacctgcgtggtgcactacaccggtgagtcgggggcccagcggggagggggcccgggccgcagtccgcagcccgggtgcggctggccgtcgaggcctgggggcccggggcctggggtccggggcgtggcggcggcgaggtccgcatggcccgaggctgaggcctgggcggtggctcaggggcagcctggggcttgcggaacccgggcgggtctgaatcggcggctgtgagcgtcggctgcgggctaggtgttatctgacccgtcagaagcatttctgcaccttagatgctgcccttatgcccgctgcacagatgaggaaactgaggcttggcgaggcgaagtcactttcccaaggtctcactttcccaaggtcacactttcaggaatgggcagagctctggccagggaccattaggaaggatttgtaccatttctgtgcccctgcccccacttccatccctcccttcactggagatgaggacgaggtaattccgagtctgcagagctgctgcttcctccggggaactcggaattcgcccctttgcctagggtggggaaacatcccacttcctaagtcattgctttggcccttcctggccttgggggaagtagagctgcacggccttcttccgtctttttacttttgagccacttacaaatccaaggctcagtgacagcgctggctcaggctgaccgaaagctgcacgtgtaatttagtcccccagctcttctagaagtagagacttttctcgtcctcattttaaagataagcatctggaggctaatacatagtgataatacaagccaaaggaaattttagacacctccccctccccagccagaattcagacatcagagtcgtgtgccttggggctgtcttactccttctccttacaagcttgtcctggtttgtatgggggcgggggagggggagagctgagttggcggagactcagtggctgtgggtcccacaagggtggcagtgattggtgtagccacagttgttgatacgaataaccttccctccccctcctccttcccctttctcaaccttcccaccctttcctctgttccccctcctcctccctctttttttcccactccctctcctcctcttcctcctcctgggtagtaggctgtgggcagttctggccaagttgctcacgaataagctccacctttctcttccaaatcatggaaacatggagggatccctctattgagggaaatgactttcactggaaagaggaaaaggcaactaacatcccccctcccatgcccttttatttctgtggcccttccccgtgggtagaaatgggggcaggaggtagaagttaaggactagaactttaaaaattctgccaaaggaggagttactgaaacccatctttctggggagcaggcagtctcatgtccgtgaaggaagctggaaagtgcttttgatgttttagatagctgtccttgtaggccacagtcagcacctgagcctgggaggtctggtagatgaaagcgcatccttttggtgatttgtcatcggaaggatgaggagagtaaccatttacagtgctggggtgagtgggcagttcattcagttccgcagccaactggggcaaagattgggactcaagccgtgaggagctgccttctgccgcaccccctccccaccctagcttgtacatagccacactagggtgcttggcagcatgtgtcccactcccacgtctgcccctcatgctcgcccatgttctggtgctgccaacaggactggaccccagcatgtaggcagtgccgcacttcaccatgtctctttgtgaaatatccccacacagcatgtctggagccttttcctatgagaacagatggtcatgagacccagaacaccatcagggtttccagtgcctcttgaagtgtgtgtttttctcgcgggtggcacgcacccacatgtttccagagcagcagcaggaccctggcatgcattaggacaaaagctttctttttgatttcgttttgataagccctataaagacgccttagtgagaagccagctctgcctcatgctcacagaatagactgttttcgagcaggctggtggctttgttcccgtgggtctttgtcaccagcctcccaggaataacctgtttgagacctgtgggggcgtgagaggagtgggtaggcactgggagatctcatctgtagcagttaaggcttttaagtcactgggaacagaatccatcttgggggaacatgatcagaaggtggaggttataaaggttccaggggttttcaaaggcagaagcccactgggtcctaagaagggaaaagaaataatcatgatgcctctagttctcatctctgttttttggttgttgttttgtgttttgttttgtttcctgcctgactgcctcagtagtctcctgttagagatttgtgtttgtctgcttctcccaactggtgggtggtggaagtcccctgcatgctcccccgtcccccctcccccctcccccctccccatggccagcttctctgtcttcttttgagtatctggctcagatttcttggctgtgattctgattgttacttctctgagaaggagagtttgagtaaggtgaacactcttgatccagtcagctcttgccaggtgtccactcagctgatttgggcacgggtccagagaaagaggcgtggaagtaaggtggccaaaatctccccttagccatcacaggtgtgcagagcacagactgacctttaccacatggatgctttaaatgccactaatggctgtcagtcaccttgatgtcactctcaagggtccctctggtgacttccgtgaccttctggcagagcacagcatgagcaaggcctcaaaggaatgcctgcactacctctgtggtaccagagggaaaatacaaagttcactatcaccagctaagcatctcctaggagcatgacaggcattgaggtgggagggaggtggtggaaaggtaagctgccaagtaagtgcctttaggagccagggaattctcatggcgcctccctgctgcctccagtagcttcgtcatctttactgttagcttgtcctggcacacagctaggtttagacctcttttacttacttcagcaggccgtgtgcctgccattgtgagagcagccccaaggggattgaaggaatgttttcttttttcttcttaaaaagtaactaactggacattttgtccttgggatcaggtttaagtcaggtatagcctcccggtttctgactgagaaaaaccaggagcccctcaacctcatgtcctcaggaggttgactgggaaggctgctgaggctcccgggacaggtgtggccactttgctgcagcctccctcaagccccttgcttttccttagctttgttcccccctctcctctgctttattccatccactcccttgctaggtatctcttggttggtgatctgatgtctggagggaggctcaccctcagcagagatgcctcagatggcttcccctgacgtgtgctgtcttgaggcacacaggctgtaactgttgggcagggctgcaacaagtccctttgccttcccacagcagatgttttttgagcaacagcagcaagccaggctctagggacatggctagtgaactaaatagacaaagacctgatctggtggggctttgcttatgatgaggagactgatagtatggccatggagcacatcaggtagtaagaagcgctggagagattaaagcagagtgagggatgggaagggaagttggctgcttttcgtgagggtgattggaaaaggcctctgaaaaaaatggcattttaacattcactcaaaggacattggagagggagctacagggctgtctagagtatccaggcagagggaagagctagtgcaggaccctgaggctggagcctgctcggtgcattagaggaacagtaagaagaccggtgcgttagaggaacaggaagtggattgtgtgaaagggtatgtggcaggagatgaggggatggtggagcctcgttggtttttataaaaacgttgcctttttctaactcaggtgagagccactggctggcttggcttttaatgcccgcccccgcccccccaacccacgctccttctggctactgtgtggacaatgggcttttgggggcaaaggcagaaacaggacactggttgtatcccaggtgtgtggagtgccagctcaggcagtgggcagaagtggtgccaggtggacagtgatccccaaagagcatgtgggttcttcgctgtgttctgatcttgaccctgccatacaacgggctatgagagcttgaacaaattgtcccacagttcccagcttccacatgctgtctataaaatgggagtaacgatgcctgctgtgaagcaaatgcctatcgagactacccagttgtctccaaagtgttgctcttttttaaaaccacagttccattgagcctcactcatcgcagttgttatgtctgtaatctcagtctagaagagtccttacgctgtttttttcttaataactctgatttcttcaaagagagcaggctagttatagaatactccacatctgtcttactgttttctcatggtattgtttaacttgttccctgccttgattttctgaaccggatgtttaatcttttaagtgtctgaatagattccgtttaaacattttagtgtgagtacttcatcctcagcacacatgggaaacatcactagttgtgatgctaaatttgatcttttctgtaaaggtacatttttccctttgcatttagcagtgatctgtggagtgcttaggtagccatagatggtctcttgctcatcagcctttcacctagtggtgtttacaccatctgatcattctcccctgaagaagtcactggcattcacaaagtgttgatttttaaaattccttcattctttctaaatttattagctgttatccttctataagataaggtaaagtaattctttacctttaaataccaaattttatttttattttttgagacagtgtctctgtcactcaggctggagtgcagtggcttgatcatggctcactgtagcctcgacctcccagactcccatcccggcctcccatccggccttctgaatagttgggcatacaggtgcatgccacctgtcctaatttttgtattttttgtagagacgggtttcgccaggtttcccaggctagtctcaaactcctggcctcaagtgatccaccctccttagcctcccaaagtgctggtagtacaggcatgagccaccgtgcccagcctttaattaccaatttttaaaatgaaaaatgaatgttaactgatggggtattgccattcccagtgggggcaagtgactttttccccctctatttgctttgactgtactgtgggctgaaattttttgtcagggccttaagatcaatgatacccattattctttttgatgctaatatcatcctaaatttggccagtaggagccctttaagctggctccagtacctttttgacaggctcccaccattccttcatccatttctcggtttcactactctggtccaattatcagccatctttcaaagagctctggttcctttcagtggggtccatgacctttttttttcttggtaacagctttattgaatataatttacataccataaattcacctatttactcatagatgttttaactagaacatttttaggcttaaactgatttttatgaattactgaggggtttattgtatccataaactggaaatcatttgtctgccttggaattttctctaaaaatattgtcacctgctgtttcccatggaagaagccaaggttatgaataacttaatcacatagcattcagttctccctttggtgctcatggtgacatttgtttatttttacttctattttttcttctgtttttttgttttcttttcctgctaaaaagcttaaccaagtctctgcattccctcccctggacccctttgattttgaccaggtgtattctagcagtgcagaaagtcggggaggtagaaataaccagttcttagatgctactgtctctttctgttacatttgctcttcctctcccaggagctcaagccaccttggcctgcattcattcctcgaatgctccaagccttttcccacatggaggtctctgcccctttgcttaggtgccaccacactgcccccactccccactgcatgacaggctcttttctttatagcacagcttaagtaacactttggatgcatacatgcatgcttctaattctgcaacaatgcacccatctattttcttagcccccatcatagtcaggatccgtgtagttaaacatctgctctttccccaaccgactgaaggctccaggaggccagacccacactagtgttgttctccaaggtctccccatcagtcttggcatagagtagctattcagtgactgtttgaatgagtggccagttaggacctggcattccctcggtcactcagtgaatatataaggagctgggcaaagcctcaatgttgccctcaagaagcttaccctgtagggagtggtcagttacaatgaaagtacctcaggcaacctacacctataggctagaacttcttggaggaagtgccatttggtcttgggtgtgtatggtgcagtcaggcaggaggaaagcgtcttccaggtatatacacaggccaggaggagaaaagggtacctttgatatttctgtaagtacttgatgaatgtctgctatgtacaagacactgtcctggctaccaagaatttaggagtgaagaagacacagttcctgccttcatctcacactgtagtggaaaagacataataaatatgattaataagcaagactgttgtgtataagctagtaagtgttaaggagggaataggaaaaggttgaggttttagatagattggcaaaggcctcaatgagaaagtgacatttgagcaaagacttgaaggaggtaaggatgtaacctatgtgactgtttgagcaagatcattttaggcagagagaacagcaaatgcaaaggcccacgggtggaggtatccctggtgtgtatgtagaacataaggaaacaatgttctgggactggaaaagtacaagagtaatcagaggtgaagtcagagggatggtggtaggggcggaggcttgacacttcttagagggtcttgtaggccattttaagagttttatctcctgagatgggggagtcacaggagtttttcagccgaggggtagtagggtctggctgctgtgtcaggtttagactgtaggagagcaagagcagaagcagggagaccagggagggagttgtaataatagtctgtaacagaggtccagaactcatgcctttaaccattataccctatagaaaatgcatatttctaccacttccagctagctattgttaagtggtatttcttttgatttttttggagatggagtctcactctgtcgcccaggctggagtgccctggtgcaatctcggctcactgcaacctctgcctcccgggttcaagcagttctcctgcctcagcctcccaagtagctgggactacaggcgcacgccaccatgcccggctgattttttgtattttagtagatacagggtttcaccatgttgcccaggctggtctcaaactccgaagctcaggcagtccacctgcctcagcctcccaaagtgctaggattacaggcgtgagccactgcacccggcctagtggtatttctttctccccctccccatgcgatataatgtggtagtaactcctcttatttatactgtgattaaagtggaaaatggagagacacacccacagggcatgcattctggtctgtgttctttttattgccgttggatcctgcatattcttcccatcatgggccctgcctttgaaaatacacttttggttataggatctaaagggatttagccaaaggttagaagcatttccatactgcgtatgggaaatgtgcttgcactgttggtgatctcaggaaaatgatagtgagagtgagctggttccctctttgggttggcacttggacctttggtcatacccctcactcataaggagttctcagaaccccacttcagggaggttgtgctggaatacagccacagagacccagaaatggaataataagaatgtaagatttgaatttgtatcttttgcctatctaaatgtagaatccctttttacccatcatgattgagacaagtgggtagttggtatgctaacataaaagtgacatggcttctgtaaacatttgatttcaaactctaacataaatcatttgctaaaggactatgtctttatctttgaggatggctctgctagtggagtttcccatcatagttcttgcaaaaaccaatttgaccttttttaaagtagagcaaagagtattgtgagaacatttaaaaaccaaacctttccagatttttaagatttctttctctaaatgtagtctcccatatgattattcactagcaatagttttttagtgacttgcctttattgagtctttcccaggagtcagctagaaccgctgtttgtattcacactcattttattgatttacatactatttaattacattatatttacacagtaaatatagctaccataaatggatttggggacaaacacagctaaccactcctccctttgtgaacacagaactcatatgggaatgaagaagtgatcatgagctagagactaaagcatgaggggagtgctcttcactatgctggggtacgaaggctgtgagttttatgagtctccaagtaaggcagctgagtaaaaggtggttaagagaacttctgtgtctaataagaagagggaaagcaaacagctaaaccattagaccttgagccatacgcccatctgggaatgttctgagtggcttcaaatgcaaagctgcagaaaaatactggctccccctacctccacccattcaaccattacacctttttttttttttttaagagacagagtctcgttctgttgcccagtctggagtgtacttgtgcggtcatagctcactgcaacctcaaacctctgggctcaagtgatctcccacttgatccactcaagtagctaggaccatgtctggctaaatttttttttttttttttttaattttttgcagaaacaggattggggacatgagtcttgctgtgttgcccaggctggttgcaaactcatgccagtctcaaactcctggcctcaagtgattctcctgccttggccttccaaagcactgggattacaggcatgagcctcctccgcagctggcctcattgtactttttgtcattaagaaactcacctgcgtgttgaaagtagaaatccttttccctctccaaactgtaaatggcaaggactttattttattttgaaggtttggggcttaggatattctggttttttgttatgtttgatttttggtttagtttagtcatttttttttttttaatcttaaaacttcccatattttgtccctgtaaaatgctgcctataggaaacactcctgcaaagattcatgagcaactataaactgcattgtgagtcatgagctttcactacaagtagtgaagccataagtctgtagaggtgccttcttcagtcctgttacccagtagaaggtatatggcactctgcccttccccaaagcagagtgccttggaagtgactccatttctattgggttattagtgaaatagtatcccagtggtccttgtgaatctccaggtcctggtcttgagtcttaaccaccgcttcagtggcttgagccaaccaccaggaacacagtctggggatactttgctgcccaggagctgctggccaggtctccctctgctgattccttgaaaagcaacaggaaagagcaggctgctgtggagtagacagacttgagactctctgcaccgtcttgttttgtaaacccttttgctccctttccaaggatttcagttcaggaggagacccaggcgaagatgacgtcaacagcctctgcatgcagtcagtcatagctttggcttctttcatggtcttgtgcttttaactggagcacattttcacatttttcttactgattagtaactaaaggtgcttaaagtaaagtttaccattctgggattacccctcatattcttgttaccatatagggaagaaggtctaaatatgaaggcctcatgcttgtccttctggttcttaaaaatcatgcaagtaaagcaaatccaagagtgctcttgagtaccagcaccatacgtgccaccaggacacagaacgcaggccaggtctgtgagcttgggctgcattcagtcaggagagccaagactaaatacttaaaataagaatatggagctattccaggcagtttgttaggcatgagttataggcttgtacggccaggaatgaaattggtcagttctgcaattagaaggcaatgcttgtgatgttttatgctgagtggcctttagagcttaaagactgtcagctgtcttgtctgcactgtaacctcagttgccttctctgagcagggcacgctttctttaggaaattatggcactaacttggcaggtggtttcactgttcaagggctccagctcctggcacaagtgatctccagagttaaaattggagcagctgctgagacttgacttgctgcctgctttacctgttccctccccaaagagaggaagcacttttcattcattgccagtgtgtatgtgggagctaaacatatatagcattttagtaaatgccactgcctactctttttcttttccttttttaaaaaagttactgaggcgtgattgaaatccaatatactgcacattttaaaaatgtacagcttcataaattttgatgtgtcattgtttccctttgaattcacccctccttaccctcctctaacaactactgatatgcttttttgtcagtgtagatttgttgcattttctaaagttttatataaatggaatcatacagtacgttctcttatgtctgccttctttcacttggtataattattttgagattcatctgtattgtcccatgtatcaattgtttgttcctttttgttgctaaatatttttctatatatagaaacatgtatttaccaacttacccgttggtggatgtttgggttagtttatagtttttgactatcgctaataaatctgctttgaacatttgtgtacaagtttttctgtggacatagcctgtcatttctcttggataaatactcaagatcagaatggctgggtcatatgggaggtgtatgtttaacttaactatcaagctgttttctgaagctttatgttatattcccactagcagtgtatgagaataccagttccttcacatcctcactaacacctgacgtggtcagtctttttagctttactcattctaatcagtggtggtagatgcgtttcctagtggttttaatttgcgttgttataataactaggaatgtttagcatcttttcatatgcttacctgccctctgtctttttcaatgaagtatctgttcaaatctttagcccttttttattggttttcttaattgttgaattttggtttgttatattctggatataagtcctctatcagatatgtactttgcaaaagttttctcccagtgtatggtttgtctttcattttcttaacagtgctttttaaagtactgaatttattttgatgaagttcaatttattcttttatagatagtgctttttgacatcatactaagaaatcttcacccaactcgaggtcacaaagatttctttcctatgttttcttctataaatttgataggtttagtacttaacatttaggtctaggatccattttgagttaatgcttgataatggtgtgaagtttttactgtgttatgtgtggatattttgtcatttcagcccaatgtaattttcatctcagacattgtagttttcatctctgaaagttggagtcttatggttctcctctactaattctaacatttgtgttagttctgggttgctttcaattgattgataagtctcctcattgtgggtcctgttttctgcctctttgcatgcctggtaatctttggatgccagacattgtgaattttgccttttggggtgctggatatttttattcctataaattttcctgagttttatactgagaagcatttaagttacccggaaacagtttgatgcttgcgagtcttgcttttgtgatttgttaggtaggtctagagctcagtttagggctgattatttcctactataggcaagatcttcctgagtattctgcccagtgctttgtcaatcatgagcttctccagtttgaccggggggtagtaagcactaatcctagccctgtgtgagcactggatactgttcctctaagccttttggatagttcttttcctggccttgaatagtttgctcagatacatgcactgagagggactctgctgaatactcaaagaggaccctgcagatctctggggatctctgtatagctctctcctgctggtactgtgtcctatggactctaggtgccttgagctccactccaggtccctctccctggaaactcccaaggatatagggctgcccttgtttcccatgtctcaggatttattgttcttcattacagatgtctggtgtcctacaaaccatcgttgtagctattttgtctaggtggtttttaggttttagtggactttttgtagggaggaaggggttggttggttggttgttggttgtttcatgaacaaatctgatccttgtcctccaccgtgaccagaaatggaagttctcactatctgttttgacattacagactgaacagcataattcctacacatgcacactcattccagcttaacaaacactgcttccaccttctcccccaggctgacaacttagggccatagataagtggcctgttcctccccactggggaagccctccttctccttgtcctgtagcttgtgccagttgtgtgacacccacttaatcacataccaccccacccatttcgggggattattgtttagctttcggactcgattatgggaaatcctctccttggactcaaggaaccccaacatcactgccaccacccaaccctgccctgcgaagatttctccttagaaagtagatgagattgacagttggtgactgtggtctgaaattctggagcaagtctcatgcccctttcccagggacaacagagcatccaaaatagcataggaaaattaagatcctaggcaaaggtcctgtttaaagctcctttacttagaaatcctgcttcctggcttttatggttttaagatactagggagaggtttgcccctcagtgtccaagataggctcaggagagctggggttagacaggcatcctcacatagagccactgaagaacatacacatctccatgctggctcagcagcagcagcagcagcagattcaggctgtgtcctgcctagtgctcctagcctggtaccagtcagatagatagttgaagtatctcacctcaggcaaagcaacattgatacattgatgcatgtagtgtctggaggttgcttggcattgcatttgatcaggaataaaaaggaagtttagggagtctgtctcagtaccctgtggctttcactgcaatcaaaatacgatcttgcacaggtcagagccgtgttcaagtttggcaagaaataaggctaattttttataggtataccgtactttccaaattgtgggttatgaaccattaatgcatcatgaaataaatgtagtgggtcacaatcagcattctttttaaaaatgagaagtatatgccatgtagtaacttacatgtaaattttgtttatacacagacaaaatgtgggtgtgtactgggtcctgacatgagacactgttcccattgtcgcggatcagggatagttctttgtggttttagttgttgagttctgtttctttgttattcctttcgtggcagcactacattgtagcgtgctcactaagtgtcagaggtttacctcacgccagttgtgttcatttggctgcaggtaactgaagacccaacctaaggcaaagcagacttctttatttttgtaagacttcattaagagcagtttcagattctcagcaaaattgagaggcatgtacagagatttcccatatatcccctggtcccacacatgcatagcctcctgttatcaacaccccccactagaatggtacgtgtgttgcaattgacgaacctgcattgacacatcatgatcacccaaagtccatagtttacattagggttcactcttggtggtgtacattctgtgcatttggacaagtgtataatggcatgtatccattatatatagtatcatacagaacattttcactgccctaaaaattctctgtgctccatctgttcttccctccctctacccctgactcctggcaatcactgatctgttgactgtcatcctagatttaccttcaaagcacacttttaatcacctcagaacatgagtcttgagggaagtggtttggggctgattcagagcactggaatgaccaccttgtggtacgcctggccttctgatagtcacagggtgactgccatgctccagacatcttatcctcacacagcattcaacagggagggcaggaactttcttcccgagtctttgtttttctttttactaatgaggtgggactttcctggaagatcccagtagacttcacagcaggtaaagtagtgcccaaactgacccgtataggggaagggcttggattgattcgagttcatctgctgggccaggctgttgttgctgtcgttgctcctgggaagttgttgtttaattaggaaggtgagggtgccacacagccttgcttccaggtggcccctctgggcatgtttttcttaaaataacagaccagagagaagctctttctggttttcagtctcctttgtggctcacaggccctgccactccgtggttctgaccttgggtgggttactgagccttggagtcggtttccttatttctgttacaagcagtctcacgagggtggatggaaaggctccctgcctggccagggaatggagaatcatagctgttcattgcctgctctcacccttacctctgaggttggttgggttgggttccatgtaagaagtgcagcttgaagtgggctaaaggcagtgtgtttattgggtattgtggagcctggagacctgtttttctcccaggtactcatttatagagaactgttcaagtcctgccattagtcatttctttcatcaggtggtgactgcattctggtaaacgaatgagctaaatgcataccccagctcaccagttctggggcaccagttccttggagcaggtaccggtccccaccctcctgtctacctcttagtcctcagctcccagctccaggcttcaggcagcattggtacccattctgccccaggacatccgtctctactcctgctctattaagataccaccacccaacccccacccgtttcttactttgttaaagtccacatagtccagtagctgtgataacactgccaattcatctctgcctccccatcctacttacaaatgttgacactgttttttaggttgggatttttgtcaggattttctttttttcctaaactcttacacaacagaactgtaatgtttttatggatcttctgagtaatgaatgcttagaaccatggtgagtgcccaccctcagtcttccagtaaaatcagttttgtgtccattatatgttaaccactggctgaccctccaatctgggatcctaattagagaattctcaggaactcagtgtcagctatcacaataggctggcagtggcttcctgagaaagcaatgccgatggtgtttttgaaaaggaagttgcagatatctattgcagatgtctgttcctcttttctcatagcgtctctggagttccccttttattggaaggcgccgtcgtggcttgtccagcttctgggaaactggaataatagaaagagcatggtatttgggtttataatttataacgtagttttactattttactaaattataaatttactatttttataatagtaaattttactatttactattttcacttctccctgtctgcctcagtttcttcatctgtgaaatggggatagtgctgtggagaaagaattgcattcgttcatgtgtggaaagcacctagcccatttagagtaactcagagtggaaccactggccacagagttgctagcagttggctgggtttactgagttaattcttgaagggccaccactgcaacctccttagtattcctgttctcttcagtcatctctgttacaaagtattagctgtgcaaaaatgagcatgggttgttttgtggggcagcattggataaaataagtgggatgaatgctgcacaaattctttctttcatttctctatttcagcctaggttggtttttactttcccaggaaaattatgacaactcaggaaccagcctacaaggggccagctttacgccccaggttccctgttggtgtgagacacttggcactagaatgagggtgaaagcttgccttatagcttcctcttaccacatcccatagtgctgacccacagcctggagagcagcaatgtgtgtaggtcacaattagtgaaccacagaggagcccatgggggtggcagatggtggagggggatttgcctgcactgaacaatggaggagcaatatatacacacattatatgtgaaagatgatgggggattttgggaaggaatattgcttcttgcactgtgtgtgacttctagacatagtgtgcacctcgagggaccacagttatttttagctggggagaaaatccacggggtgctgggagagtcagggcaggaggaagtttatactccccatctccagaagaaggtggactgccgctcatctctggtacgcggggtccttttgtagtcgagttattgcttggagtcagggaagagcattcacaggtctggagtaggactgtcgcaactccttagatgtccagtgaggtcacaggaaaccctccctagatactgcagttcctgccagactcttcagcactggcatctctgatgagtgctctgctgctggtttctgacttgtcttgtgtcattactctgctgctcatgttacagtcgtctttttcacagggatgcttgaagatggaaagaaatttgattcctcccgggacagaaacaagccctttaagtttatgctaggcaagcaggaggtgatccgaggctgggaagaaggggttgcccaggtatgctctctcatttgttttgttttgctttctagtatttaccttttatatttttttataggtggcatatttatacggttcaaaaataaaaaaagtgaaaagtctcaccctcatgccatcccatctgaccaatacccccacaagaagctcctgttgttaatgtttcttgtactgtggtttaagcacatataaaaacataacttttttcttgctttcacacacatactgttttgcagtttactttttcacttaatgcatttttgacacttgcaataccactacataaaagaggagtaggctgggcgcggtggctcatgcctgtaattccagcactttgggaggccaagatgggtggatcacctgaggtcaggagttcctgtaatcccagcactttgggaggccaagatggatggatcacctgaggtccggagttcgagaccagcctggccaacatggcgaaaccccatctccattaaaaatacaaaaattagccgggcgtggtggcaggtgcctgtaatcccagctacttgggaggccgaggcaggagaatcacttgaacccagcaggcggaggttgtagtgagccaagattgtgccattgcgctccagcctggatgacgagagcgaaactccatttcaaaaaagaaagaaaaaatgaggagtaagctctgttacagctgcctagtattcgtttatgtaagtgtgctataatttacttggctagtgccctattaatgagtatttgagtcatttccagtattttgctattataaacaatgctgcagtaactcaccttgtacagacttcattttccacgtgtgcacatgttgccataggacttactctcagaagtgggatgaggggctcaaaagctgtgtgtagtgtttttgagaggtcttgtcaagttaccatctctaggggttgcactctggactgccaccaccaggctataaaggtgcaatctcctcccagccccagcatcacagtatattgttaaatctttggcctctggacaataagagtaaaacatgatatcagtggttttaatttgtatttatctattacccatattgtgtgagaccacttctgagacgtcatacttatggagaaagtcatttcgtttgtcttgagtgtgtttcctaatctctttcctccccatttgtggaaacagcttttgttctgccaacactacaaaattcccaggagacaatagggacccagggttgccaaattttagttggattctgtctttccatcaaacctaggaattttttcttggctctaaccaggtaaagggatgtttttcagtgacctgagacccaaggaactttataattaggctctgcatgatgggtaattagtctgcttccctctcacccaggagaattagaaatttaaccaagatgaaaagacagatttctgtctctctcttttccagaatacacattgctctacttcctctataaaatatcactgatttatctccaaataaactgctcaactttcaggaacttgaagccatcccactcccaggtgtctgggtttctgttcctgcagggcagagggttggcagtgtgaggaagaggctttgtagtttacttcccttgggaaaccttgccaaccatagctttttgcctctgtctccctagtctgtctggctcttggatctgtagcccatcccccatctttcatgccagccattgttcataccacaacccatcttctgtgactgctccagcattggaacaatcactgcgttgtatgtactgagtgctgtatctgccatcgagatagtgttatcggcctacttcacttcccaggcttggagaggcatggtcgagtattggacagatgcctgactccccctttaactggtattttggggtcagtcacagccctgtcatttgtgagaagtctgggtagtttgagatctacataaaatatcttttaaattcttcatagcatattttttcaccaagtgagttaaaaacacaggaagaaggggagattgacttgtgacccttttcctttccttttgatattgttttggttttacatgtttgcaggcgtggagtcctgcctgccacaaggaccattttggcagctttctttcatccatcttggacatcttttcatgttaatacatttaaagccaccactatatgatttctcatgactaatccctggtgtggatatgcctatgaaaccactccttctgtgatggacttttgagttgttagcagaatattctggaaatagaattgctgagtcaaggaatatgattgttttgaattgtacaaggtaaagccatacctcactatccttaccaccttggtccaacatgtcccagcttctgaggggagcaaggactagacgcttcacagcctggagcttcctctttattcatcctctgtctggtggagttggaaagtcgggaacatacacatggagaccaaaagcagagataagtcaaaggatggaaatactgcagagaacctgctcactgttcagaaagtagatattttatacttatttgtgtatttaatttgaaactgaaaatatacacaaatatattttttaaagtagaaatctctccttactggtcactcactatccatactgttctcctcacagcaaatgtctggtatgtccttccaaagatgttttctgttgtaggcatatcaatattttcacaaatggtattcagtaaatgctattttgtagcccagaaaatcatattgtcttttttgaagttttcctatatgggtaaaagagtataaatagaaaaaatacagaaaaaatagactaccctcaagtattacttcctgtgtatatatttttttaaagcaaagttgagtattcctttttcaagaagagcatagatggcacttaacatgtcctttaagtgacagatcactgaaggggactaggtggtgagacatctggaatgttacctgcctagcattagtcattaagacttgcgtagaaaggttgagggcctgaccgttctgagagtcaggaggggttttgaactgccattgggcttcttggagtgagatgcaggggtgatggaatatgactgccaacctccaagtcctgcacaaggaggtggtgatgcctgggcagctgcaaagtcactggaaagtcaataccatcctggccaaggaacacctaggtaaacagctctttttcttacagagacagttggggcatgtgtccagctgagtctgtcttccttgttcttttcacagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaatgtaggccaaatttgtagtgccaacattttagttctttggaaataagactcttaatgaatgactttgttctaccctgtgtttctagaagctagagggggaaaaaaaaagccctttggatatgaatatcatgtcctagcttctgcggctctctcttcactgtggtttgtggttactgcctattagatggtatgagggaggcattcctgcatcggtccacctgctcagggtccacacccaggacacttgaggcccccaggccagcttatcagtgagtgaagtggaaaaatgaagccagaggatgcttgtgaagttgaaaggatgctcttagatcagacagttctaggaagggatcttaggggcctctgcatcagctttattgtgcaacagtaaggaaacagggccagagagaaaggccttactcaaggtcacatccaggcagtggcaaagtaggaccagagcccctgtttgttgattttcccctcttccaccctcatttcttaggaactaaactcagtatcctagtagcacgtaacttttcatgtaagtgttagaatcattaagtacatgaatgctactggcttccttccaactggccccagacctttttatttgctcccctcctgccataggaaccagagggtcacagccaaggcctgggtgaggacacttttgtttgaaagccacaacaaatggctgccatcctatttgtgatggcagtcagagctacttgtaacctggtcctgttgtgcacatctgtaagtggaggggctttttaaactctctgtttgaaccacacacaccttggtaatacaggcctggttaagtttgataactggtttcttcacctgtcattgctactgggagggaatccctggcactttacagggcctttgtctgcccagaggtctgcacctaggccaaaatccctttcctgttctttgagagctgagtcattttttgaacataactgtactcgagggagccttggaattattttcctggttgggaacaggctttctgtaaacttgatgaggtagagggaggggagagagggataaaggctacaagtcaccccgagtaaccctcccaacccactgccaaagaatgtctcagcttcttgcaagagtctggaaggaaaatccaagggcaaacccagaaagttttaagttgagtgaatgaatgaatactggagatattttcccagtatactcaacattatgaatgaccagtttattctcagtctggactgcacatgagagtcacctgggaaatttttaagactttcctgatgcccaggtcaaaccctaaaccagttaatcataatcatgggagtggaacccaggcattaagagttttttaaagcccccaggtgatgcctatatgtagcacagtttgagacccaatgatagtggggaactgtattgtcagcagcatgggtggctagccctcctgctgtcctcagcaaggcaaacttaaccttagattaaacaaaacacacagatcaatttaaggagaaagtttgtttcacctgggacccagcccaagtctttctggctgtctccagctggaacagaagtggcttggtctcagactgctcagctgttggggaagggatttggcgtggcagatggcatcgtggctgtcgccactgcacacaaagaacactgagttgctggaaactcacagattttctgtccccaacagatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctc

SEQ ID NO: 37388 - DNA, 24123 bp, Homo sapiens; identical to SEQ ID NO: 37387

SEQ ID NO: 37389 - DNA, 59258 bp, Homo sapiens; identical to SEQ ID NO: 36289

SEQ ID NO: 37390 - DNA, 59258 bp, Homo sapiens; identical to SEQ ID NO: 36289

SEQ ID NO: 37391 - DNA, 10088 bp, Homo sapiens; identical to SEQ ID NO: 36610

SEQ ID NO: 37392 - DNA, 113678 bp, Homo sapiens
gctcctcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaaggtaagggagcgggacactgaggcaggctcggggcccaggcgtcaccggcgcgtcccggtctccgcggcggccacgcagccgattagatgtctccgcggggaagggtgcgctccgggacgggtgggggcgaggccgcggcgccgggtcgcgctgggagagctccggcgggacacccgcgccccaagggacggctccggggactgcgcgctgcccctccccgagccccgcgccccgtgacccgggcgctggggcgaggggcggggacctgtggccgctgaaagccctggcccgagcgggctccgttgtcaacggtcctcaccccccggggttcggggcttccgccgcacctgatacaggaggggaggagtgcggctcgagcaggctggaggtcaccatccccatcaggtgcgccgtctggggcatccccctctcaggggtccaccgcgcccccagtactgcccgaaaggctcagaagcgacttcccctttccctggcgctgtctttatatcccagacacttaatagactctcgtaatctcacctttcacttttccctctttcctagccgcccccggctgtatcgacctgctatatttccattgtggattttttttttcggttgtaaacttacgtaagttaggttgaccaaccgttgcagccattggaaaacacttctaccagcgtttaacgaatccggttccttttagtgctcaccaaatccagcccaagaattcagggagccgtcagttcttcccgggagctgactgcacacattcctgcaagatgcctgatggattttgtacttgtcagttttgctggttgtatgctccttctgtgcttttcctgaaaaatgattgggtgacatgtgttttgactttctccccccctacccccccaccctccccaccccactgggaagtaaaaaaaataggtaacagaagcacacttgttttcagcaaaaacaagtacagctttgcaaacagactaccccagggcttgcccttttttgtgagggtagtcctttgggatcttgaccccttccctggatttttgtctgtgttaatgtcttcatgttgtgtatttttgcacttaatatttgccctgtgtatgttttcccagcttatttacacacaaagcataacagatctgagcataatgagactgcccatctttttagctacagatacctgtaaagttgcatatttgtgggaacctgtattctgagcttaattactgtagcctgggtctttcatttcaagatgatgtgcgaggtgatgccgaccatcagcgaagcagaaggcccccctggaggaggtggaggccatggttccggctccccttcacagccagatgcagattcacattttgaacagttgatggtctccatgctagaagaaagggaccgccttcttgatacactgagagagactcaagaaacgctggccttaacccaggggaagttacacgaggttggtcatgaaagagattccttgcagagacagctcaacacggcacttccacaggtatgagtgcttttaacctgaaactatagatttttctccactaaatgtttttttattagtgtcatcttttgttaatgtttcagatgagtattttccgtaacgatttgtgaaatgatagtttctggtgtttgtaagtcaaatacaaagttcctagggattaaacttcttagggagaacaaatcgttgtactctaaagtcatgtgaaaatacctcattattttcattcctatctttgggaactgcctaggttcaggaagttctccagagtttttgaaaaagggctctgaagcaaccaatctatttggtgcctccattctgttgtcttaagccttttctggctaaacttgtacttcccatggattatctcatgtatttctaatttcctaatgtaatttaatagacaaataggattgatttcacggaaaaaaaaaattattttgatagcccacctttatcagaacatctaggttttgtaagtcacatttgttttaggggatagaagactcgagattgattccttaggaactttttccttggcagatgagaattttaaagcttaggccgggtgtggtggctcatgcctgtaatcccagcactctgggaggctgaggcaggcggatcacctgaggtcaggagtttgagaccagcctggccaacatggcaaaaccctgtctctaccaaaaatacaaaaattagcagagcgtggtagcgcgcatctgtagtcccagctactcagaggctgaggcatgagaatcacttgaacccgggaggtggaggttgcagtgagccaagattgcaccactgctctccagcctgtctcaaaaaaaaaaaagatttttaaagcttagaacaactgaaattgtttctctgagtatgttacatttggaccagtgtttgaaagactttgctcatggagttgaatgaggatttacttaatggtaggtaaagggagaaagtaaaaactagaagagtgtaaggtgagtggcacggggcatagtgggagagaagtgggttatttatgtgtttcagagctgtctaggcgccacgttactcatcataagtgcctttggggtgcattcaggtagacccgcataagcacacatttatactcgcatgatgggtctgcagtgataaattagtaaatgaataagtactagccttaatgtgtttcttggctgtagtcagttctcctgaaagattgataagccaaacgtgggtttcctttttagcaacaataatttgacgttagcgctctatgttccttttttgttggattaaagaatcattaagatttttcttatttcaatcttataaattaccaagtttatttatgttgaattttattactacaattttaaaagaagtagccaatttatgttttaccaggattttattgtatttgtaatttaaggtacacgtattgaagtgtatatcaaatactaatatacttaataaggtaggttttggaaagaatgggcacacaagacatgtcagggaagtgacaggagttttgtacagttagtcgcaggctgtggaggttgtcacacacactggtgacatggttgctcagtgatttgtttctggcactgctcagtgtagcagcctgggaatgcctagttcagtggataacatgatgatgccaacggttcacgttaccacctgagcacctgattccagcctttcaaaaatggaaactattaagtaaacttgttttggacccttccctttcctggcatctggttcatctttggtggctggtagtgtgaccagataatgagtccaggaagtgcatttgtgctcctggcacattgtggaggcaagttagagtgtacttaaaaatatacataactatagcatacagcagaaaaattcacaaatcgtaagtatacatctcagtggacttttcacaaagttaacacacttgcataccaccacccagatcaagaaatggaacattatcaggcttcctagaagtcccctcctaactattcccagtagttgtcccccagagctaaccaaggtcttgacctttcaccattgattacttttgcctgttcttgactttgtttaagtgaagtaaaataatctgtatgttttgcttcttcattctgtcgtcagcatcatgtttgtgagatgcagcttgctcattctcacctgctctctggtcatcccgtgcacgaacagacagaacttattctttctactgctcacagacatttggggttgtttccagtttttacacgtgctcccctaatattgtttgttttttggtgcagatgtctataaacttttttttttttgagatagggtctcactctgttgcccaggctggagtgcagtggcatgatctcggctcactgtagcctccacctcccaggttgaagcgattctcctgcctcagcctcccaagtagctgggaatacaggcacgcatcaccaccctccgctaatttttgtattttttgtagaggtggggttttaccatgttgcccaggccggaggatatgtgtacacttctgttggatttctacaaagaagtggaatgcaaatgatggtgtgtgcatttgttcagcctcagtagagagtgccaaaagtggtggttgtgacagtttgtactaccccagcaatgtatgagaagtcagttgctcctatgctcttcagcacttggtattgttgggtctttacattttagctgttctggtggctgttagctggtaggtggctcagtatggtctgaatttgctgctccctgatggccaggaacatgcagaggtaaagcatctctacctgtgttcactggccacctggatgtcttttgtgaaacggttatcttttgcccatctgttgattgggttgtctgttttgttttttactgatttgaaggagttttctctatattctgagtacatatgtgcatgacagattgtttttagactcttgtgtttgccttttcactctctcagttgtatcttttgatacatagaagtgtaaaatttttaatgtagcccagttgatccatcttttcagtaatgtttaatgctctttgtgtcctgtttaagaaatttgcttggtcaagttcatgagatattctacattgtcttctaaaaactattttttaatcttccatctgaaattgactttgtttatggtatgcgatggggccaagagtctctctttctttttttaaatggatatctagttgaccttgcataatttcttaaaagactattctttccccagtgtactacatgcagtgtcatctcagtccagtgactgtaagtgtgtgggtctgtttctggactctcttctgctcctttgatctttttgtcatctttgcacaaatagcacaatgtctaaattcccatagatatagtctgtcttgagatctggtaatttaagaaaagggtactcactcggttgcccagactagtctccaactcctggtgtcaagcgatcctctcaccttggtctcccaaagtgctgggattaccactgtgagccaccacacctggccctgtagatattctttatcaaaatgtaaaaattctcctcttcttagtttgccaagagttttttaaaaaccatgagcaggtattaaatttcttaacatggattttctgcatcttttgagacagtcatgtgatttttctgttatgtgggaatttaactgtttttgtttgtttatttttgagatggggtcttgctccattacccagcccggagtgcagtggcaccatcatagctcgctgtagccttgaactcctgggctaaagtgatcttcccacctcagcctctcaagtagttggaattatagacgcacgccactgcgccttgcttttttttttttttttaattgcatattgtttgtagcctggggaagcaacttcaggagctcctgagaaagagcacctcccttttaaaaaaaatttacaattgtagaataattccaacctgatcttgatgtattctccttttactggattatatttggtagtattttgtttaggattattgcatttatattcacgagaaagattgacttataatttcagtttccttcagtacccttgttgggatttggtatcaaggttatgctggtttcttaaaacaaggtggaatgtattccttctttttctactccctagaagagttcctacgaaatttgtgttttcttccttaaatgtttgaaataattctttggcaaaaccagctggtacagggttttccttgtgagaaggaaaaattttagaattaattttataggtagatgtaggattttgaatatttcttcatgtgtctatttagataaagcatttttccccgctagagatttgttcaggccacccagactttccaatttgtaagtttaaagtggtttgtaatccttattatctgcaagatctgtagtgatgttcccttttaataattcttgatatcagtaattcatatattatctcttaatcagtcttgttgggggtttgtcaattttgtaagttcttttaagggaccaactttcggctttacatttttttctacttacatttgttttctattgcattaatttctacttttttttttttgctttttttttgtttgattgagatatatatatatatatatatatatttttttttttccaggcacagtctcattgtgtctcccagggtcaagtccttagatacttgaactggatttaactccctcctaccttttgtgtcattgttttatatatttcagtttaatttatatttatttttaaaaatagagacagcgtcttgctgtattgccccagctggtcttcaactcctggcctcaggtgatcctccccccttagcctcccaaaacaatgggatccaggcgtgagccactacacgcttttagctgcatcttacaagtttatgtactttaattttagatatacttttgcagtatcataattattttgtacagttaatgtttatttagatttatcctcttagttaccatttttgttgctcttcattctttattgttgtttcatgtttctgccggggattatatttcttgttttttttttttctttttttcttttttgagacagagtctcgctctgttgcccaggctgaagtgcagtggcacgatcttggcgcactgcaacctccatctcccatgtttgagcgattttcttgcctcagccttctgagtagctgggactataggcatatgccaccacatccggctaattgttgtatttttagtagagactgggtttcaccatgttggccaggctggtctcaagctcctgacctcaagtgatctgcctgcttcagcctccaaagtgctgggattacagatgtgagccactgcgcccagcctatatttcttttccctgaagaactttctacggtatttctttgagttcatatctgtggataatgaattgtcatttttgtttgcctgaaaattttctattttgcctttagtttttgttttgttttgttttgttttgttttttaagatggagtctcgctctgtcgccggtctggagtgcagtgatgtgatcttggctcactgcaaccaccgcctcccgggttcaagcaattctcctgcctcagccgcccgagtagctggaactacaagcacgtgccaccacgcccagctaatttttgtatttttagtagagaaggtgtttcaccatgttggccaggatggtctctatctgttgacctggtgatctgccctcgtcagcctcccaaagtgctgggattacaggcgtgagccaccatgcctggcctttttttttttaaatgtgatgtttcaccatgtttgccaggctggggtcaaactcattggctcaagcagctgcctgcctcagcctcccaaactgctgggattacaggtgtgagccactgtgcccaatttgccttcagttttgaaggatgattttgctgggtatagaatactgggatcgtggtcatttccttgcaccattttgtagcagcgaattcattgtttttttagctcgcttcctttttcttgacaagtcagcttttggtgttattgttgtcccatttgaagtaatacttctttttattttcccctctggttgctttttatttttattttttggagaggatatgacttttactgagtttatccaccagagtggaaataatgtttgtgcaaaaccaaatgtttgttactataactctccatcacaattaaaatccaaacagttttttgaaaacagtcaactcaatcaaaacccactacttcagaatcaatagcttctttgaagccacagtaacaaatatggttaagacttgaatgtagaaatttgttggttggaaagctaattaaacttccaacttgctcaagtagaattacagaaaggcagaattgtgtttttcacagagatatagttcactggaatcagccacactggacagctggtagagtgtttagggtcctgagataataaggaatccaggcagcctttagacagtctgctgttgtcctttcttcccaattagagatttgtggatgtgtggaatgacacctttaccagcaattgtagacttgaagagagagcccaattctttatctccacgaatggcaagttgcaagtaatgaggggtagtatgctttactgtgaagtcttttgacgcatttcttgccagttcaagtacctctgcggtgaggtactccaggatggctgtgctattcacagcggcagtcgcgcccacacgtccaggactgattgtcctagatttcaggtgtcagtgaatacggcccaccaggaactgcaaattggctctcttgtgagtgggaagctgcctttgttggcctttctggagtccttcccagccttactgccagccattttcaattctgctgaagctcaaacaggcaaggcagagaaaggactaatcagacacacagcaagatctcaccatctactcattcctcacaccaggatttgaagctgcctctggtggcttgtaacattttctttgcttcaggcattagcaaaacttggtatttgttgtattggtggcctggttcctaatcaattttggaagttttggctcttctctctataaatattcctattttccactcatcttcactcagagggcctccatttttgtgtacattaggcattttttttttttttgagatggagtttcgctattgttgcccaagttggagtgcaatggtgtgatatacattaggcttttatcatgtcctatgtgtctcttgtgctcctttccgtattttctagaccttttctgtgtatgtgtctaggtgtgtgtgtgtgtgtgtgtgtgtgtgtgtgtgtgtgtgtatttagtttttagagactgggtctctctgttgcccagggtggtcttgaactcttgggctcaagcagtcttcctgccttggcctcctaaactgttgggactacaggcgtgagccaccgtgtccggcctgtgtgtgtgtgggggatgtgtgtgtgtgtatatttttgggacagggtctcgctctgttgcccaggctgtagtgtagtggtgcagtctcagctcactgcagcatctgccttctgggctcaagcgatcctcccacctcagctcctgagtagcagggactacaggtgcgtgccaccacacctggctaatttctgtattttcagtggaggtggggttttgccatgttgcacagactggtctcaaactcctggacttaagtgatccacttgcctcagtctccgaaagtgttgggattacaggcatgagctagcatgtgtgtatatatgtgtgtatatatatatacgtacatacatatatatatataaatatatatgtatataaaaatttttaagagacaggtggctgggtgcagtggctcacgcctgtaatcccagcactttgggaggccaaggtgggtgaatcacttgaagtcaggagttcgagaccagcctggccaacatggtgaaaccctgtctctactaaaaatacaaaaaatagccgggcatggtggcacatgcctgtaatcccagctacttgggaggctgaggcaggagactcacttgaacctgggagacggaggttgcagtgagccaagatcacgccattgcactccagcctgggtggcaagagcgaaactccgtctcggggaaaaagaaaaagacaggcaccctgttgttgccgaggctgcagtgcagtggcgcgcgtgatcactgttcactgcagcctcaaactccagggctcaagcaatccttctgcctcagccttctgagtagctgggactataggtatgtgccactgtgcccagctaatttttaaattttttgtagaggcagggtcttgctattttgcccaagctgttcttaaactcctgacctcaagtgagcctcctaccttgacatgtcaaagcactgggattacaggtgtgagctattgtgcccaaaatctaaagtccagattttttttactgacccatcttccacctcactcatcccctcttcatttgtgtccaatctgctgtttagcccatagattgagttcttaatttcagttataattttcagttctagagtctgcttaattccttttactattctagttctctagtgaaattttttccttttgtcaagtatatttttgaatagttgacatttgcatctgataactctattatatgggtcacctccggatccatttctgtttttcttttttctctaggttcatttgttgataacgcccatttttgtttttttaattgagtcagacattatgtatgaaaaactgtagaaagcgctgggtgatgctgtcttccttcagaaagtttccctctgtcatctggcacatgcccagagtagggacagatcatctcagctcagtcagggcctgggtgaccagaggctgggattcagtcagtaagcgtcagttgaagctgccttcccccaacctcctgctcctggtgtaaccatccgggggttccatctgaaaccctggagtgtttcccagggcccctctttcttggcgtgtcctggagcccaagttttgtctccttaacgccatgagactactgaaagcccagcttctcggccaggtttgcagagtgttgggctcatttcctgtgtctcccttttctctgggatcttggccccttaagtcctggctgactgtcaggcctgtacttctttttgtctccccagacccttggggctttctagagctctgtagcctctactttctgctgagttttcttcccagttatcagtgtactgcccccaaatccttccaaattgtcaaatgcactgacagaaagagtgggggctctgaatagtggactcacctcagtgggcctctctttggtttggaatgttggtcccttcatttgtggctgccttggcatctctttgatgcctgcagactttcaagtcatactcaccttttctagtttttggtgggttgccgggctacaggccaccccgcgtatcactgaaactggagctgaagcgggcgtgctctctctgtctgcagcatatgcggagtctggagacattggttatcattacttgatagggagcatacagaacccactcacctcgcttaggctaccttgtccagtttcttttttttttttccagtctgcttctcatgacattgtccagtttctaatcagaatcccccatttgcccctgcccagtcacttaaccacttaaagacagtagagcaagtggcctgcccagcgggagacacagcccttggcctccaattcccgtcttggccactgtgtgggctgttccaccctgctgtagtctctactcttccccatgccctgtgtcagaccgagggagggtttgtgatgacatatctggcagtggcaaagaaggaggctagggaggtaggagaggttgtgtgcgtggtgtttagtcttactttggagatggggtcttgctgtgttgcctaggctgatctccaactccagggctcaagccatccttctgccttggcttcctgagtagctaccactacaggcatgaaccagtgtgcccagctacctaatgtttattctatgacttgatcccatgtatgtttcctttttgagtgctgattttttttttttttttttttttttttttgagatggagtcttgctctgtcacccaggctggagtgcagtggcgtgatctcggctcactgcaagctccaccccctgggttcacaccattcttctgcctcagcctccccagtagctgggactacaggtgcccgccactacatccagctagtttttgttttgtatttttagtagagacagggtttcaccatgttagccagaatggtcgcgatctcctgacctcatgatccactgcatgccttggcctcccaaagtgctgggattacaggcgtgagccaccgtgcctggctttttttttttttttttttttttaagaaggaattttgctcttgtcgcccaggctggagtgcaatggtgcgatctcagctcactgcaacctccatgtcccaggttcaagcgattctcttgcctcagcctcctgagtagctgggaccataggcgtgcatcaccatgcccggctgatttttgtatttttagtagagacggggtttcaccatgttggtcaggctagtcttgaacttctgacctcaggtgatctgcccgcctcagcctcccacagtgctgggattacaggcatgagccatcatgcctgaccgactgaccgagtgcttttttttttttttaaagcaaatattgcctttgggcttctctctaatttcattttaaagtttcagttgcattttcaaatggagattttattttaaactggagtgcagtgatttttacagtctttttgaaagcaacaaatgagatttttagaagacctcttgcttgaagaactcttttgtgtgaaacctagaagagagactgttcacctttcattgcaggtgaggtcccaaattttgccagtctctctcccaatctgccaatccctgaagcagggggtacaaaactcagaagattctaaggaatgaggtcttcaaatcaaatccaaacttagtgaaaaagaagtctacctgtgtcaggggtgttccctgtcaaagtgatgggtgagcttcagctggttgcagtggaaggtgtgctggatggattgaggaggcgagagggtgcaagacagcccatttaggaggcagttcctgcaatgtgggcatgaagtgttacagcccaaactaggatgctagaatccgagggcagagggcagtagaaaagaacaacctggcggaattgtgtaggactagaggatgacagccgagtggcagataccagggtcaagcttgcggggagaagggggacgggggtgggggagagtaaagaggagacgctggtgtttggtggtgttgagaggtatttgtggttgtcacagctagggcagggatgctcctaaacattctgcagtggagccccctcaacaaagaattatctggccccaaatgttggaagtgtccaggtttaggtataaagaatcagaagcttttctcaagtattgctgttaggttggtgcaaaagtacttgcggattttgctttacttttaatggcaaaaaccgcaattatttttgcttcaacctaatatgatgcaaaattggctacaactgtaatttgttgagtgctgcaaacaaggtacttgctaagcttaactttagtgaacaaattaggaagaattggaataaggtaaaactagctaaatgactcttccctgagaataaatactaatgactgccccttcagatggtgccccctcatctgctttactgactgtttcttagtagtagttggcaaaacacctcttaaaataccatacttgttttcatcgtctttggtgtatgaaatagttgaatatatcctttcagaataatatttggccatttacatctctcttttgcacacactgaatttgccatcttgtcttcctgttcctacacctttaattgtcagcaaggagacagagtccttcctcctattttgttgagccctgtgtgaatattaccgttctaggctcctgcagtcagtggtagagacagggtctctgcctgcagaagactttcacaatatacccatgctcaaagcaggtgcaggttgcgagacacatccagatagaatgaagtggttcagaagaaatccatgatctcgactgagtggggtgggctgccaggcacactgtggtccagaaaggtgaggctttcgaggggattggcttagagctgagggatgaaggctaagaggaaccaggtatgagagctttcttggcggtggggctacttgagcaaaggccagagcaagggagagcttagcatttagctgagtcaaagctggggtctgtggccatggttacttggcctggagggaagggaagagtgaacatggtaaggttggctaggtaggttgggatgggatcagacagaggtgaagacttgcttgtttttgttttaagtaccttagggcttcagtactttgcgtgcatcgtggcctcaggggagggaatgatgtgatttagctgcgttgttatttatttatttttatttatttatgtatttctttatttaagatggagtcttacactgttgcccaagctgtagtgcactggcatgatctcggctcactgcaacctctgcctcacaggttcaagcgattctcctgcctcagcctcccaagtagctgggattacaggcgcccgccaccgtgcccggctaatctttagtagagacgggagtttcaccacgttgcccaggctggtcttgaactcctgacctcaggtgatcctccctccttggcctcccaagtttttaaaagatcatgctatgtggataatgagctggggatggagggaagaatggacctagggtggaaaccactggttagagtagagccacttcaagtgcatgggtttgggctataaagttagtgctgtgagcaaaaattaaaaactcttgccgggtgcggtggctcatgcctgtaatgggaggccgagatgggcagatcacgaggtcaggagttcgagaccagcctggccaacatggtgaaaccctgtctctactaaaaatacaaaaattagctgggcgtggtggtgcgcagctgtaatcccagctactcgggagtctgaggcaggagaatcgcttgaacctgggaggtggaggttgcaatgagctgtgatcgcaccactgcactccagcctgggggacagagtgagactctgtctcaaaaaaaaaaaaaaaacctcttaacatcacccatcacataaggcacagaacaatgtgtactttttaattatcatatacataaatgcatactgttttcatgcagtatacataatgtttatgtatatagtgtatacatgaatgtattcaggtattttgagtgtctgtatgtggcatgcaccgttctaggtgctgaatattccataggtaaaaagggttatttagcccacatttttttcgttgtatgaagagaaatggaaaaaaccaaacttacatagttcggtttgagcaagttaaatgcatggatgatgtaatgtgggagcactttccacttttcgttgatgtttgtgtaggcagaactagggaggtggttttccttgggagtttcagctgcccactgtactcctccactcttggccactgtgcctcgcaggtgccttacctgactgccatgctgtgtactttcatttgggcaggctttgggctccttaaattcaatattggctcaaaccatctttcccccgcatccgtaccccatcctgtgaacggtagttttctacgtagtcaggtggctatgtctcttcttttcttttgagatggagtctcgtcctgttgcccaggctggagtacaagggcacaatctcagctcgctgcaatctctgcctcccgggttcaagcgattctcctccctcagcgtcccaagtagctgggactacaggcacatgccaccgcgccctgctaatttttgtatttttgtagagacggggtttcaccatgttggccaggctggtcttgaactcctgacctctgatgatctgcccttcttggcctcccaaagtgctgggattacaggcgtgagccactgctcccggccctatctcttttctgcgctaaccttatccttctagtctccaggacctgtgggatggacctttccatctcttggaggttacccctgaggcccactgactctcagacccgaaccctttgtcttcaccgggttgactcccatggcccctgttctggagcctctctgcagtatcttatccctttttgcagcaagatctttctttctttctttttttttttttttttttttgagacagggtctcactttatcacccaggtggagtgcagtggtgtgatcgggctcaagcaatgctcctacctcagccttctaagaagctgggactacaggtgtgcgccactatggttggctaatgttttttctgtgtgtgtatacacacatatatatacacatatatatacacatatactatatatatacatatacacatatatgcacatacacacacacacacacacacacatacatatatgtaattattattattttgtagagcaggggtcttgctatgttgtctaggctggtctcgaactcttgagctcaagtgattcgcccacctcagcctcccagagtgctgggattacaggcgtgagccaccacgccgggccaagatctttctaaaatgcatgtacagctgcctttcctttgctcagaacacttgagctctccattcctcctcgggctgaagactcctgtgtcatcacatcctggcccagcgcctccctgctctcccagttgtggatagttcctcacttgcagactccttttttttgtacaactttgtaaataagccgttgtctgagattaggcctttcttatcttctacttgccaacttcattctagctacaaccaagtaatttggtgcagctctttcagcgatccggttttgccctgtgtatactgattctcaaaaatgcccatattctgatgcagtggtttgacttcagctaagtttttttttttttagtagatacaggagtctttatgttacccaggctggtctccaatcctggtctcaagtaatcctcctgcctcagcctcccaaagtgttgagattacaggcatcagccactacacccggccttttttttttgttttttaaaaaatttgtttttagagatggggtttcactctgtttcctaggctggagcgcagtgacacaatcacagctcaccgtattctcagcctccctagctcaggcagtcctcccacttcagcctgttgagcagctgggaccacgtgcatgtaccgccacacctggctaattttttgttttatttttgtaaagatgaggtctccctatgtgccccaggctggtcttgaactcctgggctcaagtgatcctcctacttggcctcccagagtgctgggattacataatgatgttggccctaacaacttgtatggttagatttttaaattcaggcgtttataagagttaaagtctaagtgtgtataggtcccactgcgctggggctcaacatctctcacttgctctccagccatgcctcatctcacctctgcttttttttttttttttcttttttgagacggagtcttgctctgtcgcccaggctggagtgcagtggcacaatctggctcactgcaacctctgcctcctgggttcaagcagttctctgcctcagcctcccaagtagctaggcttacaggtgccgccaccatgcccggctaatttttgcatttttagtagagatggggtttcaccatcttggccagtctggtcttgaactcctggtgttgtgatctgcccgccttggcctcccaaagtgctgggattacaggcatcagccaccgcgcccggcctcccctctgctttttgtatcccttcgaggctcacaattcccagagctctccttcttggtgatagaaagtggggccactgcctgaggtgtgattgcagacctctcctttgactctttctctgcaattacttgttcctgggagaccgtcaacctcatggttttagtgtccatggtgttccctgctcaaatcacttcttcctggaagttgcaaagaggtgatttttccagctgtccgtccgtgtacagtgatgaacagatattcctgtgtgaagaagagtgttctcctttgttcactttccagctctctcagtcactgaggacactgcatattagagtcaggcgtcgtcattactccttggatgctcatattgtccctttcagattggctcctgtgtctttttgccaagaccccattagttcttgagtgcttcattgctttctggcacagaaatttgtcccaggcctactttgtacttttcctgcctcagatctgaaatcattcctctcaggagccctggttccctttagtgggaagtggcatttagaaatcagcatttggggctgggtgtggccactgtcacgggggtagcatctggttgtttttttttttttttttggggacggagtcttgctctgtcgcccaggctggggtgcaatggcgccatctcagctcactgcaagctccgcctcccgggttcaagcaattctcctgcctcactctcccaagtagctgggattacaggcccacaccaccatgcttggctaatttttttttgtatttttagtattgatggggtttcaccatgttggccagactggttttgaactcctgacctcagaactccacctgtcttggcctcccaaagtgctgggattgcaggcatgagcccctgtgcctggctgaaggtagcatcttttatgtcctttcattggacagagctagaaaaaaatgttcattaaaaaacctccaatttcatactgattctttaaaataaaagttttttccccttattttatatttacacagcttaaactgatgattttgatttctaataatattaacattgttttccttatctatgatattcataaaatgggttcagcattttaatacattgttcttacaaacaacccttcgaatgaagtttaggattccttagcaattcttttggctttagaaataaatacatcttaagaatatatagttagagtaatgggtttaaaacaatttgttgtaacataaccaaagtaattaccaatttgataaacaggttcatttgttcctatttattcttaattcagagtttgcattttataaactttttaagtagctgggactacaggcatgcgccaccacgccccagctttttaagtgttggcattacaggcgtggctcactgtgcccagccaagtttattctttttcaaaccaggtgtggtggcacacacctgcagtccaagctacttgagaggctgaggtgggaggatcgcttgagaccaggagttggaggccagcctggttaacatagcaagaccctgtctctcaaaaacacatttttttaaaaagtttattatttttcagccaggtgcagtggctcacacttgtaatcccacacttcgggaggctgaggcaggtgcatcacttgagcccaggtgttcaagagcagcctgggcaacatggtgaaaccccatctctacaaaaaataaaaaaaattagccaggcttggtggtgcacatctgtagtcccagctactcaggaggctgaggcacgagaatcgcttgggcctgagagatggaggttgcagtgatccaagatcataccactgcactccagcctgggtgatagagcaaaaccttgtgtaaaaaaaaaaagtttattatttttcaaacacacaaaacatttacatggttcaaaagaccagaactttgtaaaaatgtaaactcagaagtcttgcacctagccctgtcgcacccacctccgataggtggggtgaggacgtgtctggtttgcatggaatagtcccggtttttgcctgttatcctggagcaattagtgacagtgccttctttcactctcagaaatgaagcatagctaaggctttgttggcgcctgctaatgctaatttagagatgtggacaaaatgtttccactttgtggatttttttcccctgtagctaaaagtaagggcttggctgaatcctgtagacttggattgaggttctcttggcaggggaggtccaaccatggagttcatactcttttcacagagtctcattcttattcggaggaggaaatttcattttactctgaaaatttgggagcttgaagcatattgtacatttccaagtttttctgctttgcaaagggccaattattcctcctgcctatgtagttttaaacctttgccagtactaatataaaaattgatttcaagtagtgacatgctgaagttgttgaatcatatagaaaagttaaagttctacttgagatgaatcagtgtttctgagcgattgatctcttgaaatctcttttttttgagacagtttcactcttgttgcccaggctggaatgtagtggcacaatcttggcttactgcaacctctgcctaccaggttcaaatggctctcctgcttcagcctcccgagtagctgggattacaggcatatgccaccacgcctggctaattttgtatttttagtagagacggggtttctccttgttggtcagcctggtcttgaactcccgacctcaggttatccaccagctcccggcctcccaaagtgctgggattacaggcgtgagccaccacgcccagccgatctcttgaaatcttaaggtgctgtgaggaagctagtgcagtctcttccaccttaaaaataatttgtgggggaaacatgaatgacagccgaggtcatggtatcctacatacccttaaagagagatgtggcaggatgagatgatttcgaatagcctgagtattaatttgaatagtgtgacgtggtatttcttttcatacaaattaaaatctaaagaacttcacttgtgattaagtgtgagatcccattgatgcagaaaggcttaaagaaattccaagtaaaattttacttagcagccctgtggctcagctcattttcctccaccatagatgctgaggcgttcacactggagggcgatctcagcagacaggcattgtgctctttgtgttacctgaaggcactttacaaacaggaattcagtgcattgcccttcctctgtttctttttgtgattgatggagatctgctgacttaaatgaatagtttacttatttatttatttttgagacagggtctcactctgtcatccagtctggagtgcggtggcatggtcacagctcaccacagcctccacctctctgggctcaggtgatcctcccacctcagcctccccagtagctggaaccacaggcatgtgtcaccacgcctggctaattttttttttttttttttttgagacagtcttgctctgtcgcccaggctggagtgtagtggtgcgatctcggctcacggcaacctccgcctcccatgttcaagcgattctcctgcctcagcctcccgagtagctgggactacaggtgcgtgccaccacacctggctaattttttgtatttttagtagagacggggtttcaccatgttagccaggatggtctggatctcctgaccttgtgatccacccacctctgcctcccaaagtgctaggattacaggcgtgagccaccgcgcttggccagtcgcctggctaatttttgtatttttttgtagagacagggtttcccatgtttcccaggctgttcttgaactcctgggctcaagtgacccccctgcctaggcctcccaaagtgctggaatcacacatgtgagccaccacactcggccagtgaatagtttagaagcaggccatgtgcgtcctttctgcctgcctctgtaggtagattccactccgcctcccctgtgtggattcccacattggagcgcgggctgggtgggtggcaaggagagcagtaggtttgtgtggagcatgggcttggagccagctggactcgcatgtcccctttcccttgttacctttgtcacgttccctcatcactgagccttctgtttcctcacagtaaattagagataataatcatttgggtattttttagcaaattcgtattgtctactgtgtgtaaggtaccgtccaggggctgggtatatggatgtttgggagatagaatgagatcatagtgaatgtttattgcctctaagcctctttataggaatgagcccccactgaagcctcgtgacagtgctataaagcaggacactgttatgaccccattttctagatgaagaaattggaaactcactcaggatcccatagatattacatggtagaggctgtatttgaatccaagcagtctgactccagagttcttcaactgcatgaaaaagtgggcacaacagtatccttcagacccctctgcccccttatagtattactggagtgcacacacttatggttctttaacggagggacttgtctctcagttagatccccttccactccttgcacctactccacctttgagcatccggggcagctgcttgggcttcccctgcctgggatgggagcctagtctgagcaaggtgcctgcccatgtggcctgctgcctggtgctattctgtccccagtgttgagcgtagcctctggcacacagtagacacacacacagtgatgcatcctagaatgatgaaataatttcctaaacgggatcttttaacggttacctacctgttcttcagtggctcatctaattctgttcctagctcttccacgtggttaatccaaggcattcaaagtttcagtttttttccccttcttcattgctttttccagaaactttttcacagtgcagaacaaggggatttaagtgtgctatatgttggcttcatagcaagtgtgtgacactattgtttggtttcccatcaatcaactcttggcccatcataacgttaaaatttgctaacctgcaatttcgttggtattttgatgattacttgaaacaaatcactggaacaatagagaagcaaataaaaccaatggctttgaaacataatagagtcgcggtggcaaggccagtcccctaccccactgcctttggcacgtggtagctgctgattagcaaagtgtgagagcaggtggctcaggagccagtggcgtcttctggtctgccatcacttaatctgctggagccttgtgttacttctccacatatataaactgggtggactgggccctgtagtttaaagctttctggaagaagccagtctccgaagggtctttttccataggtaaaaccatgcagagtggctcagggcaaagtcagctgccctggggagccatttgctgagaccctcagcctctgctttaccctgccctcgaaggggtcctaggaagacagttggaaagccctaggactagcgattggatccctttcagctctctgattctttaaatactctgtagttcctgcacagttctctctctctctctttttttttttttttttgacagggtcttcctgtgtcgcccaggctggagtgcagtgagatcaaggctcactgcagcctcgacttcctgggctcgagcaatcctcccatctcagcctctcgagtagctgggaccattggtgtgcagtgcaccaccatgcccagctgagttttgtattttttgtagacacagggtttcgccatgtttcccaggctggtctcaaactcttggcctcaagtgatccttctacctcggcctcccaaagtgctgggatgacaggtgcgagccactgcacctggcctgcacagttcttttgttgcaaattgtagagaaaggtaaactttgattccagtattcacctgcagaagacctgagtgaacgtttggagatggcgaggtgatggaagttggcgagggtcaaaggagaggaacactgggaaggaaatccagtgtttctgctgaagggatatgcccacgtcctttagacatgggacagaaagcaggattttggtgtctttgaatgggggatgtaaatcctaccttgagtgtaacgaggctttgtgacaaaggcaaaaagtcaaaagggaaatggtgagaattttctttctttttttttttttaatttttatttttattgatcattcttgggtgtttctcacagagagggatttggcagggtcataggacaatagtggaaggaaggtcagcagataaacaagtgaacaaaggtctctggttttcctaggcagaggtccctgtggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgtttcagagagcacagggttggggggtaaggtcacagatcaacaggatcccaaggcagaagaatttttcttagtacagaacaaaatgacaagtctcccatgtctacttctttccacacagacatggcaaccatccgatttctcaatcttttccccgcctttccccgctttctattccacaaaaccgccattgtcatcctggcccgttctcaatgagctgttgggtacacctcccagacggggtggtggccgggcagaggggctccttacttcccagtaggggcggccgggcagaggcgctcctcacctcctgggtggggcggctggccgggcggggggctgacccccccacctccctcccggacggggtggctggccgggcgaggggctgacccccccacctccctcccggacggggtggctggccgggcgaggggctgacccccccacctccctcccggatggggcggctggctgggcggggggctgaccccccccacctccctcccggatggggcggctggccgggcggggggctgacccccccatctccctcccggatgaggtggctggccgggcacaggggctcctcacttcccagtaggggcagccgggcagaggcgcccctcacctcctggacggggcggctggccgggtgggggggctgaccccccccacctccctcccggacggggcggctggccgggcggggggctgacccccccacctccctcccggatggagcggctggctgggcagaggggctcctcacttcccagtaggggcggccgggcagaggtgcccctcacctcccggacggggcggctggccgggccgggggctgaccccccccacctccctcccggacggggcggctggccgggcagggggctgacccccccacctccctcccagacgggacggctggcctggcgggctgacccccacctccctcctggacggggcggctgctgggcggagacgctcctcacttcccagacggggtggctgctgggcggaggggctcctcacttctcagacggggcggctgccgggcggagggtctcctcacttctcagacggggcggttgccaggcggagggtctcctcccttctcagatggggcggctgggcagagacgctcctcacctcccagacggggtcgcgaccgggcagaggcgctcctcacatcccagacggggcgtcggggcaaaggcactccccacatctcagacgatgggcggctgggcagagacgctcctcacttcctagatgggatggcagccgggaagaggtgctcctcacttcctagatgggatggcggccaggcagagacgctcctcactttccagactcggcagccaggcagaggggctcctaacatcccagacgatgggcggccaggcagagacgctcctcacttcctagacggggtggcggccgggcagaggctgcactctgggcactttgggaggccaaggcaggcagctgggaggtggaggttgtagcgagccgagatcacgccactgcactccagcctgggcaccattgagcactgagtgaaccagacactgtctgcaatcccagcacctctggaggccgaggctggcggaccactcgcggttaggagctggaggccagcccggccaacacagcgaaaccccgtctccaccaaaaaaatacgaaaaccagtcaggcgtggcggtgcgcgcctgcaatcgcaggcactcggcaggctgaggcaggagaatcaggcagggaggttgcagtgagccgagatggcagcagtacagtccagcttcggctcagcatcagagggagaccgtggaaagagagggagagggagaccgtggggagcgggagaccatggggagagggagaggagggagagggagagggagagagggagggagggagggggagggagggagagggagaggagaattttctttatcacatttgtttctttgcttatggagaggattgcttgttaatgtggtgtgatattgaggttgtgtgtaagagcatggcctctgggtctgcgctgtccccttagctctccgctgctcactgtgagacgtgcctcacagactcgtggtgaagatagttaattcatgacgctctcagaagagagcctggtatttaataagcattcaataaatgttagtcattcttctgatagtcattattgaatgggctaaagaagtttggttttggcaaagaatgcttttccctgtaattcccaaagttaattgtgatcaatagaaaacaaaaccagagaggccgggcacggtggctcacgcttcaggctcccagcactttgggaggctgaggtggaaggatcacttgaggccaggagttcgagaccagcctgagcaacatagcaggaccctacttttacaaaaaatcaaaaagttatttgggcgtggtggtgcgtgcttgtagtcccagctactcaggaggctgaggcgagcggatcgcctgaacctagcaggttaagactgcagtgagctatgatcataccactgtactccagcctgggtgacagcaagacttgtctctaaaatgaaaaaaaaagaaaaaatgaaaaaagatgtaaacaatatggaaacatatggtgtccacagtaacagtctctccttgtactcagtgtgtccacagtgggtgtattgtctgaagggtgcattcatgtgtgagaagaatggatgaaattcaaaattactcatattcaaaatatgagtaatgggtaaaataagcctgctaagtcaaagggcttgttacacactacctgtgtgatctgcacagaaaaattattgtaaggattctgactgggtcacagtgtctctgggaaggtggagaaccaggtttggaggacactggttagccaggccctgctagccgggccccatttccccgtaatgtctgtgctccgaggttgtcaccagcagatgcaggagaggctgggagagcaagtttctggtgctttcagcccctcgtctgggccacttgcttttcctcaagagtggaccatttcccatccataggaagaggctcagatgctgggtggccagcatgcctgacaaatggcaacagcatgataaaacccttgacagctgtgcctcgagatctgaagagagcagtttcgcattcgcttacatggtggtggtaatgctccttccctctagaattatcaggaaaaaatgccatgtgattctctcctctctgctctgactttcctctagaaagaaaaaagaacacatattgaatgaaaatccaaatcagatgtttgggtttccttccttccgtcaacttttctgttatatcactgcccatgttacttttattcctgttcctgattattccatttcaaggagaaaggttcataaacaagaaatattgcctttttggttgtgtgtagtggggtgctgagctgagtggtagaaggcctatgcaggaggcagtagtgggtgggtagaataaaggttttacatcggaaagaatctacattccaaggttgttttcttgtgcaaaccatagaaatacttgttcctgaaacagtttgatgatgaattaggagactgcttaaaagcacattcctgtagatagggtctgggtgcttttcacaaacccatgaatgcctggcactttcttttttgtgttccccaaactatttttactataaatggttgttattaaaaggcccaggtgctgccaggaagtgacattttctagagtgtacctagaagtgttcatcccagaacctgttcattaaaagacttccaggctgatctgtcccacggtgctggcctgaaaacatcagctgctgctcagagggcttccctgggctcggggaagagcttccctgcctccccaccttagagtgctggttctcctgtgctgtgactcactatggggattgctgttacattcatctttacgattctcttagaagtttacagtgatactgcataaagagatacggacacttaccatagtaagttacagtcactttttaaactgtcagtaatttagagggtaagtgtctagatacagttattctgtcatcattgaacaattttaccatgcctttttatttaaaggaacatgttctgggccgggcacagtggctcacacctgtaatcccagcactttgggaggctgaggcaggcggatcacttgagctcaggagtttgagaccagcctgggcaacatggcaaaaccccgtctctactaaaaacacaaaaattagccaagcgtggtggtgcacacctgtagttccagctatttgggaggctgagacaagaggatcacttgagcctggtaggttgaggctgcagtgagccaagattgcaccactgcactccagcctgggcaacagagtgagtctccgtctcaaaagaaaagaaagaaacaggttctgggtaggccttttgttagctgcagctttagaataaaatggttttctttttcttacaggggtcagacaccataggataaaatgttaataccgtgcttctgctgacatctctctgtttactactcaacactggcaggcattagggatttcttttcatgttaggtaaacccctgtgaaaagaatcaagggaaaggtagcacttgctatccacaaagatactgttctcggacagttactttcatctgaacaaaccctctcctcggcccctccagcagcctttatcgtggggtcttcttcccttctggatgctccggggacctcagccctgtgttttgtgattgtttcagacgtgtccattgggtgtcctgctgtctctcctgccagaactgtgctctccttcccttccaagtcagcattgccctctgcctctcatccaagcttcgctcttggcccctctgctcccctgctgccactcagaggctctgtcaggggtttctttcctgatccccctgatacacactcgcctttgatgttctcgtctcagagccgggacctcggtgcctgtggtccaggctgtgcttctgcactctccctttggagtccacccagcacacttgccacagccaccagcctaacctcagccatcgctttgggagggtttgttcagtgtctgtctaggcgcaggaacagaatctcgacttgcttagcccggctaccgactccgtgttttggctccctccacctaccccacagatctccctccatcagtgccagccatgccctctgccccttccacccgccccacagatctccctccatcagtgccagccatgccctctgccccttccacccgccccacagatctccctccatcactgccagccatgccctctgccccttcccataggcctggactcccttctcctgagatgtcccgcagactcctcttcattaccatgcgcccctcaaagccaaagtcaagcctgcatggtttcttctcactcctcataggtgctttttctccgccagttcctactgggattcaggggcttggggctgattttactatttattccttttatgtttactcaagcttttatttttttaatttttatttatttattttgagacggagtctttctccatcatgcaggctggagtacagtggcccgatctgggctcactgcagcctccgtctcctgggttcaagcacttctcctgcctcagcctctcagtatctgggactataagcatgtgccaccatgcccacctaatttttttttttttttttgagatggagtctcgctctgtcgcccaggctggagtgcagtggcgtgatctcggccctctgccagctcccctcctggtttcatgccattctcctgcctcagcctcccaagtagctgggactacaggcgcccgccaccacgcccagctaattttatgtatttttagtagagacagggtttcaccatgttggccaggatggtctcgatctcctgatcttgtgatccgcccgccttggcctcccaaagtgctgggattacaggcatgagccaccgcgcccggcctactccaacttttaaaatgctaccggctttaagaaaaacacagatgaaatattaggatcaagataagccatgagggggcaaaagaaaccaccaaaagataccctgggaggtgaggccagcatgattctctccatttaaggtcatgggtttactgtgtaaacaggcccttcatttttactaactgctgcaatggcagtctgttgttttctgcccagtcactccttgttccctctcgcctacatacctgttagaagttttgggtcctctgcgtaccaattttctgatcttggccaagatagttcacctctaagactgttttgccatctataaaatctgtaaaatagagatactacttattacccaataagtagacttgatgagaactaacataaagtatctaccatgctagcctgcacaaagtagacattcatttgatgtgaggcatgtctctgcaaaccactcaacacagcccccaacacagggaagatggagagaactcagcttccctgcgcacttggttttggtcctcaccatggtatcttcccctgaagataacatctgcattgggctgcgagtcccaagccacttactagctgagtgacctttgtacctctctaatctgcctgggtctgtattctaatttgtaaaataaggtaattatgagtgccttactgggttgctgagagtaaaatgtgataaaatatatgaaagtattttgaaaatcataaggcattagacaaatatagttattgcagtttacatcttttgagtacctagcatatagcaccttagaaatatttttttgttcaggaaagtgcttgaattaataggggtacttgttcttaagcttatatgtctatttagtaagcttaatagaaccacagagaggaaattcttaataaaggaccttcgtttacagttgtgtatctgaatctttggctcattttgagatgccttcttgttaaagtagagggtgaaaccattcatagagctctcgtcagactgctttgccagacgcagtacgcagcacatgaatgtttcacgggaccaccgtgcagtaatgtgagctgtcagtattactcagttaattccatatgcagtgaccgtgtgaacatggctgctttgctcggttccttgttgtggcttggggttttaacagtgatgggcacagcctttcagctgggaagcatggagtctaagtggactcacgaaagtgcagtgaagcggtggctgtgcagtggcacagtagacagaatccagcatagcacaggaaaggagctggccaggttgccctcaggggccagaagagccttcccagaggagggggaatggttgaactgagggttgtgaggtcccattcagcatcaaggggatcgtggggatggcagcagtgggaagagaggctcgattggaggagggagcagccagcagcttcgtagggtggggcagccacactggtccttagaggggatgcttccccagggagcagtgggagaagggtggctgaccaggaaacaggaaaggcatggagggctgtgagctcacaggaaggtggctatccagggctggagtgcattctctgagagcctcgtgggaggatggagatgggcagtggagtctgggcgggcagagggagcacactgcggcaacagagctgtgagctggagacagggcacttgagacgcttccttggttgacaataaaccctttctttttatcatttctgccagtcagttatgtcgttttctggtaggcaatgtcatgcttgttaagaaaactgcatgagacagaatcaaaagctttaacaagtccatttatatttatacattcagccttagctgtatggtctcgaacactagagtgttgtgttttcttgactcatcagcagaatatcaggaatgtaaatgtaaatgtagccgtagatactctcaacaccattttttttttttttttttttaaagacatgtgatcccagtatgttgcccaggctgatcttgaactcctgggctcaagcaatcctcctgcctcggtgtcccaagtagctgggactacatttgtgccaccacaccacaggaagaaatccctaataaggcgtctttcagttacagctttatacgtagacctttgattcctctgagatacctgtttattaaattagcaaacttcccaattttgacctgacatctctaagaccatgtcacaggctgaaaggaaagtggcagcccagttttccttggtcttgcgtatgctgaggcttgagttttcagttgtggtctcccatgtctgttaaaacactggccagcgttctcagttggcgtaccttgcattctttcagcattgcactgtggttctagaccccggtctgacgcagtgtcgggcagccctaccgcgtgttcgagtgctgctcttcggtagcacttggtctagcagaatataccgagtcctgtctgcagaaccttgacaagtcttggaaagcggtctcagaatgcttactcacacacatctgggacatttccaatttaataaatgtcacggaaaaagtttggcagattgtttaattacatgtaaaagctgcttgtggctttccttgctaatatgagcctgaaaaatgctaactacaattgttatgaaatcagggaaagcttgtgcataccctaaggtttttctggagaattgcttacctgtgaactctaaagccattcctgagcggtgccaagtgtgatattgtagcataagaagagatgtacatttggtctgtgccctggcccctggcacagagcttctcaagctcctggactctctggagtactgagagtgtccttatgtgctgatcaggtgactggtgactggctaccccctaggtagcctcaaggtaaggactggtaactggaggcctggcacggtggctcatgcctataatcccagcactctgggaggctgaggcaggcggatcacttgaggtcaggagttcaggagcagcctggccaacatggtgaaaccccgtctctactaaaaatacaaaaattagccaggcgtggtggtgtgtgcctgtaatcccagctactccggaggctgaggcaggagaatcacttgaacccaggaggcggaggttgcggtgagctgagatcgcgccactgcactccagcctgggagatagcgagacttcgtctcaaaaaaagaaaagacaaaaaaaaaagaaaaaaggagtggtcactggaaagacctaggcaggattagagggttaggactttgagctccatgccctagcttctgtttgaaggttgggttatccagtggccaatgatgttaatcagtcatgcctatgtaacaaagcctaaaaccctaaaaggataggattctgggggctctgggttcctgaacatgtagcagtttctggagggtagtgccctcagagggcatggaagctctgcaccccttcccacatactttgccctgtgcatctctccttctgctgttcacctgggtcctttgtgatagcctttaaaaaaaaaaaaattagagatgggatctcactatgttgcccaggctggtctcaaattcctggccttaagcagccctcccgtcttagcctcccaaagtgctgggattacagatgtgagccaacatgctcagcctgtgatatcctttataatacatgggtaaatgtaagtaaagtgctcctctgagttctgtgagctgctgcagcaaatttaattgaacccgagaagggtatcatgggaaccctgattcatagctggttggtcagaagcacaggtcacaacctgggacttgtacttggcacctgcaaaggactgggggagtggtcttgtgggactgagccttaccctgtgggattgatacactctccagctggacagtgcagaattgcatggaattagaggcacacagctgcagaactgcatggaattagaggcacacagcggcagaattgctttacacccccgacatctggtgtcagcagtggtggtgtgtgtggaagtagggaaaacactttgatttttcctatcctcattagccagggaggtcagcaccccctcattttactagagaagtggggatgttaatcaagtgccctgcccttctcaagttcaaggtgcctgagacactggcacccctcctgtcacctgcatatatttacttcatgttttgattgtcccatcactgccagcatcaccaggcatgaccaccgtgttccagagcatggtggcagtttgtgagtgacagagtggcagccagtggcctagtgtcccgcaggcagagcagactctttgtttctccaaggcaaggatgtggcagtgccaccaaatggtcgtgtcaattgatgcccaaatggctcaccaaaagctgagtgacagttgccacagcaaaaaaaggggagaaaacataggttcagaatttcttggaaatgtttgaaatgcatgtgatagaactctaggtgggaaattggcttgttagatacagtaacttagcatgcaactagagtaaacagtttgacctaccaacccaccgactcatctgtttattttacttctttttttttgagacaaggtctcactctggccaagctggagtgcaatggcatgatcacggctcctgcagcctcgacctcctgggcttaagcgatcctctcaccacagcctcctaagtaactgggactgcagaggcacaccaccacgcctggctatttttttaatttttgtagagatgggttttcaccctgctgcctgggctggtctcgaactcctgaggtcaagcagtctgcctgcctcagctcccaaagtgttgggattgcagacgtgagcccctgaggctggccccatttgtttgttctaataaaaatgtaggactgaatttgactcacagttgactaatttacattctaaagtggccagaaaacttctattggtagtttccttcataggaaaattgggaggttctcactcaaaattggcttatatttgggcatatgttaggatacatgtaatgtttaagtaaaagtaatactttgaatatcaagctaactagtgataagtttatggttatttatactgttaggtaatagggtattttaatctaccccttattgccatggggaggtttaaaaaagcaaaattcaaaacggagaaattgtgctgacatttgaacaaaataaatggattatttttcaagtaatgttttgtttttagaaatagtaaggcagccctcattttgcatggtggtactgtgggactagaaaaatggccttttggggcaaactggtgcaaagtgacctttttcttttggagtaaaacatgcacgcacacatgcacgcttacttgcgaagcaatcttaatcgtcaatggagaaatggattgcttgtgatctttaatttttttttttgttaaggcacaaaaatctcttactgtaaattgtaaacgtataggggagtgacaagcagtaaaacattgattaaatacactgtaatttataacattaaaaacattgatagttaaagtacgtaaccctttgacgcagcaggttcatttctaagtggatagcttagagcaatctggtgtctccttttaatagtattttaaattataatttttatcataaaatgacattcataaaaaaaccctacctaaacacataattttagaaaaatcaatacaatgcctcaattgtgatgtaaaataaataaggggaaattagtttacagtaaaatgttttgttgtataaatgcttgggcatgacaaccctagaaggcataaggcccgatgtgtgtactttctgataacgaatgtttggctttaagagaagattgtcagaagctattacaaagaagaatatagcaacacaaaagaagaggtgactctgctggataaaaatgtgttaggataggtaaaagcagaccagtcatttatacgtaataagagaaaaggtaaataatgaagttagagataacatgccattcatattatagattgtcacctggagaaaatgaggaagtattataatctcacaaaaaaacccctgagccttctttgtttccagtgaaacgtcagaatccttccctgggtcatgacagactcagaggagcaacagggtatcacagaaaacatattgcttcccacctctcccagcagatggccagacatgcacccagttgagtacatgaagagattttggagattcctgtatgataggcaatggcgaatggagaatggatctgaaaaaagggaaaattaacctcaaggtttaataacacaccagggtggtaagccacaaggaaacaagcattttattatgttgctggcctactggggataatttcgcagtatcttttaaattacaaattccctttgacccagaaattctaaggttttatcttactggtatagatgcacaggtatagaatgatgtatttacaaggttattcattgccatattatttgtaatcgcaaaagattggaagcaggaacataaacctcatcagtagttgaacagttaaattatgattcatattctttgtatgccaggaagctgtaaaaagggaggaggatgttatgcaccgatatggaaatatccttaactgaagaaaagcaagggcgaaagaatagatttgctcatatatgcattaaaaaatctctagataaacaggaaaggcacaactttagttacctactgtgtggaagagtgaacagggctgaaagggagatttctctatatacacctttattactgatccaaaaaaattaagtactttttctaaaggtgtgtgtaaaaaaaaagaaagaaaaaggtctgttaggctgggtgtgatcgcccctgtagtcctagcactttgggaagccatggcaggaggatcccttgagccaggagttcaagaccaacctgggcaacatagacagaccttacctctacaaaaaaaatttttttttaaattagctgggcatgatggtgtgcacctgtggtcccagctacttaggaggctgaagtgggaggattggttgagtatgggtgttcagggctccagtgagccatggttacagcacggcactccagcctgggaaacagaacaagactttgtctccaaaagcaaagaaaaaagctctgtcctaatcccctttcctttgctgctgctaccactgtttttaaaccttgttagggccaaaatgtatttagaaatatgggttatacactgaccttagtgatggcttatttatttattttgagatggagttttgctcttgttgcctaggctggagtgcaatggtgcgatctcggctcaccgcaaccttcgcctcctgggatcaagcgattctcctctgtcagcctcctgagtagctgggattacaggcatgtgccgccacggccagctaattttgtatttttagcagagacggggtttctccatgttggtcaggctggtctcaaactcccgacctcaagtgatctgcctaccttagcctcccaaagtgctgggattacaggtgtgagccaccacgcctggccagtgatggctttagactgtcaagttcaaacaggcattttctgatttcatgctttgaagacagtttatgattcattgattttttggcacatgcataggtctattaaatatttgaaattgaaaaatattttatattcctgtaagcatgatcaatgccaaaagtcacatacttgctctattgggaactttgaaaaatactataaatataaactggatgtcatatgtttgtattttgttattttctagtgttttaaatgtatccgaaactcttaagtgaatattcttttaaaaaattgatcgcagaggctgggcgcagtggctcatgcctgtaatcccagcattttgggaggtcaaggtgggaggtttgcttgaggccaggagttcaagaccagtctgggcaacataacatctcttaaaaaaacaaaacaaaacaaaacaaaaaaacccaacttgaacattgtggtgcacgtctgtagtcctagctacttgggaggctgaacctaggagttggaggctgcagtgagctatgattgtgccacttcacttcagtctgggtgacagggcgagactctctcgaagagataaacaaatgtaagaataaaaaggtgattgtagaaggctttcatttctgttggaatcaagggtttctgccctttatttatttttattttgttggtttgattctgcccctcccctcaggctgtttaaacatgttaattagaatgtattttctttgggtttttttttactaatatatacttgaattctgaagtatatgaaatatacattctcagtaatatttcaggttgttttgaaacatacatgctaacttttttttttttgaaatggagtcttgctctgtcacccaggctggagtgcagtggcgcgatctctgccgaccgcaacctccgcctctcgggttcaagcgattctcctgcctcagcctcccgagtagctgggattacaggcatgtgccaccacacctggctaatttgtatttttagtagagacgggggtttctccatgtcagtcaagctggtctcgaacttgcgacctcaggtgatctgcccgccttggcctcccaaagtgctgggtttacaggcatgagccaccatgcctggctgctaatatttttaattgtcttgcttgcttattctatgcaattatatgtgtttaagtattgaaatgctaacaacaaccaaagatagtttggtttgctcttagcagaatgataaaagtacaggaagcaaaacttagaaactcccatgaaaaaatcccagttttgcctaaaaaaaaaaaagttttccaaaaaataaaaaggaataaaaaggagtggagctaccatatgctacaacatgtccgacccttgaaaatactatgccaagtgaaagaagccaggcacaaaaagccacatagtgtatgattccattcctgtgaaatgtccgaaacaggcagatacacagagacagaaagcagattggtgggtgcctagggcggagaggggagggagggtcggtggtgattgctgataggtatggggtttttttggggggtgacgaaaatgttttgaattagatagtggtaatggtaacacagcattgtgaatatactaaaaaccactgaattgtacacttaaaatggttaggatggagaattttatgtgacctttatcttgacaaaaattttaaaacataaaagcagtatggtcataaattttttgaatgtatattcacatcagtatttcagttactatgaagtaatgcaactcccttcagagtcaaaacaaaaaacaagttaaatcattaaggataatatagtttcagagctgacggaccagatggattataaattgtgtttattataaagtggctggcaatgccactgtagctggtgaagagaccacgtcttgaattaaggtttctcaggtttgaccttcagtgatactgatttgacatttagaaacacacaaatgcaccctccttagttgctaagccagaagttaagagagaggcacagtgcatttttatttcatccatgtactttttttttttttttttttgagacggagtcttgctctgtcgacaggctggagggcagtggggcaatcttggctcactgcaacctctgcctcctgggttcaagcgattctcttgcctcagcctcccgagtagctgggactacaggtgcgcgccaccacgcccagttaattttggtatttttagtagagatggggtttcaccatgttggccagaatgatgtccatctcttgaccccgtgatccgcctgcctcagcttcccaaggttctgggattacaggcgtgagccaccacacccggccccatgtacttttctaaaagcactaagggcttttttcctctttttctcttccaaatgaaaaccccactctgtttttgttaagttcaagctgcggttggtagtggtgagctccttgtcatttaacggagactgaacgagttctggaagacaggaccaggtttgagggctaagtgctgtttgccgtccatccacaggccaaggacccagtatcgggagagcagagaggccgaggacacactggttcttaggagcgctcaaggttgttcacccttgggagcagtttgtgagcagtgaaggcaggaaggcaggccgtgagcacccaggaagcaaaggcagagaatgcagacattcttggaggatttttgttagcaaagataaaggcttcgggaggccgaggtgggcggatcacctgaggtcgggagttcgagaccagcctgaccaacatggaaaaaccccgtctctactaaaaatacaaaattagccaggcgtggtggtgcatgcctgtaatcccaggtactccggaggctgaggcaggagaatcgctgaacctggaaggtggaggttgtggtgagccgagattgggccattgcaccccagcctggacagcaagagtgaaactccatctcaaaaaaaaaaaaaagataaaggcaggtgcagggtaggctagaaatccagaaagttgtccatagactgacagtgatgagggcgtgtgtgatcattttccacttcatgcgtcggaatgcacacaactgctttcttcaaactgttaacagtactgctaagaactgaattaacagttgagatattaagtaactttattttagccatgtggcaaaaatcaaccagtccatcacaggccaaggatttgcatttgaggagcagacagagaggaggtgttaatgtggaaggggctgcgggacacctgtcgagctgctctcctgggttagagggctggtggcgatactgcctttcagttgaatggcacttttgatggttttcccatttgattgttacggttgtggaccatgggtagagtgtagctgtctttgcacacattttgtggatacataaaccaagaggaataataacttaagtgacatgtttgaggttggaagggtcagtttgtttcaaacatggaaggacagtgagtcagcttttttttttttttttttttttttttgaggcagggttcaccttgtcacccaggctggaatagagtggtgtagacacagctcactgcagcttcaacctcctggactcaagcagtcctcacacctaacctcccgagcagcagggactacaggcatgcaccaccacgcctggctattttctatatttctattttagagatggggtttcaccatgttgcccaggctgctcgaactcctgggctcaagtgatcctgcctgcctcagcttctcaaagtgcagggattacaagcgtgagccaccactcctggccgtgaattagcattttgttgtctttttttatttgttttgagacagggtctcaaaacagccttgagcactgttgccctgggcactgttgcccaggctggagtgcagtagtgtgatcatagctcactgcagccttgacttcctgggctcaagtgaggctcccacgtcagcccgcaaagtagctgggaatacaggtgcgcaccaccacacctggatcatttttgtatttttgggagggaccaggtttcaccatgttgcttgggttggtctcaaactcctggcctcaaatgatcctcccacccgagccccccaaagtgctgggattacaggcaggagccgctatgcctagctagcgaattagcatttaaaaaatatatacttcctggttccccctacaggagtgttgattcagcaaggtgaggcccaggagtctgcatttgaatcagctccacaggtggttactgtgcagccagtctgtacttcccgtcttgcctgtgccgcctcaacatcgtggagcctgcgtgttttgctaactcgagagcccaggtgtgcagtgcattatttttcctgataggcagcattctggttttgtgaatgggtgtgcctttggttccattgccatcatctgggctgcggacattgactgggttccccctgggtgcccagcactttgtcacaggtctgggcttctgcttttcagagtagagtggggaagacagctggacatgcagccgggaagtgaggaatgccggggctgggggcgggtgtgaccacctagcaaggggacctgtccatgcccacgtgggaagtagaggaggcctctgcaggaaatggcctcaagctgtgaacatcaggtaagtgggagctggtcagggaaaagtggcagcttcagaggtcagagggaacaaccgtggtgtggagggccagcagaggaacagacggcatgttgagcgagctgtagattgctgtgaccgatgtgctgtgaggcatgaggtgaggagggagacgctggagtcagaatgggcggagctgacttctagagcggccactctgacctctcttctgtgtgctcatggtgtcacctgatagagtatcaaggtctggatgagacaatccatgttaagtgcttagaacaatgtctggcagataatgcaacagaagtgtgtgttatgacttctcatttgggttagaagttattaggggggctttgggcttgaccttaagggcaatgggaagttactgaaggattttaagcaggaaagtcagagtctgatttgtttcggaaaacatagagaatggatccgagcggggaaagattgaaggcagggatgagttaggcagcttttttagtagaccaaggagacacagtggcttggataaaggaagctggggcgaggaggtagaggagtgggcagttctagaagatatgtgtgtgagggcgaatgaggggtcctcagccagtggttactgtggaggaggaggcgatgtgatgtctcagtgtctgacttggacaactggatgctgatgtccactgcgtgagagcttatgaggagttgggagcttgggcaggaagatgatgatgagctcagtgtggacaaaggtttttgaacctccaagatatcttgcctgtaatcccagcactttgggaggtggaggcaggaggatcacttgagcccaggagtttgaggccagcctggacaacatgacaaacccccatctctccagaaaattagctgggcatggtggcgcatgcctgtggtcccagatacttgggagactgaggcaggagaatcacctgagcctaggaagtcaaggtttcagtgagccgtgattgccccactgcactccagcctggatgagagattgaggtcgtgtctcaaatagaaattttaaaaagtgcggttgggcatttgcctagggtaggtgattgaagccacggacaccggccggatcaggcaggcacactgcatagggtgagcagcagaccggaaatgtggaaccccaggagcaccagcattctgtgaatagacagacaggaaacagggtgaggtgaagagatgggggtgaacagtcagaggctacccagtagatgaggactggagctggcctttgggtttagcagaggagaggtggtgagtgccatgaaagcagcaggcgctggagacaattgcagtggtgagtaaggggccaggaaacagaactgaagaccgagacaacccaggctggggaaaagtttctgaacaagttacgtgtccatgtggacaccgtgtattctggtcatgtccttgggtttagcattgtttagaaagacagaaaggaggactgatcttttttgtttttaatactaagcaatacagacttaaaaattaaaacaaaaaaaaattatcttacttccaactctcattcccaactgtagtgggtaaccagcatcagcagcttggtgtgtatctttctatattttatcttatatatacttgaaaaatacataaaagcgtgtgtttgcttttaaccaaataggatcatatggaaatgcggttctgtactatgtttttttaactcaatatttatgtggtccctaaatactaggtttgggcatacattttttcagcatgtatttcttaaagagaaactgacagggaaaataaataagatattgtattagtccgttctcacaccgctatgaaaaaataccaagactgggtaattcataaaggaaaggtttaattgactcacagttccgcatggctggggaggcctcaggaaagttacagtcacaggggaaggcaaaggagaagcaggcacctttttcactgggcggcaggacggagtgcatgcaagcaggggaaatgccagacacttataaaatcatcagatctcgtgagactcactcactatcacgagaacggcatggggtaaccgccctcatgatccagttacctccacctggtcctgccctcaacacatgggaattaggggattataattcgagattttgggtggcttcacagccgtatcagatatattggaactttaaaaatgtttatgtaatctgttatacgcaaatattgtccagtgattgaaaagccagtgctacttcagtcacagtggctttgaacatgtttagaattcagtgagatgatgagaccaaatttttataaaatttataaaaatgtgaagtttgtggtcttcttttctagtgtcctcctgtcccccttttatcattaggagtggtgcaccctgccatctatctatggactgacgggcagatagatatagatgtttattagcatacttttaatcgtggcaccagggtttcaaaacatgatttgctcattcattttaatatataaacttctaattttctttatttcaaatttgacatgcttttaaacctagactgaggcgagtagcttctactgcctgaagatcacagtgtgagctctgcatgccggtttctcatgtccttgtgtccatttattagacgtctttttgactgagaagacacaagactttgccttctgtgaagttctttttttctgtttttttttttttttttttttttttggtggtaaaatacatgtaagataaaaataccatcataaccatttttaagcacccagttcacggcattaagtatattcacattgttgtgcaaccattactgccacacatttccagaacttcctcatcttcccaaaccgaaactccatccccattaaacaccaactccctatctcaccctccccacccagcgttgtccagacacctaccattctattttctatctctatgagtttgactgctctagagacctcatataagtggaattctacagtgttttgtcttttcgtgactggcttatttcactcagcccaacatcctcaaggttcacccatattgtattatgtgtcagaatttccttcctttttttttaaatttttttttctttgagacagagtttggctctcattgcccaggctggagtgcagtggcgcagtctcggctcactgcagcctctgcctcccaggttcaagtgattctcatgcctcagcctcccaaatagttgggattacaggcatgcaccaccacgcctggctaatttttgtatttttagtagagacgaggttttgccattttggacaggctggtcttgaactccttgcctcaagtaatctgcctaccttggcctcccaatgtgctgggattacaggcatgtgccaccatgccctgccaatttcccttcctttttatggctgaataatattccactgagtgaagttttatttcattttcagcaaaaggttagtgaaatgttgaaaagcagttaaaaagcaaaacagagctattgaaggagattatagagagtaagagatgtggaattgtaacatggccaagtaaagaaaacgggaagaggaaagggtaaggggtggggcccaggcacccacgtgaggttggggaccatgaggctctgttgcccctttcccactggcgatggggctacttcgaggcattgggatgatgggaagagggcccaggcacccacgtgagggtggggaccatgaggctctgctgccccttttccactggcgatagggctacttcaagccatcggaatgacgggaaaagatggatcacttttggcaataaatgtcacatctgatcttaacttgaaattgacctgattgtggcttttgagtaataatgtctggtctatataatatgaacctgttagccagatctaaacctttcgttcagaagtgataaacatcagcattatcaggcattatgtgaaaccaagttctttagctgattttagtgttactttctgttgtctcaatcctagataatgtcaaatagaaatacatatttgcattcttcagatttatattttaaatgaaaatattccggtaattattgcatctattctatttcagaaaatacttgacactttaattattaaatagaatgtcactttaaactagtgatatatttgacttacagtatttttaaacttaacatttttttttcctaaataggaaaaaatgtacactgacaattagattcctctgatgtaataaggtagatcatttattgcacatatttggggttcctactatttttttttctgcaataataatgcaagcagtacatacaggaacatgcttttgggatcttaaactttggaatgtcccgtctaatgtttacctaaactgctaagtttaaatttgctttgatatattttcagttgttggattcttctgagcagagagaaaggtttttttctttaagtggagtaatcatgaacgtctatgaattcgttttctactgtagccacagcagtataccatagaatagttttggtagttgaatatattgggaatacttacatttaaccaaaataatagaaattccctgtattctctttggttttagaggcaaatctaaaatctggaagttgaaatgaggatagtttggggttcttaggaaaaccttagggaaactgtatgaaacagaaaaaggcttgctgctggtgccggaagagtgacagcgtgctggggggtttgtgcatgagtgaaggtggggccaggtgggagccttcctgtttctggatggatggtctgtgcagtagtaactcaggctgcatggttcttgcatcatccgagttgtgaagtgctcttcctccacttccaggtcctccttgttatgaggacttaggctttgactagggctttcatttaaaggtgacgaaatttgttcataatagacttttaaaaataaaacaccgatattccaccttcctgggaccgacagtcctaggaccctgccaccttgtcaggattcttcatctcccctactggtccattattaccctcccagccctgccagcctttcagctcccttgcctcttccacttcattgcgcttacctggcagaaaccaccccattcagtccgttctccatgcccattcacctccactgacccgcagaggccctaagtgccgccagcatctctgttagtgcatcccgccctctttcttctacgcggcatgctgcctacccgtcctctcttctagatgccatttcataccttctcctctcctatcttccccaaatgtaaatgcagaatgatgacattgtgtttgtttttttctgtgtgaaattggaagaaatcagaaaagaagttccaccaactcccaccacacctctggatctgcaccccgcaccccatgtcgtctgccctctttccctttactgcgggtgatctgtgtgccccagaaaaggtcagcctctcctcttagtcacttgacttacctgctttcagctggactcatcagttcccacctccccactggattcttgccctcactatgcaaatgtctgtctcatcctgcaaaggtctttcttgacctcatatcttctccagccactgcactgtttttcttcccctttactgcagagttccttggaagaattttctgtactccctgctttacttccactcttcccattctctttgaactcagtccagtgagggttttgacccgccactgcagcatgctgcagatgtcacagtcaccatcgatctccattccagcaagtccgaccaacaagcatcagtcagctcatttgatccactggcatcagtgaatacagttgatcatcctcctggaaataaggatcttcaaagatcttgaagggtttcctggttttcctcctcatccctgattgctcctagcctcttttgctgatgcccctcaatgagactgttgggggcttgatccccatctcttctcaccctccacccagggcctcactgacttgcatggaacaaaatgattatccccatttgcagtctctacaacacacccaaaaactccagactgtgaattgcgctcaactgtctaataaccatttcaaatttagcacgtccaaacccaaacttttacaccttcccttcaaaacatactcttcccgtagtcactcccttctcaggaaccaatgactccatccttcacttgcttccgccagaatccttggaggcatcctcgtgcctttctttctctgcgatctttgacctgtcaggagctcctgctggctctgtggtgaacaggtccagagtccctgcttctcaccacctgcggtgagcccaccctggtctgctgcataattgcagtcatttcttacccatctccccacttctggcctcaccttctcacaggctgttctgaagacagcatccaggggaatcctttgaaaacgggtgaagggcacggctcatgagaatccttacttaggctctttcttttctctaatattgattttagttcagatcctcattaatccctgggattattgcagtgaactcactgctgatttcccagtcttaatctcctccagcccgggggtagcagtgcttccagcgacctttcattgctccaacacacccattttgagcacatcccttatgctaatgactgactgagactttaccagttttgccccattttctgttcagagtcctcaaagcctgtagataaggtgatttctatagccttcaacattaaatccaggtttcatgctgtgtgctgttgttctctgaatggctgcccacttatgacctcaccggcttcctccatacacgctgcccatgccccagccctgctgaagcccttgcttatcagataccttctgcttttgtgaaagaggctctcactggctatacagcatgttcagaattcagctcaattcaagtgctgtgtccttcagcaaaccttccgagaagcactcccacttcccatcatggatggcttcaactcagctcccgcagtatcctggtcacctctcacccagagcacgtactgctctgaggttcctgccagctcgtctgtctgttctttaaagcatcctgaggagtggacaggccctgtttctgtgttgctgcagcggccagcatagacgagatatgcactatttcttgaaagaactgtaacgtccgatcgaggtggaagcactcacttgtgctttgatgcatctcccctccaaacacaacagtgaaaaggtacaatttaagtagagaaacaaaccaaaaagcatagccagcccaccaagcaagagaaatacccttcagtacacaaacagactagaaacctagcatggtaagcctgaattgactggatttcactggccactgagccgcaggctccaagcaggcagtgtcagtaggaaagtgggttcttacaggggtaagggtaacagggactaaagtgttcagtggagttagaactagatgtagctacttttttttttttttttttttgagacgctctcgtcacccggcctggagtgcagtggtgtgatcacggctcaacctgctgggctcaagcagtcctcctgtctcagcttcctgagtagccgggtctatgctactgggtctacgcatggtgtgtgccaccatgcccggctaattttttatgttttgtagagatggggtctcactatgttgcccaagctggtcttgaactcctgggctcaagcagtcctccaaccttggcctcccaaagtgctgagattacaggcaagagccaccatgcctggccttagatggtttttggagctggagttagataaggtttccccatctaaggcaattctctgctatacagattggggctctactggcagttgtggtcctagggaggtagaatgcaaggcctgggatgagccatgctattccatggttctctaccagggtctgcactgttggtgacataaccacgcaacagaatcctgcatcaccatggaaaacctagttctggacggaggccttggaaggcttggagggcaacaaccacagaacactagtgctatgggctgaatacttttgtgttccctgctctgccaaagtcatatgctcaaatcccactccctggtttcactgtattagaaggtagagcccttgggaggggattaggtcatgagggtggactccttgtgaatggaataatgtgcttagaagagaccccatagagatccctggtcccttccatcatgtgaggacatagaagctggcagttgggccctcaccagacaccaaatctgctgatgtcttgcttctgaacttccagcctcgagaactgtgaagaatgaatttctgttgtttaaaaggtaatgggagttagttacagcagcctgaatggactgagccactagacagggaggagagcaccagcaacagaaaaccttctgtcgcgatgagcccgagaccccaattcctctatgctcaaagacctctaatacacatcctcacagagctgatgccttacagagctgtgcatttactgcatcggaaatttaaggacagtctggcaaaaactgtcaaaataagtatgtttaagatgcttaaaaagataaattagcatccatgaaaacaaacaagaaattgcccaaaaggaaacaagagtaagaagatatgacccaaaaaagaaaaagaaaaaggaagaagaacttgaaatctagtaaatgaaaaggatattagccaggatgatagactctggaccagacatagtcaaagacaaaattagtggattggcagttacttcacaaaattgacccagatgacagggacaagatggaggggcacaatgataaaattcaaggtcctgaattcaggcaggcctgtagccgactctgtactttgacttgacagttatgtgccatattatggctatttattaattattattttttgagatggagtttcgctcttgttgcccaggctggaatgcagtggtgcaatctcggcccaccggaacctccacctcccgggttcaagcgattctcctgtctcagcgtcctgagtagctgggattacaggcatgcaccaccatgcaccaccatgtccagctaattttgtatttttagtagagatggtgtttctccatgttggtcaggctggactcgaactcccgacctcaggtgatctgcctgcctcggcctcccaaactgttgggattacaggtgtgagccaccatgcctggcctaataatggctttttaactgaagctagtttgagtctgtttgctttttgcctgcaagagaaataatctttcctcatgtacgaaccccttcatgagatgacagtgtttcgttaaagttagccattagatgatctgacagtcagctagagttaattatcagagatgtaaatcggtatttgatatgattaatattggcacataagaaatctctgaaacttaggaaggaaaacaaacttggtgggaggacatggacagaagaccggtctacttggcggcctctccctaccctcctcccgcacgctgcccagcccaggagcccgcttctgaatgctgcgttcgatctctgaagaggtttcagcacttacagatccttaccaggttttaagccacatttgggtgatcttcattagtattgttggcatttctttgtgtttgcaagtatgcactgaaatactgaattgaagagctattcatgttctttagctaattttatggtctcaggagcagccttgtctccaaaactcactgtataatatgtttataatgtctatatatatttaattgcaataaaatatactaagataaaacttgccagcttaagcagttcagtgaatgctagattcatgtagtggaatgtgcttgtgtcccctccccacccccgctgtgttcagcctctgctgttactccccagccaggcgcagctttggatgtgtccacagtcaccctgctgctgtcttccactctctctgaccacactcagttctgagccccacatatgtttctgttgtcttcagcagtgccctgggataattagaaaccaattcagtgaaattgtggctaattctaagaaacagtttctgaagtcattttaggagatttgttcctactctggagggctcctgcagcaagaattctccagctctccctgctgactagccagccgcagtccaggctgtgcctccattaaacccacacctccagttgccttcactaggacctccactgctcctaggtttaaagagagtgcccagggtttaaatgttagtgccctaacatttaaagaggtttaaatgtcaccaaactcgtttctccctgaatgacgcccctggtcttatggcggcagccagggccctctcagcttgtcactccagccctgcagctaccgtcttacagagccagggcacagctgatcaggacccccagtattctcagcctgccacactcaaagttgagcctccattccagaatggaggctggacagaggtaggaaggcccactttgcccatgactccactagccaggatgcagcatcagcaccacgtagctggggtggggtggaactgggggagagggcactacattatcagctgcagcagtctggaacagagtcgctgcctcactgacctggaaaggggaggcagggagcagtcttggttcaaatacaacagactctggcctttcttactgaattttcagttgtttgctgtgaacccttagaacgatctccagagtctcagaacagttgttttcttacaatgttcacctgttttccttgggagcaagcaggtcagtggagcttcttgtgctgtcatgctagaagttgattacccacagtagggattcttgcagaagaaatattactttagaagagaggctgggcacggtggctcaagcctgtggtctcagctacttgggagggtcacttgagctctggaggtcaaaactgcagtgagccatggtcacaccattgcactctagcctgggtgacacaatgagaccctgtctcagaaagaaaaaggaagaaaaggaggctaggacaggggtggtggccttctaggccatctttcctctctctccagcaactctagatcacatgtctgtgagtcatttaaaatgtcttcattcagttcatgtcaggatcctgttcaggaaaatgttttggacttctctggctgctgagaaggtggacttggattccccttctttccctgctgtccttgtcccagggtgcagggatagagggaagtcagatggtctgtcagtgttgtgatttgttagggaatctgtgtggtccattgatgccctctttctctggaggatcactgagatcccttccccataacttgtaatgaggttgcctttgtgtgaagactgtggagccttgatgaaaggctttctttagggggtctttcttatttatttaattttgttttgtgattttctaggagttcgcagcacttactaaagaactcaatgtatgcagggaacagctccttgaaagggaagaagaaattgctgaactgaaagcagaaaggaataacaccagggtgagtgtgacctttctgttcactgcctgcccctggagccactgtcaggaggaggggcggtgtgtcaaaacgaaaggacgacccactctgtctggcctgaaatacttttcataccttttcccactgagcagactgtgattagtcagcatgatcacacattaatggcttgaaatttgtgatgagaatttatgatattttaatacaattgagaggaatttgtttttctgcggaattgaagggacttcattttagtatgagactgtaaaggagttatttgccccagattcaatcatgaaattaaaaatgctgtttaacaagtctttattttggccttttatttcagctgctgttagagcatttggaatgccttgtctccaggcatgagcggtctcttaggatgaccgtggtgaagagacaagcgcagtctccagcaggcgtgtccagcgaagtggaagtgctgaaagcactgaagtccttatttgaacaccacaaagctctggatgaaaaggtgccatcagccacataagtcttggtttgtgcacatgctgtgtattaggccagcttcacaagtgttggtgtaacttttgttttttgaagcttcttgaattcttggaaataacttctctaagaagacagggttttgtaggtttaaaaagtactaattggcttaaatgtcttaaaattactaatgtatattgatttgctgttacaaattgggtagtattaggttgttgcaaaagtaattgtgggcaaaacctgcaattacttttgcaacaacctgatatttcgggggaagatttatttttctgaaacttaatttagagccattaacaagttttcttgacagtaagatcaatgacagacattaatggtattttattatgttatattacactaatatatacattaagtgtatatattacacttaactatatattaagaataaaataaacagtatacacacacacacacaaactcaaccccttttattttcaggtgagagagcgattacgagtagcacttgaaagatgtagtttgttagaagaggaattaggtgccacacacaaagaggtaagcttgagacttcatcatgagttgaattgggggggggttatttttatcctttaattattaaaagcagcataaggccagacgtggtggctcacacctgtcatcccagcactttgggagaccgaggcgggcggatcacctgaggtcaggagttccaagaccagcctgaccaacatggtgaaaccccatttctactaaaaatacaaaaattagccaggagttgtggcatgttcctttagtcccagctgctcgggaggctgagacatgagaattgcttgagcccaggaggtggaggttgcaatgagctgagattgcaccattgcactccagcctgggtgacagagcaagactctgtctccaaaaaaaaaaaaaaaaagtaaaagaagtataaggactgtagttgtacatatcacatgttacttatcttcccaattgaggaccagcctatctgagtcattttaaggactacaaaatgatggttacctaaggactcgtctggccagtggataataaattccatcttcaatgatctggttattttcggattgggtagcattgccatatgctttctcttttatactatgttaagcagtttttagttgtgtttttccaaaaggagttttgctatctttacttatttctcttatgtaaggtattttacactcatattcaattttttgctttcagctaatgattcttaaagaacagaataatcagaaaaaaactctaacagatggagtgctggacataaaccatgaacaagaaaatacaccaagcacgagtggaaaggcaagtctgtaggctttgtctttattctgtttgatttcatttgttcacagtatgtgtcgggttatgtggaaaacagttgctaaagtaccggcttagagctgaagtggtcatgaaagttgtgtaatccaacagattgcataagtcagttttgattttagctatttcctggaagtatttttattttatagctcaccaaacaagggtatttaaggatttttttttccccctatcagagatcttctgatggttctttaagccacgaggaagaccttgctaaagtaattgagctccaagaaatcataagtaagcagtcaagggaacagagccaaatgaaagaacgcctggcttccctttccagtcatgtgacagaactggaagaggatctggacacggctagaaaagatctcatcaaatctgaagaaatgaacacaaaattgcaacgagatgtccgtgaagtgagcaataacaaaaactacagtcttgtcatgaagttgtatgtttgggacgttttagttaaatgattttttttctctgtttgtctcttactctcccaattactttcaacctttggattattgtataagttatattgaaaaagagagagtgctgtgaaactgccataagctacctccccatttttgttgtgaaatctcctgtccctgagctcttcaaagtagagaactagtcccactgactgacatggccatgaagtggacgccacactggcctctcctacctgtgctgctttaatattctttaatgtccttgtttgtagattcttcatctgtgcaatttctaggctgtcttaatttgttcttatgttcagattgccttctgttgcacacatacttagcaagcagatattgatactggctgtgctagctcacgtagggcaatgtgagtatagtctcttaactgtgggagggggcgttgctggcggtcttctcattttctgacctgctccttcaaggaatttgtggcgttgaatattaatggtcaaacaatcaagagtggaatttgcttctacatgggtcatcaggatcgtatagcaaaaatatgtcacaatatactcattgctgacaaatatttctgccattataactgtgagaaactatttgatcatgaatgccgggcgtggtggctcacgcctgtaatcccagcactttgggaggcttaggcgggcggatcacgaggtcaggagatcgagaccatcctggctaacacggtgaaaccccgtctctactaaaaaatacaaaaaaattagccaggcgtggtggcgggcgcctgtagtcccagctactcgggaggctgaggcaggagaatggcgtgagcccaggaggcagagctttcagtaagccgagatcgggacactgcactccagcctgggcggcagagcgagactccgtctcaaaaaaaaaaaagagagaaactatttgatcatgaaacagtgaggctgagtgctttctcaggtgcccttcctgtcactttctaacctgcgctttgtcccttgtcaggcgcctcaaccgttgaatgtctgcttttcagtttggtagtttgacgttgagtaatttcatgtaggaattcaccacaggaagaacatttgcatgtagtatgtcacctaaggttctattctttggctacagcaggagattatgtggcagagattaatatgcagagaattttgaaattcttttaagacctatcacttttattttttaattttttattttaacttttaagtttggggtacacgtgtaggtctgttacataagtaaacttgtgtcctggcggtttgttttacaaattatttcatcacccaggtaccaagcctagttatttttcctgatcctcttcttcctcctatcctccaccctccaccctttgataggccccagtgtgtgttgttcccctctgtctgtccctgtgttctcatcagttagctcccacttataagtgagaacatgaggtattttgtttttctgtttctgtgtttgctaaagataatggccgccagctccatccatgtctctgcaaaggacatgatctcattctgttttatggctgcatagtattccatggtgtatacgtaccacattttctttatggagtctatcattgatgggcatttaggttgattccttgtctttgctgttgtgaatagtgctgcagtgaacatacgtgtgcgtgtgtctttataatacaacgatttatattcctttgggtatataccccgtaatgggatttctgggttggtatttccatctttaggtctttgaggaatctccacactgtcttccacgatggttgaactaatttaccctcccaccaagagcaggaaaacattcctttttctccacaacctcaccagcatctgttactgattgacttttccacaatagccattctgactggtgtgagatgctgtctcattgtggttttgattggcatttgtctaatcggtgatgttgagcttttttcccctatcacttgtaatatttagactttgctaactttagtcattttataaatagggaacaacttgaaaatagtgaattctgggggtggaggacaggtatttctcaagcaaaaagttctggtcctagccttaagtgtttgaaactgtatagtaatcatcttgtagacttcaggtagttgcatccaattaaattaaactggtacttctgtttccatttgtcaatatgcttgagtcttgtaattgtatgagagttcatccaacccttatcctagaaagtgagacttgtatctcactactgtgtccactgagagaggccgcaccctgtcctgtgtgagaccatttgtagcgtgaggcagacgtagactgcgtcttctttgaggacactttcacctccttgaaaaatatttagatatttgagtgtatatatttttataatattatgtagaaacaggaaagcttggtcaactgagtggccagacatagtattaagagagacaagtctttgttaatcgtataggtgaatatttatggtatttgaggtagttacattttcattcacatttgagaaaattgacatcttcatcaatttaattttgaggacattattatttatttatttatttttgagacaggatctctctctgttacccaggctggagtgcagtggcgccatcatagctcactgcagccttgaactgctggactcgagcaatcctcctgtctcagactcccaagtacctgggactacaggggcgtgccaccatgcgtggctaatttttgtttctttaaaatgtttttggccagggacactggctcacgcctgtaatcctaacactttgggaggccaaaggaaggccaaggaggatctcttgagcccaggaaactcaagaccagcctgggcgatatagtaagacctctatttctacaaaaaattaaaaattagttggatataggagtgtgcgcttgtagtcccagctactgggaagattgaggtggaaggatcccttgagcctgggaagtcaaggctgtggtgagccttgattgcaccacagcattccatcctaggtgatagagggagactctgactcaaaaaacaaaataaaatatttttgtagagacaaggtcttgaactccttgcctgaagccatcctcccgccttagcctcccaaagtgctgtgattataggagtgagctgctgtatctggcctgaggatgctaatttttaatttgattggaaatttgggatttacttcagtttttttctctcttaagtatcttaatgtgtaatcgttaattacctacttttttgtcccctctgaaatacctaatttaggccatggcccaaaaggaagatatggaagagagaatcactactcttgaaaaacgctacctcgctgcacagcgtgaagccacatctgtgcatgacctcaatgataaacttgaaaatgaaattgcaaataaagattctatgcatcgacaggtaatggattttatcgacctttgtctggctttagttaattattaatgaagttaaagaccctttttctctcactttcatgttggaaatcaagtccaaatatcaagtttttatgaccttagaatattatgttcaagacatgtgggagttccttcagtttagaggttttgattacgtaggatttgatttaaccaattttgtcctcagttttttcttttgttgtaattgaaagttaatctattgcttgttagcatttttaccaaaggagcagagagtggcaaagaacttcaaggcaattggctatttgtaactaagtgggagcactatgatacatgaatagtatgacaaatgaagtcttggtcggatgcggtggctcatgcctgtcattctaacacttcgggaggctgaggtgggaagatcgcttgagcccaggaatgtgagaacagcctgtctctacagaaaattaataaattagccgggcatggtggcatgtgcctttagccctagctactcaggaggctaaggagggaggatgacttgagccctggagttcaaggcttcattgtgctatgattgtgccactggactccagcctgggccacagaacgagaccccgtctctaaaataaaaaatgcggccaggcgcggtggctcacacctgtaatcccagcactttgggaggccgaggcaggtggatcatgaggtcaggcatttgagaccagcctgaccaacatggtgaaactgcgtctctactaaaaatacaaaaattagctgggcttggtggcgcgcatctgtaatcccagctgctactcaggaggctgaggcaggagaatcgcttgaacccaagaggcggaggttgcagtgagccgagattgtgccactgcactccagcctgggtgacacagctagactccgtctcaaaaaaaaaaaaaaggcagtgaagtctgtagtaagaaattgggtctcctgtggtttcgtaaaccatacttattcttgtaattacgagtatcactgtattccagcctgggtgacagagcaagactctgtctttaaacaaacaaaaaaaaagcttcttaaaagttatttaggaaaagcaaacactttgacaagaggtgttttgcacattgaaaccaagaccaggaaagtgggcatgtactcctggcagcaagaaaaccttacccaggccgggcacagtggcgcacacctgtaatcccaccactttgggaggctgaggcgggtggatcacttgaggttaggagttcaagaccagcctggccaacatgccgaagtcctgtctctactaaaaatacaaaaattagccagacctggtggcacatgcctgtaattgcagctactcaggaggctgaggcaggagaattgcttgaactcaggaggtggaggttgcagtgagccaagattgtgccactgcactccagcctgggtgacaaagcgagactatgtctcaaaaacaaaaacaaaaacaaaaacaaaaacaaaaacctgacccagaagcaactcccatcactgtagctcttccatcatgactctcttagtctgtatctgcatttcagtttgtttcaatctgttaaaaactgatcagctagaagatttgttgcattttgatgctttgctctcattttatagactgaagataaaaaccgccagttacaggagcgcttggaattggcagagcaaaagctgcaacagacactgaggaaggcagagacgctcccggaggtggaggcggagctggcccagagggtggcagcgctttccaaggtagtgccatgagcttcattctggttcggctgccaggcctgtgactgtgccttgcctgtgtaccttgtttgtcactgttcttattacatcagcacctaaatccgtggaagagcacggatttggtttgagtgctctttcatctgagattggaacactttgtaaatgccagacatgatccttttatcccgaagtctaccttggttttgtgagctgtatactatttgtccacggcatgtgtgatctgagagttactgcttcttagaattgttttggtcaccagcttaagcataggatagaagtctctgtaaaagaagggtagtttttctcagaaataggaagatgccgttcttttaaaaacaccatcaagataaattcttcataaacacatttttaagtaattttattattttgaaattacttaaaaatgtatttttaagtaatatttattattttgaaattacttaaaaatgtgtttttaagtaatatttattcatttgtccaacaactgttgactaggcatgtgcaagacacagtccctccaagttctccccattcatgagggaagcagctaaagaggcaaatgctgtcataggtcctgggatcggcgagtacccagggagcgcatcaccgggcacaaacccagcctctggggcgtggggagcccagcactgcagtgccaggcaggcgagcagcaggagctgaggcccctgtctgtcgtcctgagtcttcttgctcaagcttttcaagctgctggggagggcatccttctggaccattcagatggttttagggctcacacacctgttccttctagcaagtttgttgctaacagctgtaagaacctatcctcccactccatgatctgcttttaaagtctcgatttcttttctcccctgttatctttcctgtcccttgtcggctttgtagtctgaccttttgtcttctgggagctctgctgctaaggaagctaaactgttggaacttacttccaagcttaggaaggtagaatgggtgcactgctccttgcttgtgcttgccgctgctttctgctttccatgcttactaaccagaagcagtccaaggatgggagaatcacgactccattgagattgggcataggggttggggggaaaacacccagtcagtcgccagcagcagccatgcttcagaatcaccaacacaagagggctagccacctcatggcccagcacgtgaagccccgtaggctgtgttgatggatgagtacatgctttccatttagtatggcggagcagcccacgcagagcatgttgtgcctgttgccactgcagtggtatgcagcatgtcgttaatgaagtgtaaggatgacgtcagcgtacgctgtttctgctgacaggctgaagagagacacggcaacattgaagaaaggttacgacagatggaagcacagttggaggagaagaatcaagaactgcagcgggtgagcatgcagccctgagggtgggggcgctgagtgggtgctgcaaggtcattgctcggctgtggggagctcagggcctcccacccctgactgagatgttggtcctccagctcagttctggtcgcgtgcatttgttttgcaccctcatctgtgagtcgcctgctaatgcgtacatcccacacagtagttgttttcagtcagtattgggagctgcggaagaaatttgagatcctaggcagtacttcaggtgtccaaaaatgcttcttgcttgtctagcggcctatcaggggaactgttctaggtagctgtggtaccggcgtggcccccctaccccctgcaaatgtagaggcaggtccattgtcctgaatgactagtccacttttctaggatatggcactgaattcccacatgcaggtcagaggcctgacctctgtcccaggttaaaatactccaaacataatggcgtgttggaatgaatgtttctaagcaagagcaacaccgtaattgagctacaataaaaagcactaggaaggagtgtggcagtggagacttctgtccattgaatcctaagattgttttcctgaaagagttgggtggatgtcaatatggaacatccaggaaaaagatatagcaagagcagtcccagggccagctggtaccaggcctggggtttggggtagatttctctttaacaagtaggtggagaaaggaagcatgcagcgtctaattttagaactcttgcaccgtcacatcagcccactttataacattaatttaaggctactagattttgttttcaccagaaatctgtattcttggccatgccctgcagagaatcaaaggagcttctgggaaacgacgattccgactcccagtgagagggtgcattttaggcagtccccacctccccttccaaaatgcacactcatgctcacagacacaacagtgaactttaagctgtgttctttaaaaattatttaaatgctgacggaaaataagcacaaagaaggatattgtttctttcccaagaggaagtatgcgatactccgtatggcacatgatgtgctggaccctttcaggtaatgatagttgctacatgttagaccttatgagaaaaggagaggtcactacccatgttttcccagtgcagaaattgggcgcacggggttcgaatgcactgctgatggcgcggtctcatggctgtctcctcctgcctgggcagcatgactcgggtgcacgtcgtaaccccgtgccattgcctcctgcctgggaggagccccctgagcactgcaagggcacttgggcgatgagggcatggaggtgccacctggacaggtgccacctactgacacttcctgtccctttctgcctgtcatttgagaaacaaaggttttaaaccatgaatttgattatggttttataaaataatagacatgtcagttttgttactacatattaaaattacttaaggtaattatttataatttttgaatgtaaatttccattacgagaaatttaagcaacataaagatataaagaaaaaatatgaaggtctctctagcacaatttttttttccaaaacaaactttttaacttttttgctttgtaaattaagttcacccttcctccccaaatccagacccaagcttttagttacacaaggggaaattcctctaccagcgtggagacaggctcatcctctaaatatctgctataaatctgctccttaagtccctctgacagttaacaactagtgacattcctgaggagtcctgtggcaggagcagtgggaccttctagttaatgacctttccaagacttgtcccgtgctccctgtgtccatgagttggttctggtcaccatgcaaaagtccactcaagatggcagtgtggggagcaactgggggaggggagggcacacatggggctcaccctgttggtccttgtgcttttaaaataatgatcgaggatttacgtgaggtttataagactttgtttctcctgctttaggcaaggcaaagagaaaaaatgaacgaagaacataataaacgtttatcagacactgttgacaagctgctttcagaatctaatgagaggcttcaacttcatcttaaagagagaatggctgctttggaagataaggtaagttagataacacggacatgctggagctttcccaccctctgccaaaagattgctcatctgcccctgagcaggcgtgtgtaacagtggttagcagctgttaccgaaaatgggaattattctttaaagtggaaaaggtatgcacagttatccagtcactgaattaacttattgtttgctaagtccatgccccatttgtgtgtatgggaaattgtttatcattcttattctctagaatgagagtaggtaagtggtttttataaagggccagattgtaaatattttaggcttttagtagttatgagtaattaaataattttatgccaatcaagtcattagcacaaaagcagccataaataacgtgtaaatgaatgagtctggctatgttccaataaaattcatttgtagaaacaagcagtgggctggttttggccgtcaggttctagtttgccagcccctgcactaggatcattttttgggcccaaccctcacccctttattattcatgcattggaagttaatttctggctgggcgtggtggctcacgtctgtaatcccagcactttgggaggctgaggcaggcagatcacttcagccaggagttcaagaccagcctggccaacatggccaaacgccatctctactaaaaatataaaaattagccaggcctgggggcacccgcctgtagtcccagctacttgagaagctaaggcatgaaaatcgcttgaacccaggaggtggaggttgtagtgagccaagattgcgccactgtacttcattcagcctgtgtgacagagcaagatcctgtttcaaaaaaaaaaaaaaaaagttaatttctgtctcatttataaataggtcacttaggttgtatcgtgtactagaaagggttcagtcagctgaaaccaaataaatattccaacctctaccttcgttctttttcatttgatttggaaaaagtttaagcctggactctgagtactgtcatcatggaaacatgttagctgtcaccagagcgaagggatatcctagaatctgtgtcggagaagctctaatgggcagcagctggattcccgtttgataaagcctgtcctgactgtgcagtgtccctagcgatgggactcagaaactgccctgagattggttgttaggattggggtctgctcatctgagagactaatgattcccgctcattgcatgacacgtttatttacacggtgctgaccatggagggcatttccagagaccatacagagtcattatcccactcacctccttgatcagtgggtcagccttaatggagcagtgtttttatctttgattttaattatgcatttgaaacttaaattcaggtttcccaagtgaccaagaaattgtaaagcctaaaagttagtataagccagtttaactgattaaaatgaacttgcaccatgaacttgacatacctacctttaggaagttcagttggtgaggagtagatatattagtaagagatataagagaaggtgtcgccgcctcacggtctaaccctgggactacagcagtgcttgctggtgtgctcttttactccgttccctttgtgtggtcctttttttttttaaacgaatacagccatgctatatttaaatgggacattttaaagaaacactaaaggactatctgtcttttttcagaactctcttttaagagaagttgaaagtgcaaaaaagcagttagaagaaacacaacacgataaggtactgaaatcttctctaaatccatgaagagccaagttgaactgagttgatgatgatgatagttactgcagatgtctgacagtggagagcagcttggtttgtggctctcatagtccactgccataagtttctagcactctcaggcttgtatgttgaatgcctttgtatttcaggtgattttgagtctggctatgcatatggttcagaattcggagtcctttctgggtttatttgaagctaaaatattagcatcaatgacagtgctgtccaacagaaatataatatgagctgcatatgtaatgtttaattttctaatagtcatattttagaaagtaataggtaaaatctattttatttaattcagtatatgcaaaatgttattatttcataatgtattaatagaaacaagtgagctactttgcgttctttttccactgtgtatttcctagtcatagcacatctccatttagactaacccattacagggctcagtagccacgtctggccagtgttggacagcacagctctagaaatgagatcaagtatacccatgacacagggatgggtgcatacttgatgtaagacaattaaacacaatacagagatgcacaggacgtgaatattgttccccttctcctctaaaagagtctgcttctctacgaaactaataattgttaatcatttggtgtttatcttctgaaaagcttttctatgactaagacacagcttttcattcattagggcttacaaagttaatatagtagtctgagtgtttatgtttattgcagtactcttggagaaaattttcccagaattaaaatgtttggtatttgtaactgctgatttaacctgttagggttatgcccaacatctgagcacatttgaagtaagtggttttaaaatctaaaagagatagcagtaatgtaagtcttttgcttttctgtaggatcagcttgtcctaaacattgaagcactgagggctgaactagaccacatgagactaagaggtgcttcacttcatcatgggtatggtattaaccagtgagcagccatattgtcagcacctgtggcaggccagttcttggctatgtgggcagcctaactggatgtggctaatggtgtgacctcaaggagcctgtagcttagtaggaagcgagagagaaaagtaactcaaaggttagagcttggtactgaggagacacatcattggcgaaactccaaaacacaggaggagttttgatcagttaatatttggatatcttaatttaggtgcccagcagagtgtgacactgatgatgtaagagcagaatgacagatcccaagatctcacaccacagatgctggcacgggtgggacaattgcagagcagttgaaggccagcagtggcgtgtggctgtgtttttcgtcagccctgggaaagtggagcagaaatgcagagccagacacctggacccagaggaggggtctctctcatcctagacagctgggctccttgtggctcatcaccttggctgtctgcacagcttttcctggagagctttctacctggtagggctgagagactaaaactgttggcctggagcaggcaacatgtagctcttggggcagatgagagcagtgccctccctggagaccctttcctgtgtggaataacttttccaaattgatagattctgccttaactaaaagagagtttattttcttttcttctaataatgatcattcttatttttcatgtttcagccgaccccacttgggcagtgtcccagatttcaggttccccatggcagacggccacacagactcctacagcaccagtgcagtgctgcggcgcccacagaaaggccggctggcagccctgcgagatgagccttccaaggcaaggtctttgtgtgaaatacctctgcttacgtgaaagttacctacttatcccgtggctttcagactactttgggataaaaatgttgataggtcattgctttcttgccctcctctcattttctattttctgactaagagtttagcttttagagcattttttaaaatagggttttgtttttgtttttgtttttgttttaaagaggtagggtctgtgttgcccaagctggtcttgaactcctggcctcacacagtcctcttgcctcggcctcacaaagtgctgggactacaggtgtgagccaccgtgcctggcctctgtagtttttttttttttttccttttaataggaattcttataaaaatacagtcacttttaaatacaatgataatcatggatttaaagtagtgattaaaaataaatgagtaggccaggtgcaggtagctcacgcctataatcccagaactttgggaggccaaggcgggtggatcacctgaggtcaggagtttgagatcagcctggtcaacatggtgaaaccccgtctctactaaaaatacaaaaaattagctcggcacagtggcaggtgcctataatcccagctactcagaaggctgaggcagaagaatcgcttgaacccgggaggcgttgcagcgagctgagaaagcaccattgcactccagcctgggctacaagagtgaaactccatcttaaaaaataaaataaaaagccgagtgcagtgcctcacacctgtaatcccagtgctttgggaggatcgcttgaagccaggagcttgagaccagctttggcaacacagggagacccctgtctctattaaaaaaaaaaaaaagaaaaaattagttgggtgtggtagtgtgtgcctatagtcccagctactcaggaggctgaggcagaaggatcctttgagcccaggagattgagaccagcctgggcatcatagtaggaccctgtctctacaaataaagaaattagctgggcatggtggcatgtccctgcagtcccagctattcttggggctggggtagaaggatccctttgagccccgggaggtcaacgctatggtgagctctatgattgcaccactgcgctccagcttggtcaacagagtaagaccctgtttctacaaaataaaagaagtaattgaatacatatattcgtcatttagtgaaaagaattcacctttgaacgtttaccttctttctttggtctgttcagcagcatttgtttcaatacacgcaagtataattttagcccccatcgtcactcaacagctagtttgggccaggccgcattacagacctgtagagtcctaggcctgcagcagtgtgtaataaaacaggaagaatgcctgcatcccagaggacacaaacagtcgacagatagagtctggtagtgtgtgtgtgttgactattggtgtggaacaaattactacggagctcagtggcttaaaacagtgaacatttcgtagttcacagctcctgtgagcacaggagcagcagagcaggatagtcccggctcaatctggcaaggctggagccacagaaagacccaactggggcaggaggcctcggggccatcagccaccacttggaactggccaccggggctgctctagggtccttgcattgtgatgcaagcagcccgtactctaggagagggcgaggagaaagtcccacagcctttccagtcctggtcttggaagccacagccttcacttcctctctattctgttcatttgagtgaggtgctgagtcctgcccacactcagcgtttggggtgagaatcaccctccacctcttaaagggacgagtgttaaaagtgtttgtggacatatttttaaacgatccctgtacgtcagatggtaataagcatggaagtgggactcagggcggccctgagttgtggagtgagcagggaaataagaattttaagaagggaggccagggagtcagtatagtgagggtgacgtctgagcaggggcgtgaaggaggaaggagaaggagcacatggagcgtgttcagtgtattgttatggagtgccaacaagatttgctgagggattggatccagggtgagaaggaaagagaggaagtcaaagatgactccaagcctttgggcttgaacagccggaaggatggagtctgttttttgagatgaggaagacactggcttagaggagactaggaattgagccagggccatgttcaggttgatgggactgtcagctgtccaggggaggtggcaggttggctgttgaatatcacagtctggaacccaagagacatctagaactagagatgaaaattggggcattttgcgcatatggatggtattaagaaacatgagacaagatgacaccacctcatgggtgcctggatggagacaaggtctaagaatggagctctggggtgctccaaggccatcggtggggagactgggaaggaatgagacagaggcatgaccagcgaggggtagggtcctgggaccaactgggtagagtgctcagggaagagaggagagcagcggagcccaccctgctgatgggccaggtcaggtgggagacgggacaaagggacagctggtggccttagtaacggggagcacgttggaactgccatagaatagtcccgctggcagggaagtaagcgctgaaagctggcctgcagcaaggtctagagaagtggggagaggaagacagaatggaggtggctcaccaggatcttttactctggttgggagcaaaacagtggaggcgtgggtgaaaggagacccgcccgggcagggactggggaagggccttggtttctgccgtggtgttttaaggtgagatgggggagaagatgtccttatgctaatgggacgagctagtggaacttgcttatccagagagggagctgtgatggccggagatccgggtgtgagccagggcttgaggctgctgcccagcaggtggggctgacctcagagaggaggaaggccgagtgcaggccttggttttgtctccatgaaatgggaaggtcgccagttgggagtgagaatgggagaggaggtgttgggggcttgaagagtgaggtggcatgaaagaatcacccctggggggattgcgtaggtcccggcacacacacttttccctctgcattctgatgacatacataatgcctcagtcagacacggccactcagcactgagctgcccatgccgcatacactgccattcttgaggttgcccttgattctctcagttgctgctgccctccttttcctcgttcgagcttggtagtgccagcctcaggtagggcgggatgtggacacgcaggttggttagagggaacttgaaaacacttatgaaatttacggcaactgagtgaactcagttgatatggatttaaatcttttttatttctgtaactttccagtagcatgtataattggagtaaggtgtatttttttattgatccatattaagtatacatattttggggatatatgtgataatttgatacattcgtataattaaatcagggtaattgggatatccatcaccttacgtatttctcttttctttacactaggaacattcaagttattcccttgcagctattttgaaatgtaccacctttttttttttttttttttttttttttttgaggcagagtctctttctgtcgcccaggctggagtgcagtggcgcgacctggactcattgcaacttccacctcccaggttcaagcaattctcctgcctcagcctctccagtagctgggattacaggcatgagccactacacctggctaatttttgtatttttagtagagatggggtttcgccatgctggccaggttggtctcgaactcctgacctcaggtgatcacccacctcagcctcccaaaatgctgggtttacaggtatgtgccaccacgcctggcgtgtatcacctagtaatgttaactttagtcaccctgctgatctgtccaacaccaggtcttatttcttctaaggctatatttgcagccattgatcagcctctcttcatcctccccctgcccacccttcccggctgattttcggtttttgtttctgactctgccatctcccagttgtgtatttcgccatggaaatgccacatgtccatgttagggcgttaatatcacaagggtccaaggaatggattgttgccctccccaatttcttaaatactgcctgcttcatgtcagtaccttataagcatggcccatctttctaaaatcttttgggctttcattaaagaattcctaaatttccgatagatttatgtttctacaactaatgttgttactttatctactgagatttggttttcttgtttataggtacaaactcttaatgagcaggattgggaacgtgcccagcaagctagtgtcttggcaaatgtagcacaagcattcgagagtgatgctgacgtgtctgatggtgaagatgacagggacactctcctcagctcagttgacctgctatcgcccagcgggcaggccgacgcgcacacactagccatgatgcttcaggagcagctggacgccatcaacaaagagatcaggtgtgtgcaaccgtgcatgacactcaccacacgcatgggtgtctctgaggaatctcatcttgcctggaaaagtctggatgaaatactattaacattttctaagtattacataataatagaacttacttaacttctgttttaagaattttaaggtctgaaattgcccttgaatataaaattcaggtaaccagggcactctccccacagttacggcactagtacctttctgtaggacattgtgggacctgagaggtccttcccctgagaagctcgccacatagctggagggtgctgaaggggctcagcccagctcccactgccgtcctgaaagctgcacctggaaggccacatgagctgagcacatctggaggaggctgatcggcctaccttcctgatccagagtgcagatgaaaggtgtgcacggtggtgggctgggaagagatgacggactgaagcctgccttgaatgaatagcagtggctgcctccacaggccagtgccactcaccagagagaccagcactcagaacacatgcacaccggagcgggcgcatatggtgggaagcgggaggaagggttgcttatcaaccctcttctggtcttagtgtccctccttgaccctgaaccctgaaaggagcgcgttgctatcacctgccgcatgtgcagcctcctgcacagaagaggctgtgtgtagtgacgtttaaaagtgtagaacgtttaccttcttactttggtctgttcagcagcgtttgtttcaatacacgcaagtataattttagcccccatcgtcactcaacagctagtttgggccaggccccattacagacctgtagagtcctaggcctgcagcagtgtgtaataaaacaggaagaatgcctgcatcccagaggacacaaacagtcgacagatagagtctggtagtgtgtgtgtgttgactgttggtgtagaacaaattactacggagctcagtggcttaaaacagtgaacatttcgtagttcacagctcctgtgagcacaggagcagcagagcaggacagtcccggctcaatctggcaaggctggagccacagaaagacccaactggggcaggaggcctcggggccatcagccaccacttggaactggccaccggggctgctctagggtccttgcattgtgatgcaagcagcccgtactctaggagagggcgaggagaaagtcccacagcctttccagtcctggtcttggaagccacagccttcacttcctctctattctgttcatttgagtgaggtgctgagtcctgcccacactcagcgtttggggtgagaatcaccctccacctcttaaagggacgagtgttaaaagtgtttgtggacatatttttaaacgatccctgtacgtcagatggtaataagcatggaagtgggactcagggcggccctgagttgtggagtgagcagggaaataagaattttaagaagggaggccagggagtcagtatagtgagggtgacgtctgagcaggggcgtgaaggaggaaggagaaggagcacatggagcatgttcagtgtattgttatggagtgccaacaagatttgctgagggattggatccagggtgagaaggaaagacaggagtcagagatgactccaagcctttgggctgaacagctggaaggatggagtctgtttgttgagatgaggaagacactggtttagaggagactaggaattgagccagggctgtgttcagaccagccttggcaacataggaagacctcatctctacaaaaaaaattaaaaaaaatgagccaggtatggtagtgcatacctgtcacaccagctacttgggaggctgaggcgggaggatcccttgagcccaggagttcgaggctgcagcgagctgtgatcatgctgctgccctccagccaggatgacagagtgagatctgtctcaaaaaatataaaaattaggccaggcactgtgatgagtgtgcgtacatcagagcctcacatgttcaggtcccgtcacacagtggcctggtacagaacactggagctcttcaggagtgcacggctccactccagtgttcctttccctgtgtgaagttaacatggacagtgagtgctcagattgcaggtttgaatctttcttgtctcgtcagtattttaaagggtttttctttagcaactttagcagttataatgcagaacttacaaaacgggccaactgtagaatggaatccaagaattgcttttatatttatgaagagaccggtaaaccctgcccacgctggcttggcctagggacacagcagtgtgaccagggggtgcctgggatctaccctcgggccctggcctgacgtgctgcttggctagcctgaatccaagggaggagcaggtgtgtgtgtggagtcctgcagcaggtctgggtggggtgctgccacgacttgcttgtgaagtttacgtgggtggaggtgccagtcctggtcagagagaacaggaggtaaagaagagaaggttgagagaaacatcaacaagagctgtgttactccagctttttttttttattaaaaagaaaaaaatagggctgtacattctgaagtaagaagttggtgtgctgcctgtgtttttgactttataactcccatttcatgtgccaccttgaaaactggcgaagagacctctgcagcatctgttgccaggcatgggggccctttgaaggaggaggtgcaaaataattagtgtgatgaagcgttcagaaagatcgtctttcctcatcattatgggagctgggaaaggattatataccttttgtttttatttcttatgatgtatagctagataaaagtgtttcctctttatgcagaaagttgacctgatgtaagtgttctgtccactgacttgtggattttcttctattaataatgatcaaaaagcacttttcttagaaatgtaagtagaactttaattggaagggttattgcaaggtttctatattttaatactagaataattattattggcacagtcaaatattaaaactgctgtctagtgatccatgacactctaggagagaggagcgttaatcttgaattccaaattaatgtagcatggttggcatgaatccagaaatttacatgaggatggtagagaatcccatcagataacgctctggttcaaatttaaactaaaaaaaagaaccaactcaatattttcgtttagtctaaacagttaagtgttgggaaactcctaattgttttgtgcatctgttctttatattagagttcctgatttccagttgaagaaatctgtagatttcttcagctttgctctaagaataggggagataagggtcataaaattttaaaatatcacttagtaaggaaattattaattgcaaccataggaaaaattgccatccagccttctccagaatttttgtgtaaataagtaaaatcaaatgttaatgatatccagaaccaacaagactcaatggaaggtttactttttgttgttgtaagatgtagtatattaaaaaagattgaggccagtgtggtggctcatgccagtaatcccaccactttgggaggaggctgaggttggaggatgtcttgaagtcaggagtttgagaccagccttggcaacataggaagaccttgtctctacaaaaaaaattttaaaagatgagccaggcgtggtagtgcatacctgttgccccagctacttgggaggctgaggcaggaggatcccttgagtccaggagttcgaggctgcagtgagctgtgatcatgctactgcactccagccgggatgacagtgtgagaccctgtctgaaaaaataaaaaatttggccaggagctgtggctcgcgcctgtaatcccactactttgggaggccgaggcaggcggatcacgaggttggaagttcgagaccagcctggccaacatggtgaaaccccgtgtctactaaaaatacgaaaaattagccgggcatggtggcacgcgcctgtaatcccagctactcaggaggctgaggcaggagaattatttgaacccaggaggcagaggttgcagtgagccgagatcgcgccactgcactctagcctgggcaacagagcgagactccatctcaaaagaaaaataaataaataaaaatttaaaaagagtagaacatttttgctgaagtgttcattgtttgagcagcttattactggagtttactcatagtaatacagagtataagcatggtttttctcatgcaaacacattaatctgtttgccgaaacaggaggactgactgcttttgttttattttaggttgattcaggaagaaaaagaaaatacagagcagcgggcagaggagattgaaagtcgagttggcagtggaagtctagacaatcttggtcgttttagatcaatgagctccattcccccctaccctgcttcctcgcttgctagctcctcccctccgggcagtgggcgctccaccccacgaaggatccctcacagcccagctcgggaagtggacagactgggcgtcatgacccttgtacgtatccgccctttccctgctgtggctgccctcagcatacctgtatgaaatcttggacactacaaatctacccacaagaaaatcaagtacattcgttattctaagaggttcaagattataaaaactagttactatttaatcattcagttatgacaaactaattttaatatctggggccgggcgtggtggctcatgcctgtgattcctcacactttgggagactgaggtgggcagatcacttgagcccaggaggtcaaaaccagctgggcaacatggcaaaaccccatctttacaaaaagtagctgggcctggtggtgtgtgcctgtagtcccagctactctggaggttgaggtgggaggatcacctgagcccaggaggtcgaggctacagtgagccatgattgcatcactgccctccagcctgggcagcagagtgagaccctgtctcaaaacaaatcccaaaaaatataaaaaaaaattttaatatttggatgaccaggctagcattacaccatttgtttgtgtgacattaggcatgacatctgtgcaaagtacagcagccagaaggggaaatattttctgttttataggaaaaaccacttagcaaaagtaaataaaggcagacatcagagcatatgggaaaatgcacaaagtgggtcagtgcatttctttcctttcggagtgcccaaccagcttcctgggcatctactaccaaaaaaaaaaaaaaaaaaaaaaggaaaaacatgaaatgggttctgcatttgaagccgtgaacaagccagctgcttcgtggctccctaaggaagcagatgggcttcttcccttcacagcttagggtcacctctcacctggaaatgcaatgaccttctggtgtttggtgtttgcaaagtgtgcagatctgaggaatgtttaaaactttcctttgggcctggcatggtatttcacgcctgtaatcccagcactttggagaggccaaggtgggaggattgcttgagctaggagttaagagaccaacctgggcaacatagtgagaaccccatctttatctaaaaaaaaaccaaactatcttgtatatttagaatttgtcagtgtgttgtcaatgaaatatttcatatttacaccatttgctttttaactgtgcttctatcatattttttcccgttaccatctattttcgtttttagttgtgttgttagccagcatgcaattaaatcgacggtgaatcattttagtggcatatgaggtggtaactagtctattttgcagtgttttgaaatactgtttttataatttacatcatctactaattaggtaacattttaaactctttgactgttttatttgtgggcttgtgcttatttctgtccagagaattcgtaaaaacagttgtgtatgtatatatattttttctggttttgtaattctgtatgctggctgacagtctctatgcttccgtcattggttttgatttcctgtcatccttttgttttattattttagccatctccagattcatttttaatccagacctcaggtccccatcagtcagtagtttactcatccacctcccctcccagttccaccccatgctatagcgattcttcacagcatgctcaggtaaccacgcaactgtgtgtgttcgatcatgtttgtgagtttgtgctgtgatgactttattaatgggttgtttttttctcagttaaaagtatctttttctcaatggtaatttaaattagtgtattactatatagtaagtatggatacaggcaagacataggtgtttaagagtttttttactcaaattatgtaggatttgtgtaattcataagtgtttcctacataactaatctaagcgtagaattaatggaagctgtttacacaaacagtatgctttctggttctgatgattgtgttcaagactgtaaatctcatcagcctgttgagtctcatcaactatctctaataggttatttttaaattaaaatatcttatgtgaatcataggatggatgtaaagattctacctaatattatgctagcttttgttcttatatattttcacaggataccttgctttaagcaataaatttatttttgaaaagtggtaaatcaaattctaggtaaggattttacattaatgtccaacaggtgattaactaaaagtaggtttgttcagttttataattggtattgcagtaacttcctcatccgttggaatatttttaattataacatggattttattaaagaaaactaagttatagagaggtttggcttagaatagatgattgttagggccttttattatatagaatgccatattttaataaaacacatgaaatagaattttatctaagtaataatttatagtgtttctctaataaacctttaataacttatatttaaattttttggtgaaaaaatggttctgtatccagttacattttctctaaatcctgtctcctgtcatttctattttaatatatttgcttatactgatccttgaatttttaacttcaaagtgtatatagtaaatctggtttctcttcatttctttgcatgcatctatcagcctagtgatttaaggaaacatcgtagaaaggtaaattgtttagtaatttaacatatctttgtatctccataatgtattgaagagtacctatcatattttccataaatgtagcattatgtagttgtataataatgaatggttggcgttttaatggaagtgtttaaagtgacctagcaccttactgacaattgttctattggaaattggtcattagcggttttcacagaacactgggacaaatgtaacagcttgccattctctcaccttttcagccttctgatcattacatgcttattcatagatgtagtagttttaaaaataagaaattactagtgcaaagctatagaatgtagatgcggggggacccattttcataataatcacagctagcattgggctcttgctgtatgccaggcactgtgctgagtgctttcccagtctggtataggctgagtgtccctgatctgagatgcttagggccagaggtatttcagatttcagatttgtttaaattttgaaatatttgcattacacttactagttgagcctctcaaatctgaaaatccaaaatctgaaatgctccattgaccatttccttcaagcatcatgtcagcactcaaattatagattttggagcattttgaatatcagatttttgggtttgggatgctcaacccgtatttaatccccatacacatccctgtgaggttactgttgttatccccattttacagatgtggaaactaaagcttagagaggccccacagtgcacagtgcagatttgagttcagatttgtctgatttcaaaacctgacagttgaccacttcaccatctagccttacttgtctcagatactctgacctccctggcagcgttcctacagaaggaggtccaaggccacttctctttagagataactgtggattgggccttcctgttctcgaaggaagtagagtacattaggaggagatctgctcagcagctgttctttatgttgaccccaaatctctccctcataactttcatgctctggtctgtattctgtgcccctgtttgaaacccgcctgatggtgcagtgactggacagctcttcagagatacctaaaggcagctgtcctctgacaaaagtgtgggacctggtcagcagctgtctgtgagctgctctgttgagtgatttagtgaaactgcttgggttcagatcctagttcagtcactgatgagtttgtgacctggagtctgtttgtaccttggtttactctcctgagaagtgaagataatgatagaacagtgccacttaaagtggcattggacctgtggctgtctgtggtgagataaggagcttacaccagcagcaacaagacacagagcacggccttcagttcagctgacttctgttggattgttttttctttattttttgatagcaagattttctcagtgaaggaagtagcatgttgattgacacttaggcatgataacctggccctgttggtcactggtaacttcagcgtgctacttggtgtctttgaggagcctaggcctcgggtggttgtgaggttaaaccaggggtgcgtgcagagtgccaggccttgtctacaagagactgtcgccttccttctctgtgtcagtggtgttggtgtagaccaagaggacttccctgctttctagtaggcctgagctgggatggaggcagaagtctggcacgtgacagcactacagcgtgtggaggggtgcggagggcggcgtgtggaggggtgggagggcggcgtgtggaggtgtcggagggcggcgtgtggaggggtgggagggcggcgtgtggaggtgtcggagggcggcgtgtggagggatgaggagggcagcgctggccaggctcacggggctttccccagaccctgttaccagcttatagctggctgcgtgtcagctttctctgtactctgtttttggttttgtttttttaaaacagatgattgttttaacctgaattttgaaacttaagcttcatattgataatttctagctttgaaagcctttcattgttttgtgattgcaactggaaattaggaaaggatgcaggattcatttgcattttaactgttagttgagattctgtcctaaatgagcacagctccattttgcattgaatgcacttggtcctccctgagccacagtggggctacagtaggattgatacactttacacaatcccatttaagaagcagaaattcaaactgagcccagtggtacgtgcttgtagtcccacctactttggaggccgaggcaagaatcagttgagcacaggagtttgaggctgcaccgcaccatgatcacacctgcaaatagccactgcagtccagcctggaatcacagcaagaacctggctcttaaaatttatttttaataaaataaagttcactgttcaagtcttgctgtttatagtaatgcttgctgaacatgttttatgaaatccagtcccactcaaaaccagaaaacacaaatgtataagcaggatctgcctagaccctgcaggggtgagtctgttcactgttgttaaccaccatcctgctccctcagcacatgggcgtattcacgttccactgcaaaaacaaaaaaaccctgggagtctgacaaagatcatcttgtaatgataagcctagaagtattttcttttaagctatattgaacaaaaatgtttaaactgcataaaagtgcttgaatttatagtgtccatccaaacattgagaaatatgagccatacacatgtgtatgggggtcatgggctgttccttgtttatttttaccccgttcagacaaaaaaggtatttgacaattttgcccaagtggtttcttgccctctctagtgtttcttttgaaggacatcaggagataaacgtatttgttactggctcttcattagtgcaagttaatgctgtctcacatttgtaacgatgtggtttatcggtgttgttcagatctctgctgccccttcagagactgtcctcatgatgtgcctaggattccggggagggcagaaccttgggctgcatggaggaggctgaggatgaggggcatacctgtgtcctgttgggccccagcgcacgctcgtggggaggcagaccaggagtctgacaactctgtggtgctgtgctgcgtggcccttcagaatggtgccagactgaaacaagactttctgtgctggcagaaagcacagcaaatcgattttcaaagaagtttatggctataatttaaggcctgagtttttcacagtctgctgttaactaactttgcacttctctcacccctcagttgccaccttccagagaagaggtacgagatgacaagacaaccataaagtgtgaaacctccccgccttcctccccgagagcccttcggttagaccggctgcacaaaggggcgctgcacaccgtcagccacgaggacatcagggacataaggaagtaaggagcctgcagcagccccatgcagagcgcacctgtcttttcgtttctggtgttgagaaatcgacaaatctttccttgagtaaaacagtgattttgtagaattacccattaattcagttgagtgtatttacatgttacacttagaatgcttaccactgctctgggctatagtgaaatccagcagaagatgcatatctgtttgggcaagcttagtttggaaagaaaggagttaaatgatatcagcaagttttggaaaaacttcatgtcttcagagtctataaattgactactttctattcttgatggagagtttggcaagcagatgacaggcttggtattggaaccgctctctaggacaacccgtgcctttcttgtgccttttgtaaactgtggagagttccaagttgtacttaccaatttagtgagtgtcccctctcaggaaaccaatcagctgttttgttactagtatgctatctatgctatctttttttttctttttgagatagagtcttgctctgttgcccaggctggagtacagtggcatgatcttggctcaccacaaccttcacctcccgagtagctggaactacaggcgcacaccaccatgcccggctaatttttgtatttttagtaaagatggggtttcaccatgctggccaggctggtctcgaactcctgagctcataatctgcccgcctcggcctcccaaaatgctgggattacaggcgtgagccaccgcgcccggcccctctttttttaaattccattggatttcggttctgtgccaggcaatatgcaggggaggcatgtatattaatttttgcagtaacccctcaggcagttaacattgccacggttctcagctgagtagagtaatgctcagggcggttgtgggagctgctggaggggaagcaggcagaccattgggctttggcacctgatggcgcggagtcagggcctcccctgaaggggaggggagctccatgtcagagagagtctcagctgcccagaatgggtctccgcgctggcctcgccgggagtctgcctttatcatgcatgatgcacttggtgaggaagatgtgtgtgaaagagactggaagtgcttgtagggaagtttgcgactgttaatatgtgaagtatcctacaagggcacatagtaaagatccgttttctttcctcgaagctccacaggctcccaggatggtcccgtgagcaaccccagcagtagcaacagtagccaggactcgctccacaaagccccaaagaagaaaggcattaagtcctccattggccgcttgtttggcaagaaagaaaagggccgacctggacaaactggcaaagaagcattaggacaaggttggttggttttccgcacccttctcagcacccaggggtcggggaggaaggcactgccttcggtgccatcagttcccacgcggtgctccaggagccgtgtgctctccagggagcagcagctgtgaaggcatgggagctagagagcagcagtttatgctcacttgccactcaggtacaacacatttcctgtcttgagcatttccgtcttgggcatttggttgtctagtcagaaacttagccttaagaaatgatttaaatctgaacctgcaaatattcatctgcctatttatgaaaacatagagctttgtcatgctgatttttacttctgggctgttctgcttcctcacagctggtgtttccgagacggataactcatctcaggatgccttgggacttagcaaattggggggacaggctgaaaaaaatcgtaaacttcaaaaaaagtaagctttgtgttatttcttcatctcattgaatggttttcagttgtgcctaagctctaactagtgtttgttaattataatagctagctatgtatatatacattatattctgaaagctttacctacagccttaattaagccgtactttctggaagatttagtgtttgtgaaatttcgaagaaactcacactggtatccctatcatcttggaaagctgtccaaccaggagatagggtgggtgagagttggactcagctgcctgagcactggagtcggccctggcgcctgcccaggttcactttgtgacgttgaggaagtggcctagcatctctgtgcttcagttttctcatctgtaaagtggggatcctagtagtacataccttgtatggcttttatgagaattaaatgggataatgtgcatacagttctttaaacagtaccagcaagtcataaacaagttgtagctgtggccagtgcagcgactgttgcttgccagcattcaggatttgctcttcatactgctggtctgtccgaaacagtcgccatgctgcatttttctctcttccgtagatcgggtagttttatctcaaatagactcctgattttatagcccgtttattcagctttaattctaaactaagtctgcttctgacaataagctctaatatttgggatggctttgaacaaaggagaacaggcattgtgatgccccagggtgaggacgtggaggaatcgggtttctgtccctgggccttctgggatgcggggtgagttgcgtgttggctgactgtagatgaagtagataggctgagacagtgcccaagtgagccaacaaatgtagaacaaaactaaacccagttctgcaataaaataggcagtttgtgtagtccatgggataagggctgagcttgagcaatgtggaagatggtaatgccaggcttacagggtgaaacttgacgggctgtatgatgactgtgactgtgggaaaaatcatctggccacttttaagtgccctgagaaaccagtgctcatctggaaattggggcccaaagatgcaccagagcctatggggaccctctcccctagaggcccctttgcctttagcccctagagttgccagctgatttttttctgttgtgaaatctatctcattttagttttcttttcaaagcctttataaatgctgtattgattatattttaggtaaaatgcttttatgttaacagtaccataggaatactcagttttttggttccctgtaaatggaaatttatagaaaccacgtaacagcaaaatctgatttgaacattgctatgcttgaactgtgtaagaatttttttttttttttttgagatggagtctcgctctgtcacccacgctggagtgcagtggcgcaatctcagttcactgcaagctctgcctcctgggttcacaccattctcctgcctcagcttcccgagtagctgggacttacaggcgcccgccaccacacccggctaattttttgtatttttagtagagacggggtttcaccatgttagccaggatggtcttgatctcctgacctcgtgatctgcccgcctcagcctcccaaagtgctgggattacaggcgtgagccaccgcgcccagccaagaatgttttcaaataacttgggtaattgccatttggccctgtgaaacttaatgttagagctaaactttctgcctcctggaaacatgctaggaaaatttcattccttagattttgctaatgttactgtttttatgatagtaagtatgaggaagtgaaataaaacttctctgtcctttatgttgtgcttgggatccatgtggaagttctgaaatgtaccagctccttagtggggaaaatttccaagtacaaagattatttgtctgactatagagggcagtttcgtttctttcacttaaactgagataaaactgattttagaaaaagtgctttatttattgattgattgattgagacgaagtccctcactctgtcgcccaggctggagtgcaatggcacgatcctggctcactgcaacttccgcctcctgggttcaagtgattctcctgcctcagcctcccagcagctggaattacaagcgtgtgccaccgtgcccagctaatttttttgaatttttagtagagatggggtttcaccatgttggccaggcttgtttcgaattcctgacctgaagcgatctgtccacctcggcctcccaaagtgttgggattacaggcgtgagccaccacgcctggcctaaaatgtctacatataaatgtgaaaaaaagtttgcgttttccagaaaaagtattgtgtgaatacagtttaatatttatgccatcttaagaacgaacgtatatttctcagaattattttcttcttattaacccctgatttaactcaaaggtgtgttttaactgcaaaatttacacagccagatgctttcacttacagagaacttaaggaatctggtgagtttggtggcaagctgatttcaagttttgtaagacacagcatggtgggcgcgtttggtgcctgggatacgtagtaatgaacccgcaagtcggggctggctgtcctagagccattcgtcagctttgatagcgcatagtgcctccacagcacttttagaattccccagcgttcttgaaacaccatctcttgaagtaaccttgcttttaaagtgttcccttttcatgttctcctttttgtcttcgtagtgctttctcagggtaagcagactcgggagatttgctgggctgagtgtgggcagtcaccagccacaggctctatgctgagcttcctgagaggatctttttatttttttatttttgcccttgcaaaataaaagaaggcccttgcaccgttgcccaggctgaagtgcagtggcgcgttcaccactcactgcagccttgacctttatttttagtagagacagaggtctcaatatgttgaccaggctggtcttgaactcctggcctcaagtgatcttcctgcctctgcctctcaaagtgttgggattacaggcatgagccaccacacctggcccaaggatctttttagttttgcatgagaaatgctgactccatccatttctcatcagggcgaccctacatctttcctcaggactctgccagtgtgccatggcaatggagcatgggaggggctatgcctgggtcacagaactgtacttgtggtggtggtgtttttttatgggttttggagagggtcctgctctgtcacccaggtagcaactgtacctgtgaaagcaagtcttgttcactctatgcagggtgccagaggattgaaaagcttcagtcttaagaaagtaaggcaatatatttagtttcgatagttgagagaaagtacttcctcccatcccttacatactgtttgatcagcaaaaactcacacaagcttctcattatgaaagacaactttaccgttatgctatgtcttaattataaaatgcacaacattattcacaaattatatgacctttttgcattatagcattctcagtagcaagtgaaagagccaagtctgagatcaagcaataaaggaggaatgtagttgttcatgtaaatgaacggcccagagggccagggtggagtggcttcagccatctccaggctctggactctgcatcccctcgacacaggggccttcttcccgtgattggaacagtccccccagagaaaacaggggctctggtgttcccacctggagtgccagcccaggggcatggtcccatgtttggtcttacagatcatggactggtctgataggggaggggagccaggacacacaccgaggcctgggcccgccacccagatggggtctcctctgccttctccctaacttcctgtgactcttagacacatccgtctacctccactgtcttaacactgtttccactgttgcctctggacccagaagcatctccattctggaaaagactttttataaaagctagtgatcattgccaggaagagggtactggtgaagtctaggacagtgtacaccagtctccaagtaatagaagtaaagaattattttttgacaattatttttatttacagtgagtatctattacatgttaaaaaacgaagtctctggcagagtgccaaggctgagcgtaagttgggaaccctcctgacttggcagcagtcagatcctccctgcgccttggccaggccccggacgctcaaagccttagcagttaaccagattgttagcgttcagagctttttctgggattgatgtggcaggaattacctgtactacttcctagacccactggtgtgtgaaggaagctctactggctgtctttgagtggcatttgtcccaagggaacggaaggcagggtttcagccaccacctggtgattggcgccatgcagcgcgcccttcctcccaacctcttcatttcgcatcttgcgataccacttcatactcctaagaaaagtctgctgctattgaaatgtattgaagagccaatatcaaatttttaaaaataagagattctatggtatatgtcttatgaaattattatagaaaaaatggactaaaagcagcctagggatgtttgaatgacttggggatatctgtacttgcaaaccaaatgtatgtgtcctctccattacaatgacaccttctctctgagactttttattttttaaaacaattagcctctttgaaagccttgtaggtaaacacttgagaaataagatgagattcaccaagcttatagtgttatttctgaaatacctatgttagagagcattatgttaacctctgattctgtaaggagacggggattctgtagagagtcagagggagtcattcagtattttctcactcaggcattctttgtagtatgcacagaactagtgtgaaatggatggtgttgatactgttaaagctgtagaagatgaaaggaaaatgatgagcatgtatagtcgtctctcagagtctatgggggattggttccaggacccctcctgaataccaaaatccatggaagcttaagtctcctgtatgaaatggcatggtatttccgtatcacgtaggcataatctcctgtagacttcaaatcatctctaggttctttacaatacccaacggaatgtaagtgctatgtaaatagctgttgtactgtattggttttttttgttttttcccactgaatatttttgatctgcagttggttgactgtgtggatgtggaagccgcagatacagagggcagactgtatactgctagacttttgcaaatgctcagaacacttcgttaactaattttatatatgtgtataatagtggttccttgattttgtttttgctggttgtaatttttttttttttttagagatagggtctcactctgttgcctaggctggagtgcagtggcacagtcatggcctactgtagccttgacctcctgggctcaggcaatccttccacctcagcctcccaagtagctgagactacaggcatgcgtcaccatacctggctgatttttttttttttttttaatttttgtagagatgcatctcattatattgcccaggctgctcttgaactactggcctcaagcagtcttcctgcctcagtctcccgagtagctgggactacaggggtgtgtcactacaccttgcaaatttttaaaattttttgtagagttggggtctcgctgtgttgtctaggctggtcttgaactcctgggctcaagtggtcctcctgccttggcctcccagagagctgggattacaggtgtgagctaccatgcctggctgattctttaattttcaatatcttctcctttataggcatgaattgctggaggaagcccggagacaaggtttaccttttgcccaatgggacgggccaacggttgtggtctggctagaggtacatccttcatttaacatgcagttgcgtgggttacagtatgtgaacttactgttctactttgtaggctgtacctcactgtgctgccttccttccgctttccgcctccagctctgggttgggatgccagcctggtatgtggctgcctgccgagcaaacgtgaaaagcggggccatcatgtcggccctgtccgacacagagatccagcgtgagattggcatcagcaaccccctgcacaggctgaagctgaggctggccatccaggagatcatgtcgctgaccagcccgtctgccccgcccacatctagaacggtacgttcagagacaacccctgcattctttggaaacagggaatgcctctctgaaggtatcactgccctgtttacattgcttctccagttccttaacagcatatgaagtatagttctaattcaaaattttagcatcacatacattagaacttttaattttggggaattggatggtcaaaagaaactttattaaatgcttttatgaaagattggctagaatggcttcatagtataaaaatatgagcttttttaaacatagaaaagcaattacaaatttaaatatggaaatatgaaatacgaaaataccaaaaaaaattggtagagatgggggtctcgctgtgttgcccaggctggtcttgcactcctgggctccaagcagtcctcccacctcagccttccaatgtgctgggattacaggcgtgagccaccacacccagctgagtttatcaaaattgaatcagtctaagggcctcttgaaggaaaaagttaatattttaaggacacattttataattaaatgttttgaatttcatttttcagttttcatgattcaaactgagtaattaacatttgtactatatataaagatatttgctaagccaattatagtgtatttttaaatgttactggaatataatatacatatagagaaatgcacgtatgagtgaacagttaaatgaatctgtaaagtcagcatcccctgtgtggtccacacctacattgaaaaatgggatctgaccagggctctggaggcctcctgctccttctgaggcactgccccttccctagggatgagtgcctggctcctggtgccatagactgctctgttagtttcgttcttcatgtgtataaacaagatcatgtagtattcactctcttgtgtctggcttctttcacttaatgttatgtctgtgaattcatccgtatcattccatgtgtaagtagcatcttgagtaaaatttttctgtctagttcagaggactggctcttccaggcttcttagaagcacccatttatttatttatttaagttttttattttttggaggcaaggtcttactctgtcacccaggctggagtgcagtggctcaatcgtagctcactgcagcctcaacctcttgggctcaagcgatcctcccacctcagcctcccaagtagttgggactacaggtgtgcaccaccacacccagctaatttctaaaaacttcttagagacagggtcttgctgtgttgaccaggctggtctggaactcctggcctccagtagtcctcctgcctcagagtccctgagtgctgaaattacaggtgtgagccaccatgcccagccagaagcatccattgaaatataggtgacatactagtaagagatacttgttatcccaccgtcaaaactgatccctaaggaatttttgtattttttgtagagatgggtctcactttgttgcctaggctggtctggaactcctgggctcaagcgatcctcctgcctcagactcccaagtagctgtgactacaggcatgcacagccatgcttggaaaaggtccctaaagaattctaatcctcccttccccatcattccagtttgcggacattttttaaaataaaaactaaaggggaaaataaagatgagatcactggttgccttgtaaccagtgttttactgtatttgatttatttggcctgtaggtgttttccatttggggagctaaagaccctgggagctcaggatttcaagcagttcacaaatctgcaaatgttcatccaacatgagctgtacttatacagtttctctccatgtgggaagtccctcaaagtccttaagaagggttatcctacttgaaaaagaagaactatgttaataaaaacaagaatggttattgggagataagggcaggccaactccagatttataaagttgagactttttacactggctggattcccagtctctgcttttagtctcctcaggagaaaacaaattcttgttgcaatgaagagcctcacacatttctccaaggagcacgtcagcgctggatttagggctcccagttaccttacaaaaaaagttttgaggggttttacttgttttatttatttttttcttcttaatgaacaaattatggtgatgaacaataagctttgtcctcccctgttgctccaagagctcctttcccacagcctgcctcaggagcagtgtctgagctcttccctggttgtttcacatgacagtggccttgctgaaaatgaaggtgctgagtggtttctcccatgtttatccactgtcttcagtaatgatggagaacacctcacataaggcagactcttcacaccatgtcaaaatgcaaggaaaaaatctccctcaagtagacacacaggccactgtctgtctcgtgtctggttctgatggctgcacagagccatcgacactgcttagcagtgaccccctctgccctgtggcctgccttcagcctttcaggccgtcacggaacatctgcgagaaagccctccaatagccaaagcaagagtttcatgctgggttctttgttgttaatctgctttaaatatattgaatcaatagttacttgagaattactcaaagtttccagaagtacacaacgtgttttcttctcttgatatttcacatacctcgggtaagcatggcatctaaagctctcgtcatcgtgtgctcttctcctgatggtgttgacgacccagtgttaacagggaatggttattctgtacgggcatctgaactgaaaagtgagaagagcgaactttgcctcctcggccccttctctgtgcctgtggcttatgcgtgtgcccctctcctctttgtcactgcttcccttgccctggatgtggttggtgcactggggtcaccttagaccacaggaaatgtctggttaacacacgaagagatggaaacgctcgcagccacgccgcaaacggttagtcacgccccacagcctgcactcctcccagcgcgttttccacttaagaccgtctgggttctttgcctttttgttgaaaacaaaatgttgttttccattcagtcgttccagataagtatttcctttagttattagttgaaatgtgtaagtagaatttgtattttattttagattttttccaggaacttcaagttggtagactctgtcttttagaatagctttaatctagctctccttttggagagatctcagttgagcctccatgtgactgactgtgtggccctttctccttccatgaatatgcttggcacggagagagtctgctccttgcatgagaagttgaaattgttggttttgcatgagttttgcatgatgctttgatagtctgaactttttcactcagtgaagctgcatcttccctgcagagttgcgttgcctgcattaccgagctcaccaatactaatagttatgttcttttgcattcctaaccacgtaaccccaggaagatgaggagggaagctgggctcaggttggagtctttctctaatatattcttcactacatgtacagcagcaaaaagcaattggagtatgaaaacttgtgtaatctactttttttgatgtttatagcatcttagtttattcggagtacaggattgttaatgatttgaaagcactggtcaagcaaaacatagcatcaaagagtacgtctcatggacaattttgaacatttctcatatggtgccatggcagttatttttaattaatatagattgctttgtttaacatatgatcttgtatacaaagtcttgtggcttaggcagcttctgagattatgtatgtaatttcctggtagggtaatgttattacaagatatactgatagggaaattgtgctctaataaatttccaaacacaaaaattggcataatgacttttcctctgtgcctttgtgttgattttttactaaatactatcctaatactatgtccacttaaagattttcttactaatggaatcctaaggaattaagcctcttcttgagtactgtatatttgaattttcagcttctcaattctttaactcaccaaaaactctatcccaactgttttgcattctgtatgttcagacagcttgccgaaatgtcgtgcgacgccactggccttctgtggtcagggtgtatgtctcagtggcacattgcagccatgaggcgtggacaggcagttctagaggctttcccgaatggactgtatttgagggcttcagaataatcattatatatctgaaaagaatcaaaaggattttaaatcataattttcctgattacgaggtgatggttgaagcagctgtttccttctcttggtactcctaaaatctagctcattagactgtccccccacctttttttatttttattttttatttgtattttttaacaaaatagagtagctataatgtgattctgtgggcttttttctctcttgatttaagcattctgtgcctctcctccagataaataacctcattgtttaacttgttagatatccctttataggaccaataatgaccataaatgaattatacagggtacatttcataattacttaaatttcagtatattttccaccaaggagcagaatttggttaatacttcagtatgaaattgcctgagtcagggacaggaagtgtaaattaaataagcttaaccttgctctttgcggtggaaatataaacaagactgagctgtggtgatgactccagaactagccgacatgcagtctagtggaagctcgtatcacttttccctccttcctgtcttccagatgggactgccacctgctgccaagggcagtacacagtggccagctcttaaaccagggagaactttgagctgcgccgagagactaggggaggaagacatcaaggcgtggtcaaaaccatttatacctcatttaacaaaattagtaagagtgctggctgcgtggagcatctatgagcaggacacccatggtccccccgtcatggagctcccattttatggagttcataagactgggttgtacttgtggctgtttcagtgctgggagtaaacactgtgcagtgggtgtctcttctagttcagatgttctctggactgacatcacctggtatgttttttttccagaaggctgctaaggcagcccaggagaagaggtgggtctccctgggatggagcctgatccttctgggagttcatgttataggccacttcaggagtctgagcagagcatataatgaggaaacagaaacaagtagggttctgcttccatgcagttttctatttagacaattcctttgtttaatttccccatttaagaatacataatcagcaagcaagagaataataccagatatccctgctacatgtatcaggcctaggccaggtgtagtggctcacacctgtaatcccagcactttgggaggctgaggcaggtggatcgctttcagcccaggagttcaagaccagcctgggcaacgtggggaaaccctgtctctacaaaaaatataaaaattagccaggtattgttggcttgagactgtagtcccagctgtttgggaggcttaggctggaaaatcgcttgagcccggaaagtggacgttacagtgagccgagatcatgccactacactccagcctgggtgacagagcgagaccctgtctctaaataaataaataaatatcaggcctgtaagggtaaggtttagaagagtgaatcaagcatggtgatgctgttagatagctgataattacccaaaaatgtttggcatatttctctctttttagagaaggtagtgaagcatttttttctagtagaatttaaacattctttgtttaaattagagaatttgagttattgcttaacttaaatttagaatttgagttattgcttctagtttggaccaaataacaaatgatactggaagccatagtttcaagaccaacatggtgttagttgagagtcactacaaagataccataaggtagctatgactggtgaccataacttagtcttcctcagctgcagacttcaggtacctcgggtaccttccttcgatatgtgtgtgtatagaatgtgttagttctttttcattgtacacattttgcatgcattctgttagatttatccctgaggattttgcaggttttgatgccactgtaaatgatactttttaaatttcaattttcagttcattgctagtatttagaaatatagttcatttttataaattggccttgcatcctgcaactttgcttaaacccacttattctgatagctattttgtagattccttttctacactgataattttgtcatcttcaaataaagacaattttatttcttttgcaatttatgtgctttttatttctctttcttgacctcttacagtgactgggatttccagtacagtgtagaataaagtggtgagagtggacatccttcgtttgttccttatcttaggagaaacacagtcagtcttttttttttttttttttaaagagacagggtctcaccatgttgcccaggctgttctcaaactcctgacctcaagtgacccgcccacctctgcctcccatagtgctgggattataggcatgagccaccatgcccagctgagcagtcttttacattaagtatgatgttcactgtagggtttttgtaaatgccttttatccagttgaggcacttttcttacatttccggaatgcttggagttccataaatgatgacaaatcttgtcaaatgctttttctgcatcttttgagatgatatggttttttttcaatctcttcatatggtgagtttcattgatttttcttttcaaatgttgaatcaacttatgtttctagaataataagccatacttgtcatgatatcttattgttttaatatgttgttgacttggcaatattttgttacatatttttggatctgcctgagggctactgatctatagttttgttacatctttggttttgctctcaggatgatgctggcctcatagaatgagataaggtgtttcaaacttttttggaacacttcgtgtagaatcgtggttatttatttatttatttatgttgataaatgtttggtagaattcaccagtgaagctatcttgggtagagattttcttttttgtatgttagaagatttatgattacaacttcaggttctaatagagatacgtgttacctgtttctgagaagctttggtagtttatcttttaagaaatttgtccatttcatctaagttgcttaaaattgttcacagtattcccttattctttcaatgtctattgaatctatattgatgtcccctctttgttgtcattttgtgtttgtttttgagacaaggtctcgctgtgttgcccaggctggtctcagacacctggactcaagccatcctcctgcttcagcctcctgagtagctgaagttaccgacatggccaccatgcctggctgccctcttttactctttttttttttttctttttttgagatggggcctcgctctgctgcccaggctggagtgcagtggctcaatctcagctcactgcacctccgcctcctggttcaagcaattttcatgcctcagcctcccaagtagctgggattacaggcatgtgccaccatgcctagctaatttttgtacttttagtagagaagaggtttcgccatgttggccaggctggtcccctctttcattcttgatagtggtgatttatatcttctgttttgtcttatctagtccggctagggtttgttaatttgattgatatttatgaagtactagattttcatttcactggtttatttgctgttatttttctgttttctgtttcattgatttctgcttttttaccttgttccttctgcttgccgtggatttcattcgttcttctagtttaagttttaattttttttaattttgagacagagtctcgctctatctcccaggctggagtgcagtggcatgatcttggctcactgcaacctccacctcctgggttcaagccattctcctgcctcagcctcctgagtagctggaactgcaggcatgtaccaccatgcccagctaatttttgtatctttagtagagatgggatttcactatgttggcgaggctggtgtcggaactcctgaccaaaggtgatccgcctgcctcggcctcccagagtgctaggattacaggtgtgagccactgcaccaggctagtttaagtttttaaaagcagactcttggatcactgattttcgaggtctttctcattgataatcctttgtcgtgatttttgctctcacggtattgttttaactgtttcccacaatttttgaattttttaaaaattttctttaaattaaaaatattttctggtggggcagcagtggctcacgcctgtaatcctagcggtttgggaggccaaggtgggtggtggatcacttgaggtcaggagtttgagaccagtctgcccaacatgttgaaaccccgtctgtactaaaaatacaaaaattagtcaggtgtggtggcttgtgcttgtaatcccagatactcgggaggctgaggccggagaatgacttgaaccctggaggcgaggttgcagtgatccgaggtcgcgctactgcactccagcctgggcgacagagggagcaatttccccttgtaatttcttgctgtgaattatttagaagtatgctaatttttaaatatttagtagggggttctagatagctttttattattgatttctaatttctgttgaagtcaagagaatgtaccttgatttcagtctctttaagtatgttgagatttgtctgtctttgagaatatactatacagacattaaaagcatatatattctgttgttgggtggcatgttctatattctgttgttgggtagagtgttctatattctgttgtttggtggattgttctatattctgttgttgagtggcgtgttctatgttctcttgttgggtggcgtgttctgtattctcttgttgggtggcgtgttctatcttctgttgttgggtggcgtgttctacattccattgttgggtggagtgttctatattctgttgttgggtggtgtgttctatgaaacgtcaggtcaagtttgttaagggttgttagtttaggttttctatattcttaatttttttctttttttgcttctttcatcagttgctatgagaaagaagtgttgaattttttcaactataattgtgaatttgcctgtttccccatttagtcctgttggttgttgctttatctcttctctaaaactatattttaactgacttttactgattttgaaatggattttttctttaggaaaacaaagtgttaaaatgtaaaccaaccagagataattttagtgagcagtgttgaattgagccttcaaacttgttcatgagtcgtgatcaatctttgtcacattattatactaaaaactatctcagagaggaaatttatagccagttacagtttttttgtagtttgatttaaaagttaaatttatcacaacgaatcatatatttttcatgttactattcctgttgtataaaaattttactaacaaatttaaaaggtgagaagagatcaaattattttgcaattataaaattatcattagtttagcctttgagaatataggtaatagattaaaaattcattttaaaaatgatataaactacttttgagacttcctctgtaactgaccttttccatttatgaaaagcagacactcgcctatggggacatgaaccacgagtggatcggcaacgagtggctccccagcctgggcctcccccagtaccgcagctacttcatggagtgccttgtagacgccaggatgctggaccacttgaccaagaaagaccttcgagggcagctgaaaatggtcgacagttttcacaggtaacttaatggagatagttcttaataattggctaagatttttcactgttaccatctctaaatcatctctcttttcttccaaatagaaacagtttccagtgtggaattatgtgcctgagaaggttaaattatgaccggaaagaactggaaagaaaaagagaagaaagtcagagtgaaataaaaggttagtacatgacatttaattgattcggtttactcctacttgctggtgtgtttggagcctcagtgacttcctatttttcaaaaaatcaagaaaggctaaatttaagtggagaaaactaactagtctagtgtcattgcagaggagggctggatgaagttgagtgcttttgagattctcttccacagctagagaactgttccctgtgttctcacacatcagtctggaggttaaatgtctccggctagtcgtttcctgtgagttgagagttttcctttggtcatgccctgtgtactccttcactccgaaatgctgttccacactgttagataacaacagagcaaagctcacttgatgattcaagtgtgagaaatatgactgggggcttatccaaggggttcaggagaacaggagagcaccgtgcagttctgctcccggaggggaaggagaggcagcgtctgcatttcagctggtccttgaagaaggaggaggagctgcttagggtaaggaaaaggcatttcagttggaaaacacaggccagggaggcgttagaggatgtgagacattcatccagaagacgtggagttggttctcttctccgttggggagtccctcactcgtactcaaatttatttgtttgtttgtttatttatttatttaatttattttgagacagggtcttgctctgtagcccaggctaggctggagtgcagtggtgtgatcacagctcactacagccttgaactcctgggctcaagtgctcttcctgccttagcctccctagtagctcctgggagtacaggtgtgctccaccatgcctggaattttttttttttttgtagagacagggtctcgctatgttgcctaggctgatctcgaacttttgggctcaggggatcctcccaccttggccttccaaagtgttgggattacaggtgtgagccaccacacccagtcagaatttgcttttaaaattagacagtaaacattaagctcagagtaatgactcccagaattcctggaatgcaaggaagtcaccaataacaataatgataagaagaggccagtcttactaacagtgagtaggtgccaggtggtgttctaagtactcaggggttgctttctttcatctttaccttagccctgtcagtctaagtgctgttttcatccccactttatactaagaaagaaactaaggataaaaatatggttgggagatggcccagttgaagggaagtctacttgtgattgagttaatgtgaatcaggagaaaagtcgtaagtcgacatttatacagtgtgtgtatatgtatggacttttatccagaaaagggcattggcaatgaaatatgtccatctgttttgttttctgtatctattttacatctttttccaatagacaaagatctttggaagtgtctttggaagtgattggtgatcatctgcatatatttttagagtggctatttttagatctaatagagcaaattgaataatttgttaatttgcataagatattgtggctgggcatggtagctcatgcctgtaatctcagcactttgggaggccaaggcaggagtattgtctgagcccatgagttcaagaccagcctggggaacatagtgagaccctgtcagtacaaaaaaattagctgagcttcgtgacacacgcctgtagttccagctcctcaggaggctgaggtgggaaaaatcacttgagcccaggaggttgaggctgcagtgagctatgatggtaccaggctgtatccagcctgggtgacagagcaggacattgtcaagaaaaagagaggaaaaaaaaagattttctgcaaagtctctaatgtgctggatgatattgttaagtttctctcattttaaaatgagacaaagacttcgagattagaaatgagaggtttctgttgaattgagcaaagtgttcatattattatggagccagctccatccgtgatgaagtatttcagaagactctccagtctgtgtgtgaagcatgtttatacatgttaggtattcaagttcttgcagtcctctggcttctgatccctggatcctcatcatcttcttttctctagaaataataacttcattcctctcgtgctcactggaaggatgagttctaatgggagagtctccctgagagtggagcagggccaggacaccattgtctcagtgcagcaaatggttgtctatttagcagtgtctcccagcacttttctcaggagccgaaggattaggaaccatggtaggaatctttctcctgcattacagggtacatgtgataaagatggctttctgaagccacttttataattgtctttattcttttgcagacgtgcttgtttggagcaatgatcgagtgattcgctggatcctgtcaattggccttaaagaatatgcaaacaatcttatagagagtggtgttcacggagcacttctggccttagatgaaaccttcgacttcagtgcactggcactgctgttacagatcccgacgcagaacacacaggtgacgccaaacctgtctgtgtctgcactcattgttcagttggcaccctgattatagacagctagttattcgaatagaaagaaactttaaaaaaaaaaaaaaaaaaaaacttcagacaactagtttttggtttttttttttttttttggtctattggctttcccttttctgttggaagcatgagagtcctgcaataaaccagataaggacgatctttcattccagcccatgtgcctgatcagaagagtgacatatatttagttcttacatggaaagagaagtgtttttaggtgtgccacatgaagattttattaattttgtttttatgggtaattgccttatgccattctttttgactcatgggctcatttgaaaaacagggaacttttattcctctacagaacattgaatatgccaggcaaggtggctcatgcccacaatcccaacactttgggaggcccaggtaggcagattgcttgagtccaggagttcgagaccagcctggccatcatggtgaagctctgtctctacaaaaaaatacaaaaaaattagccaggtgtggtggcacatgcctgtagtcccagctacttgggaggccaaggcagggagattgcttggcccgggaagtggaggttgtgatgagctctgattgcgccactgcactccagcctgagtgacagagtgagacccccatcccaaagaaaaaggaaaaaaaaaaaaaaaaattgaatatctttggccaatacccctgaccaacccacacaacacacccttgttaatatgactccaaggatcatggatccctttctgcaaaagcccatccattgactccacattagatgccctgatttaaaatattattatggttcaatgtagtcatagcagtgagggagttgtttttttgtttgttttgagatggagtttcgctcttgttgcccaggctggagtgcaatggtgcaatcttggctcactgcaccctctgtctcccaggttcaagtgattttcctgcctcatcctcccaagtagctgagattaccggcacacgccaccgtgcccggcttatttttgtatttttagtatagatgggatttcaccatgttggccaagctggtctcaaactcctgatctcaagtgatctgcctgtctcggcctcccaaagtactgggattacaggcatgagccaccacacccaggccctaatttttgtatttttagtagagacggggttttaccatgttgcccaggctggtcttgaactcctgacctcaggtggtctgtccgccttggcgtccgaaagtgttggaattacaggcgtgagccaccagacccagccagcagtgagggagtttaagtcttggtttaaaaaacaattacgatgctaacacccttcaaattagatttgatgaaagttttatttgtttttctttggttatttcaggctcgtgctgtcttggaaagagaatttaacaaccttttggtcatggggactgatagaaggtttgatgaagtaagtttttggcctaatgttctttaaatgtctgaaatgtgtgtaaatgtttaaatgtgtgtgaaatgtaagctgttattattattatacttgggacatcatgtagctaggcagtctctctggatgttagaagtcaggctttgctcttatacatttattcacaaatgagcctttaaaaactaatacctgggccgggcacggcggctcgcacctgtaatcccagcactttcggaggctgaggcgggcggatcaccagaggtcaggagtttaagaccagcccggccaacatggtgaaaccccatctctactaaaaaacacaaaaattagccgggcgttgtggtaggtgcctataatcgcagctacttgggaggctgaggctggagaatcgcttaaacctgggaggtggaggttgcagtgagctgagatcgcaccactgccctccagcctgggcgacagagagaaactccatctcaaaaagaaaccccctccccgcaaaaaaaaaacccacaaaagtaataccttcaagaaggtagttttgtttttatttttgctatttaatttttgacatccctcaaaaatggttttcacatcataaaacattggttgcagcttaggaacagagtctgtaagttgggttttggggaccagtagttatcctaccccagtccagagtgtacccccatactcctgtgcatgggtggggtggcatgtttcagaagtatattaaaaacacaaaatgttaatttccccttaaaaccatgactcatttgttccacacgattaggagtctcttaattggaccttaagaaaagttgagtttgacagagagaatagaagaccacctctaaagatgaagcacttgttgctatatcctggcataagataaaattgtttctagttaaaaattgtttgtagagctgcgtgtggtaggggcacacctgtagttccagctacttaggaggctgcggtgggaggatggcttgagcccaggagtttgaggttacagtgagctataatcacaccactgcattccagctcgggcaacagatctagactctgtctgtaaaaacataaataaaaatgaaaaataaactatttttaagataaataaaaacgtattacgttgcaagaaagtgattcctgcaaggtgtaagaagtagaacatgatgctgtggagaaggagcacatcctcatggcccagcaccgacctcatttcgccagctgaggcccagccggaccatcaccatgccccgtttcacgctgaagttccaggttgggcaatatattgtgtggtcatcaagaagggattaaatacatgtggacaagaatacattctcgagatcagcagtcattttaaaggacatgtaactttacatctctgacctttattttttaaatgaatcttgttttttgttccttaatttaccaggatgatgataaaagctttaggagagcaccttcatggagaaaaaagtttagaccaaaggacattcgtggcttagctgctgggtcagcagagactctccctgcaaacttccgggtgacttcttctatgtcttccccctctatgcagccaaagaagatgcagatggacggtatgtgatgggtcacactaacctgtcacttgttgggagcatgagcagctttctgtctggaacattaataatgatctaaaacggcctatttaatatgttacaaggcacttgagtatggttgcatgtccaaatataaatgtttttaaattaactctaacatttgtttataaaagtttaaccataataatagaatttttaaaacacgcttgtctggttgaatcttagcatatttttccaactaataaagctcagtattcgtctgtgttctcagagagagactgaggcatacttgtaaatttgtgtctgtgacaggccgtgctagaaagctctttcaggaaatagtagtgtagtagtagcttccaaaccacataatttactgctctccacaccagagaaaataactgagtacatttttaagaacacacagtttccagcttgtgtgagctctgcctatgctttctgccctccctgctgctgctgttccgtgcagtcacatgtctacccattagagggcagggaagggaggaaggtgaacctccaagaagtccccagtggagcgaggcagctattgactataccagccagagagagagcatcactgccatgatttcacatgcagtttgggattttcccttagacggccactttgatttgaggttaacagttgaccatggcttccttacaggtctctcaactctgcccttgtactcatctaatgaaaggcagtgcacaggttgaagagccaggctgcctaggtttgactccagctctgccactaggaggtgcatgaccctgaacaagtcatttaactaccctggcctcggtctccccatctgtaaaatggtcgtcatggtagtgtcttcctcatagagtagttgcgatgattgaatgcctcattcattaagctggtgaagttctgagcccgtgtcagtcggggctgtttggcagcccctgtgctacacacaggtcactcatgctcacttctgaggccagtgagcagactggaggaaaggaagtggcattaaaaactgtgctaatccttgaggccaggagtttgagaccagcctgaccaacatggcgaaaccccgtctctacaaaaaaaaaatacaaaaattagccaggtgtggtggcacatgcttgtaatcccagctacttgggaggctaaggcacaagaatcatttggacctgggaggcagagggtgcagtgagccgagattgtgccgctgcactctagccttgatgacagactgagactctgtctcaaaaaaaaaaaaaatttttttttaagtgctaattaggggccaagcatggtggcttataccagtaatcctagcactttgataggctgagaggcaggagaatcacttgagctgaagtttgagactagcctgggcaacacagtgagaccccatctctaaaaaaaaaaaaataataattgaaaactgtgcgaatggggtttttgccaattttttttgtcatcagtccctcccgtacgtaggttcataaattttgttctctatcacctgtataaaaataaaaagaaaagtacatttaaataaaaccttagttaagctggacgctttgggtgagaatagcttactttgtggcatttttagtaaaaagctgtattatttatttattgtttgccagaatttgataatatactcaagggggaaaacccagtatatcttttaactaggaactttttacaaattagcatttttcttccaagagtcatgcatataattcttagaaagcagaactgtgacttggccttcagctcaagctctgtcacctggagtccacgagtgctttcttgttttacttgtggcttcaatttcagttttccttctgataaatcacatctcccttgttaaatgttaacaggaatattaagaatgagagtttggatggatgaaaagtaaacctaggccgggcgcggtggctcacgcctgtaatcccagcactttgggaggctgaggtgggtggatcagctgaggtcaggagttcgagaccagcctggccaacgtggtgagaccagcctggccaacgtggtgaaaccctgtctctagtaaaaatacaaaaaaatcggccgggctcggtggctcacgcctgtaatcccagcactttgggaggccaaggcgggaggatcacgaggtcaggagatcaagaccatcctggctaacacggtgaaactccatctctactaaaaatacaaaaaaaaaaaaaaaattagctgggcacggtggcaggcgcctgtagtaccagctactcgggaggctggggcaggagaatggcatgaacccaggaggcggagcttgtggtgagccaagatcacaccactgcactccagcctgggcgacagagcaggactgtctcaaaagaaaaaatttgccaggcatggtgacacatgccaataatcccagctacttaggaggctgaggcaggagaatggcttgaacctgggaggcagaggttgcagtgagccgaaatcatgccactgtactccagcctgggcgacaagagcaaaactctgtctcaaaaaaaaaaaaaaagtaaacctaaaaggtatagggaatttattataaagaagactttttacccttacattaaataactcaggcacaagcctgctaaagggattattattattattgagacagggtctcactctgttgcccaggttggagtgcagtggctcagtctcggcttactgcaacctcagcctcccaagtagctgggaccacaggtgtggtcccatgccttgctaattttttgaattttttgtagagatgggctctcaccatgttgcccaggctggtcttaactcttgggctcaagcaatcctcctgccttgacctcccaaattgctggaattacagacgcgagccaccgtgcccagcaaagttgactattttaatggctttttaattaagggaatgtggggtaaactccagcaggtctcccaggttcttaagagtcagagggtttgtgaagatcatctgtcctcaccaacagtcccaactgtcttaatgtctttgctggaaccatgcaggatgttgattaagtgttcctggtatacctgtgggaaaacaaaaaacataaccgggagcagccagtacctgcttccgatttgcaaaaacttaaaatcccagttgttaatggaaatcgggcttacttatggccacactgtgtttcttgaacaagaaccaaaatctgtggtctctatgattaatatttctggtaggaactgagactgggcttcagtttttagatcagctttcaccccactccctggccaacgccccacccctgcagccagatctctgcacctgctctgctcctccccaggagaaaagggcaccggcttcccagacacccagctagtgctgggtagcaaggttctctccctcctcttagactggtcttgtacccgacgtcgttggcctctgcgctcagtggggctgggcagcatcagcagtgccgcttggtgtttccttcataccagtgttagagatggagcacttagggcagggagaaagccccattggtctatgaatgcagagtttagtaagagataaagggatcactctaagtaggggtcatttatgcagatgtacattttgaaattgttactgtaccatttggtgcttggtatttcggagtagtgttccagagtctcccggggctctttgggagctggggagagccaccactgggtgacacttggatctctctggctccatcccgcccactcaggcagctcccctcaggtccctccgtaggcactgctgtaggtgtgaagatgtgtgtctacttgtgccctcatgtgatgttctaagactaactgcacgctgtgtttgcacgcttcctctcgtggctgttgaaacaggcaatgtatcaggaacacagaggttggattctgctacagtcaggacttactcctgctaaagtctcctgttggtgagtagagagcaccacaacccctagagatggctcagaggcacagcaggagtcatcggagctgcagtgccagactaggggtgtggaccatgaaagccagtgcagtttttggggaatttaaaatatatatagacacaagctctccgtacccattaagatcattttgttgttacaattgatcataaagaggttagtgtgtcctctttttttaaggaaaaaaatgtattttcaccttttccttaaacctgaaaatgctgactcattttaattgtctgtggatgtcatgggggtggagtggggaggagagcagagcatggcagagagcgtcaggggagagtctctcctcctgacgtcgttatgcacattgctgtgattcctaagcttgctttgttttaaatacacattcttgaatgaaacaagcccaaagttttgtggttaattatatattatactaagtgtgacactaatagcctttcagtttggagagactggttcttaaaactgcggactctggctggtgagtggcccgccctctccttgctgttctaagcaattttaaggtctccgttggaatatttgactggtttgttcatcttttatttgtaattggtaacatggagacgtaagccaaaatgaagtcagccaaggagctgtctcattgatgtgcatagcccttgatgttctagccagtgattctcagagcagctacggcacagaaagtgaggggtcctggaggggaggggtcagtgtcggggggacgtttgggccccagcatcagaagttcccgttcgtcagtatggcccggcctgtactgagtggttttttgtttgtgtttattttccagtttacccacactacttctacagatgattatgcagcatttgaatccaacaaagactacattttggaatccagtggaatctttaatcttgttaatacttgttatatggaccctaagatattttattacagagtttttaattagtgaaaaattcatgaataccatagagaaaatattttagaatttaatgtttcttatatttatgtaaacttatgactcttcatttatatagttacttactttttcatgtatatccaggctataaatatcctttcaaatcatgttcttatacctaattttagtctttcaaatgaatgtactgtaatgcttgtatgtataaatcctatgaatagagggcttttgtaaattatgcatttattgtaattatcattaattttttaatgataaaccatgacaaaggattttacgtttataaaattatgacagaagccatgtgcattatcctttacggacgcagcctagctctacagcaatcatcctgaaataagcatacctaatttcaagcaattgttgtattttcatgactgaccttaactgtactttttctagcaagagatgctttattctgcagcatgaacagatttaaaatggctggtgttaaatatcagctcctaataagatgtggactgaaaacactatcacaacactatgagaagcccctagcactggttaacgctttcctagcctagtctctggatttggggagcttgtcttcagtggctgagactgtgagctgggagcagttctctcagctggagagactcgggatggggtaacctggggaccagtctagcccctgcaccctcttccctgcctctgctccttgggagcgggtggagagacacccatgtggctccccttagggccagcaccaagcaccacgctctcatcctgcaagtcggcgcacacagtggatgaaggcaggagacccagaaagcagtgcagtgcagctctaataaaggccttatttttcttatgtaaatcatctttttacatttgtttgtaaacatgtttaaagaacgaacctagtgggacatttttagactttgatgctctagccattttggattgtgtaagttgcagatgtggcttttactttttaaatggcatattaacaagccagcaaagtgtgtcagaccatggcgtggtatttattgtgcagcagatccagagacagaggcagcctgtcttttcagttggtttctgcttttaatttacttgtacaattcattgttactgttctgtttttctattaatcttttgtcaacttcctgattatgtaacaaagtatgtacagtctacttttgaactatttttatcacagtattatttattgctttctttcaataaagtactgaagcattttccactgcc

SEQ ID NO: 37393 - DNA, 3920 bp, Homo sapiens
actggccgctgagagaagaatcgggtggagcagagagcagctgctgcagggcagacagccggacccccaaatctgcacgtaccagcagtcagccgccccacgcagggaccggcttacccctcgctccccgccctcactcactttctcccgccctcggcccggcctcccagctctctacttcgcgagtctacaaactcaactcccggtttccgtgcctctccaccgctcgagttctctactctccatatccgaggggcccctcccagcatctacccccctcccaacctcgggggacctagccaagctaggggggactggatccgacgggtggagcagccaggtgagccccgaaaggtggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgaggtaagccagcccacttgcctgtttctggtcccagccctggatggacgctcttgggctgggggagaggacaggaccacccccctcctctcctttcttgcatcctccctctcttgggccctcggcacagttctccgcccctcccagcccctcagtccctcttgtcgcttgttggactgtgctggccttgccggcccactgtaatgtgaggctcccgctgccgctacagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtggtgagtagcgggctggtggatggggaggcaagggccagagaaccaaatggccctagaccacaaggaggtaggaggcagggcctgagctgccctcaagagacctgctcccgggctccccctagcgcagagggctcctaaggctgccctgcctgcctttccctccatcacggacaacagtcactggcctggctcggaggccttgattccacttagccaagaggcacacaccaggacctggaggacaaccccgggaaggcctgggggtctgttccacaggtgtgcaggcattctgtgtgctaaaggatggggatgagggtggtagctgggacccaagaggaggctggctaatgaggacttacgaaggctctagggccccaaaagggtgtttgggagtgctagcagtgggagctcaggaaggctggctgggatcaggaacgatggctcaagggggaaacttctaggagcatgactaggctgccagatccataggaggctgggagggggacagacctagaccagctcccagggtggctcagctctcagagaccaggctggtatggaagcctagctggccctcctgggagtggctcaggcctgagtgtagctgaggggatggaaaagcccaccctgcttggaatctgcaggcttggcagactctgcccccttgtggccacaggaagccatgacccaggccccatgttttcagagggcccattagctcccaccatcccccggctctgtggtcatcgagggacacctatagtcagaggagagaactcaggtggctctgggtccagaacacagttcacagaggggcgaggtgaagcagctctgggtgggcagcacaggctgaggcttggggctcactatcattagataactcttagagtgaccagctagcaccctaattcttctccagccctcagcttcctctccggcagcctggggtgaaggcctctgtaggaccaagtgtgtccagctataactccttccagccacttctggcatctccagacctacaacgcagagcaggaaggttctgggaaaagaggacccctctctcccctccagctgtgtgaccttgtaaccttagacaacctctgagcttctctgagccttgtttgctcatctggaaaaaggggattaaaccatttacctcatggagttgtgaaagaatagctgcaaagcacctaacacatagtaaggttcccagtgcagctacttctgctgggttgagtctagctgtgtaggccccttgttcctcacctggagaaactggggtggcaggccggtcccccacaaaagataactcatctcttaatttgcaagctgcctcaacaggagggtgggggaacagctcaacaatggctgatgggcgctcctggtgttgatagagatggaacttggacttggaggcctctccacgctgtcccactgcccctggcctaggcagcaggtgagtggttctcccagtgactcctacctggtactgaggaaaggcggcttgactggtgagggagagcagggcttggcttgggcagcggttaggtgtgggagggaaaatggtcagggagggaccaggtgaatgggaggaggagcgggacttctctgaatggtcggtgcactcaggtgattcctcccctgggctcccagaggcagcaaacccattatactggaacctaggcccttcctgagtttcccctccacacagctaggagcccatgcccggcctgatctcagcccgaggacagcccctccttgaggtccttcctccccaagcccacctgggtgccctctttctccctgaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccgggtaggtgagagggcgagggggcggggcggggctggcccgggacaccgcgcgtgactgggtctcattccagggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctgccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttattt

SEQ ID NO: 37394 - DNA, 6214 bp, Homo sapiens
atgacgcgagaccccgcccccgcagcgcccgcttccaagatggcggcagcgatgcctgcccggctgttggggtggcggtgacgacaggcagcaaaagaccaggtatgtgcgctgggaatgcgtcgacacggaggcctgggataaaggtttgggcattcgagagagtgagaagttttgggtaacgcctggagacgagcctgagcagggacggggtcctaggtggaagtatggacgggggccgggcgggctcacgttgctagtaggtagggcaaaagcaagagactgggataggatgggcgtgctccgaaagagctgggttttaaccccctccacagcgcggaccacgcccctctaggtgagcccttccagccacccctgactgtctctgcccctgctctccctctccctttctcttcagcagtaaccctcctccccacccccgctagaagaggggaaaggtagaaaaggtagaggacgccacccccaccctactctccgccgagctccggggctgttcgcttacagcccccaggtggtcacggtccctgcacctgaggagttggcacccaggcacatgaagaatagaaggagcctgtttcctacttcgccctgggtactccttaggccactccacggtcctgtcatgactctgtcgccacttcaactggttcttggtctgggggaaaacaatgtttccattagctgtcctgtccccactccccaatctgtcctgttggggtgggggtacgggggtggttaagtatgaacctgacacttatcattccagggtagcacgggagataggcgagggacctaccatctcctgctcctcctcttcctttccaaccactttccttcacttcgcctgctgggaaaccagcttcaccctgatcctgatctctggcggtgcaggtagctagttatcctttaccacttctgttccagctggtcccagattcgctgctggagtgctggatggagcctttctctgccctctgtgacatttccaattttagataatgcctcacatctctgtccccccgggaccccctggagcccccatgatccctaagaagacagcttgaacctaggtgagtctatctcttcccttctaaaattggaagagggggttctctagagactttctgaaatgaacatgagatttgaatgatgtaaacatttttgggggtgaggactgacagtagatggtgggagtggtttggggggaggtagaggagagcgaaacttgggctgaagtgacaggtggtagggttactggtggttacattctgtttccttgcgtgactgtgcacctgtgtgctcccttctgtgactttgttttctgctttttcctctttacccctggcatcaccttcaaccctacctactgacctctctgctggcttgctctcttcctgcctacccccagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttaggtaagtgcaggaggaaggaggtggtgaaaggaaggacaaggtgcggagacagggaggcttggggatagggaggcatggagtggcagaagtggaacttagaagaggataggtaggctgaggctgcaggtaggctgaggttgagatagagggctgaggttgagatagagtagactctgaattgggagtttagattagactattgggtttccactttctactgcttgtccctttatgggctcttcctgccccaggctaggaattgttttccttgtagatgagccctggtttaattagttgcaagtctctccagccttcaactatagcttccaaccctgtaagacaggagaaagttaggcaaccctaaaataagaagagaaggctaggtaaggatcctgcaccttccagcctttgtagagctgtcccagtgataggtaatccaaggcatgcgagatttctgagtgagccctgagaactaagccccagaaccagactgccagtgtcagaggtattcccaaaccctagtttgattcttttctctttgcccctctgatccctctacttgccattccttcccaacagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggtacccccaatctccacctcattttgactgactttcttctaaggaagcctcaagcacatgccacttcactttcatctaaatgggtccctagaataattttaagaaggccagactgttagagtgtggagaagcacccggcactgctcttccaactttgttagtcccatacttttccttaatctgcttaggttattcccactgtcctacactctcctgtgattttttctttattgaatggcttgtgcagagttggaattggacacaatagggctaaaattctagttccgtcacttgttacatgtatgactctgagcaagatacttaaacatctaacatgaggaaagagcataagataactaatataccatctgttccacaccacaccattgttggttgccaattgtcaggattaaatgttagacagcagcatcttaagtatcaggtccataccaatacacaagcaagatttgtcaaatgactaagtggaaaaatgaaaaagatagtctttctttttcattctccttgccctccaccccactttgatttccctcttttcacttttattcttttttttctttttttttttttttgagatctcactctgtcccccaggctggagtgcagtggcacgatctcggctgactgcaagctccacctcccgggttttacgccattctcctgcctcagcctcctgagtagctgggactacaggcgtgtaccaccatgcccagctaattttttgtatttttagtagagatggggttttaccgtgttagccagggtggtctcaatctcctgaccttgtgatctgcctgccttggcctcccaaagtactgggattacaggcgtaagccaccgcgcccggccttcacttttattctttagcccccttttctccgtgccacctacagacatagtctggttcccctccattatcttccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacaagtttggatacaggtagagggcatggaagggtactgggaaacagggaagcctactatcctgtggaaggaggagagccaagcggattgtggttggggatgtgtccccagaagactcggggtatgcaaggatctttctctccctagcctcccgtacccccagtacttcggaggagtctcagcacttactcctgaccagtacctgaagatgaatggcttccccaatgaatactggggctggggtggtgaggatgacgacattgctaccaggtcagacttcctgccacttcctccctcctgaccccagtctggatccctgtcctctaagaccacctttgaccatagcccttcaacactaacctttagctccctggtcctgcactgagcccattcctttcccttagtctttttaggatacccaggtcaggcttgcatgctactgcccattgtgtcatccttcagtctcctggttagtttgttcttgggagaggacataagatcaataggaaatagtatcgtcggattccagaactggaaaggggcccagagacagcttagtcttgccttctgctggggttccagccaggccacttcctatggggttaggagagaggggctctgctccatgttcccagaatcgctttgtaaaaggcctgtgccattggcacagggccaactcatttttagcatgtgaaacattctgaccttcagcctcagctgacccaatttcatgtctgtggtatgaatatttgggcttggtatgcaggaccaattgcctccattccccctgtgtcctctgtgatgacatctctgtgaattctcatcctctgtatgtgtgtgaaatacccagtgaattgtaaatatacataagtattcttctagttccttcccaggccatctgcactccatgcttctgtgtgtcagaagtggagtttgtttcttttaaggtcctgattacctggttctacccttttcttttctttctttcgttttttttttttttctttttctctagagacaaggtcccattattttcccaggctggtcttgaactcctggcctcaagtgatccttctgccttggcatccaaaagtgctaggattgcaggtgtgagccactgcacctggcctacctttttcttaacatgggggatgtgggagagaagctggggtagctcagtcactattctaagattctcagcaactcccagtcttctcttattcttttgacagaatggcctctctctgcgtccttcctagactgcaagggcagctcctaggagccctttaggaagccaagggaataggttgccaactgtttaaaggccctagggtgactggcactgggccctgaggatttggatacatccagcttttatattctcttcagccatttccttctttctgtttgacttctgtcctgggctttttttttcttttgcctactaagtaatagttgtttttttgtgtgtacagaaacatttaatcccttccttgcttttctctactctggatcccccatgataccctcacttttcccatagggtgcgcctggctgggatgaagatctctcggccccccacatctgtaggacactataagatggtgaagcaccgaggagataagggcaatgaggaaaatccccacaggtaggaagaaggaaggactgcctgggaattgttactggatcctcagggttctgtacccctagccaggaaaatcctaaaggtccctagatttctggctgttcctttctgggtcttagtctccaacctctaaccctcagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgc

SEQ ID NO: 37395 - DNA, 183982 bp, Homo sapiens
ctctgaggggcttagaaattaacagggtaagttgaatatcatcttaaatactatctggatttttatagtgaattcctaatttgggcctatagtgtgtcaggcaacagttgggcactgggaagaaaattccttctcttattttccatgcctgtagtggttttcagttttcttttggatcagggcccctttgagagtctgcttaaagctgtgtagatcttttcacaaacattcacacatgttcagtcagagtttgaagatcttcgaaaacttcctaaagttcacagaccattgggcaaccctgtgctttgcagtatttcagacgtttttacaggctttgtttctcttttaaatattacaactctatgaattagtgactgatattgatattttacattgaagaaaccggtgttcaaaatggtatgtgacttttcctgtaatgcagctgtcaaatgtgaggctagaattgaagactttcccaaattttaataatactgttggctttttttaaggttctttcttcttaatatgtcaaattgctccttagtaagattgtgtcagcctttcctcattgtcagcaagtgagcatgcctgcttcaccacattatcccattgggtgttcccccaccctagtgtttgctaaattggcatgtagataattgcatttcattttaatttgtttctttgttgtatttagagttctctatccacttatccattggagtcttaccaatttttgtagcattatatatgaattttgaatatattaagaatatttgtcatgttttgtgcaaatacatttaccctttctgtttgcctttttactttgtgattttttttatgtatagaagttttgaaatgtttaagtattcagatctactttttcctctacattttttctctttttttagtgtagaaatttccaaatgcttcatacatctcaatgaatgcagacacattcacagattttttttttaacataatggcaatctaaaagattaaaaaaggaatgccacttaagttacagatttttgacttccttttgtcatatgtttattggctattggtctttcgtcttctttaaatatttttaagtatttaatctttcataatttttataaatgatatgtagaaatctagattattagttctgatagcatttagtaaatgtttcatttttaccaagatttcaaagtatagtttacccaatgtaagattttcatatacacgtatatttctttgtctctattaatgttcctttgatctaattatctgtcacagcataattatgatgtatttttaatgttattgtagctttaaagtcctcttttattagtttttcaaaactgttttattctttgatatttttccaaattaacttgagaatatattcatcaaattaaaaagtaaacatatgaaggatttttaattacgattgcattgagttaaagattcatttggggccaggggcggtggctcacgcctgtaatcccatcactttgggaggctgaggcgggtggatcacctgagctcaggagttggagaccagcctgggcaacatggaaaaaacccgcctctactaaaaatacaaaacattagctgggcgtggtggcgggctcctgtagtcccagctactcagggggctgaggcaggagaatggtgtgaacccaggaggcggagcttgcaaagagccgatatcgtgccactgcacttcagcctgggcgacagagcaagactcggtctcaaaaaaaaaaaaaaaaaaaaaaaaaaattagctgggccggtgatgtgcgcctgtggtcccagctacttgggtggctgaggtgtgagaattgcttgaggctttttgtttgtttgtttgtttgtttgtttaagacaaaaatcttcctctcttgctcaggctggagtgcagtggcatgatctgggctcactgcagcatctacccatcaggctcaagggattctcccagctcagccttcctagcagctgggaccgcaggtgcacagtggcacaatctcagctcactgcaacttctgcctccatagctcttccacctcagccccagagtatgcccagctaatttttgttttttgtttttgtttttgtatagacagggtttcaccacattgccaaggctgctctcaaactctaggctcaggcagtctgcctgccttggcctcccaaagtgttgggattacaggcgtgagccaccatgcctggccagcttgctatacttctttatgttttttctacacatatgcaacttggaattagatctctgtcctctcagagactttccttatgctgtctggctcccaggagcctcttttcctagtcctttcactagtggcaggggttattctttctcttagagtcttagtgtcaccctcccccactgttttgccccagagaaatacatagtgaagattcttcccatattcttcctactaccctggaccctttcccgtttctcaggacagaaggacaggtttctcttaggctttcagatgtgctgcctcagtagtgcagcttcataacagactggctttgaggcagagtcagcagagaagaaaaaaaaaaaaaagaaactgggaactcccctcgtactgctccaaaccacacactgtagcccacagatgcttgttttacacccactagaaagagggggtttctcctggagttttgccatgtgtgtctgctgcctaattctgggactctgcccaccctcaggtcaaagtggtagataaaggaaggattaaaaaaaaatagtaaactcaccttcatattggttattcttcatattttgactttcttctccaacgcacctgacattgttatttttcagttttcaagaggttgcttttagtattctgcccagagtttttagttgtaattagtgagggagataggctgtaaagggcttattccatcttgacattcactgaaagtcacattatttcattttaaaaataatttttgttttgattttcccaaaattcttcttgttccttgactattataagaacagatttttgttgttgttgttctgtgcatatactggcctcttgtatctctctcaagataccaataaagttaggaacattttatttatttttgttgccttactgtattttctttgggtcattgtgtctctacttctacactttattgcctctcttggtttttattaagtggccagtgattgttagctttcttctttacagtattttcaagtaaaggtcacaatcagtggttgtcttacttgaatgtatatacccattgcttggcggcccaggtaaaatgtagattcctggtcccatggacaaaaatctgattcagtaagtctagagtagggcacataaacaccttaaattcttttgatgctgatagttgaatgatagcccttgaaatcttggaaactggtgtaattctgtacagctcattattcccctttacaaaatactgtcttacccactgagcatcatggctgaccatgggactctgcagttggcttcccgcttgctgtggtgagtgagaggtgggctttccctcccctcccctcccctctttggagacaggatctcattctgtcacccagactggagcacagtagtgtgatcatggctcactgcatccttgaccacccaagatctaggaaactttccacctcagcctcccgagtagctgggactacaggtgctcgccaccatacccattaatttttctgtttttgtagaggtggagtctctgtatgttgcctaggctggtgtggaactcccagcctcaagcaatcctcccacttcagtctcattgggattacaaccgtgagctactgttcctggactcatttttcttatcatgcacttgcagagacaaggctaatagcggggccctgtccctcggtttctgctgttggaaaggaatttttctgcagggagagttctgattagttctgagttgccttcctttttcccccctctccgttgagattgtctttagcctgctattatctccatttcaaagttcacactataagccctcagacaaagactttagactcatgataaatgctgtggctgacacttacttgtctttagagttgtactggccatcattggtgttttttcactcagtcgttttgtggcctgcccacacccccaggcccttctgacctcaggtctttagtaggagaagaggtagatgaatgggctcactctgccatcttaattgaatgtccactgttaatcttaaggtgatattggtttctaatgtgcaaggtatttctgttgaattctcagatataataatcatcatgaaatctgtagtaggatcacaccttatgtatactcaggtgtgcaaagaaaatatagcttctttatttttcttatctcttccttttgatgaaccctggtcactggatggccggaagaagagtaccagacttactcccatctggtaaactgggtcttatccaataatttaaatagttgtgtttggatatttcagcttctggatactactcattcaaatattatctctttcctcagacgtgcccacaacagaatctagacttatgggttggcttgtgtgaccttgtagtggtggaagcacaccaagaccctcaatctatctactgtcttttctggtttcttactggtctctccctggaattgtggccaccgaggtactaccagaactatcgtttgaggtactaccagaactgtctgagacctgttctttttgctcctagaatgcattgtccatctttcctggtgtcacagatagcctgaagtctggcttggccccctgagcctggtattctctcttccaggcctcttgctatggaattactttatccctctggcaaagtcgtcaatctgtatcttaagttacctttcccgtactactttagagcacacagaagtttcctaaggtacatttcctaaatgtaccttcttccatggcacatgagaaataagggagatgccagagctgatctcacattccttctcaatcttcctgtgtttctgtgcatatattttggagtggctatctccagcttctgttgagtaggcatagggagaggaaagaggttggtggtgtgtgtgtgtgtgtgtgtgtgtgtgtgtgtgtatgaaagtgtgtgtgtgtttgtgcgcacacgcgccacgtgtcagggaagttcctggaaggcagtcattttgtacagtcttagtgggaagtgaagctgactgttctagctcccagatttccttactccatcagacattcttttcttctgccccatctgcctgaaagatgatgatgggagtattggtcacttgcatcttctgtctctgtctcaccttttaatcccacaatccttcatccagaatcaggagtttggggctataattcatattttttctaatttatatcatctttctaccctaattgacaggccccatgttctgactgtcatgagcagaagggatatctgctctgtactgtggaagaaactataatcctactcttttcaatcttggccagaaaatattagtgtctaacaaattccttctttgggaaaaccagactttcaaaaacttttatcttagtgtaaaattctttctttaattcataaggtaaatattaactatttctttctcttttcatttttaaactttaccaaatatatggatgctactcatagaataggagggaagtcagtggaaggaaaagcaaatgagaaaagcatgtcagtatcttttcataatcatgagagcatatctactctcagtactcccgtttctcaagacttccttggcttttcttacatttacttttttaattgtagtagagactcttacaagattatgcttctaaaacatattatagttatttgatttgtattaagcttataactttgatatttttaattatagttttctcaaataggaaaatagtgtgtctctattttttcaaatcttctcaaaatatttatcaataaggttttataaaattttgaaatgtggatttaataaatatgtctcacattctttttaggaaattttttttctttttagtttttaagagtaaaatccaggttgcaactcagtttcttctgccttgtagctcttccctgtgtggacccatggcactttgtttatttgtcttttgtagaattcctcatatttgtgtttaccaaactgtagtcagctcaatgcagggaatcagacattgcttgtctttatttgccctagtgcccaacaaattcctgctcatgataggcatggggaaatcagcaattcctgtgctcctttcctgatttattttctccataggacttaccatgttctaacatactgtattgtttatttgttttatttattgtctgtctcttctcactgaattataaatagcatgcaggcagagattttgaacgattttgcttactactgtattcctaacacctagtggagcacctgtcatgaaggtgaccagtatttgttgaatgattaataaattatcaaaatttagataattgtctaaattatatcatatgatctataaaatactgtaagtataaacttctggtataaaaaatagtaatgtaattggaaaggtacattaaaagttaggaagaccttaatatataatctactatcccattttgtgaaatgagcaagaaataatttaagcacaaagcccaagctaattgtggaaatggaccaagaatttagaactcttaagtaaaacataataataatgtcaactggacatgtggtaagcagtatatatggttgtagttaagaaaaagtacaggttctgcaatcagacatttctaggcaagtttcttgatctctctgtgccttagtttcctcccctgcaaactaggaaaaaattgtatctttcttatagattgttctaagacatctatgaaataaagtgtagtaactcttagcacactgcctggcgtttagtgaaggctcaaaaagttagcttccattattactatttggaatatctgccatctgtagcttgtggatgtgagagttctttagtttttggtggggcttttaaaaaatagttcctagaggccaggctatcttttagtctttccttcaatccctctaatatgccaagctccccagttctctgaattgatgcatctactcttctattggcctagagaacactcttctctgacatgctttgcttctttaacacctacttatctttcaggtctcttcctgtttctctcatttttaaatttttattttaagaatttataaatatatacaaaagtagagagtatgatgaatccatcaccatttctatgtatccattacccaccatcaatagctgtggggatttgatctctttaaaaattaaaaaaaagttttcttgaaatcccagtaaataccttttatttttttcttcctagcacattaacacaatttgcaatcatgtatttaatgtctcttttctccattagtttataagctccataaaagctgttttctttattgtgatatatccagtgtctcatacagtgcctgaaacatgataggttctcaaatgtgaaaggaatgaattatttaataactgaaaacgtcgctaaggggtttgaaaagacgagcatttgatgaaaactttttgaaaaagattggtaagaatgacttaggcagctttatattaaaacaataggtaccgttaggctcagattcatatacttattaagcaaccttgtgctcttaatttttttccaagtaagcttctgtgtaaagcaaactcagtgaccttgtgaagagaatattatttgagtttataagatattgtccatagtaaataactaaattagctttgggggatcactcttgggcaaggtaaaatgatcccttgaggtgctgggccttctgggctgagagatcaagcaccttgacggctcatagagaagttatcatcttgaagcctttgcccagccatcaacctactccttgttgctgtagcttcatttgatgaaatttaagaaaagtgtttttctcttcaaattgctatcccctcctaatttttttttttttttttttttttttgatactgttttgaaccagtaaccatggtttcttgtagaggctccttgggagctttaacaacatcagtcagtttcacagctggaagcagagtgatctagataaaagcataataaaaaagcttactgaggtttttttcccccctgttataacaattctttcattagggagcactttgcataaagtgaaatgttctctgttcccactgaagtagacattttaatttaaattaacagtaacgtagtacctggttcctttttagagtctagaaaagggaggtaatactaccattcacctgtccttcacctgaacctaccctgtctctgtccccttctttttttgtttctattttcttaccatctttctgggccaatggtgagtgatagtaatactgacatttggggttcaagatggatgaagtcgtgaagttgtagctttgaattaatgagggaaaaaggagttaagtagcaataaaaacttgatacagtggtaccaggagtttatttgtcaggatcaagaagagtcaaggactggctcttgtcagagggccagagtaagtaatttgttagaagtcagcgttggcagcaagcactgtcttgacggatggcactattgagaagggaaaggaaacctatatttattaaactctttacagaaaagcttgccaaccctcattgagatagactggatcagtctaccctggactggatatgagaatggttatattgtggggaaagcacactcttaggttatactgcttgtggatattagtatagctgtggcataaaaggagcatgatgggaatttggatgagagtagtgggtcttctgggcctttctttatcgaaagtctaaaccctgcctgtgaaaggaaactccaaatgtaaacattgaatgtttatttttttttacacatttctttgtccttcctacatgtatacctatgtccatactctcacatggttttactgtaattctgttattcgtatacttacataaatgtggacttacacaagcatcttaattggaaatgaccttggagatcacgtttcaacatccttattttacaggtggcaaaaactaagtcccttacaagttatatgcctggtgtcacaaaagcaggttagtggcaagttttgggagtaaaaccctggttctttgaattcctgttgtcatgcgtacaggtattcacatatgaagtctgccctataaggcctcacccaatatgtatctttagctttaagtagcctttcttagaaaactaaaacagctgaagagaagagaagcattaaatctagattcttctaacttaactctgctactgattatctttgcaatttttaggaagtgtaccattctttgataaacagaaataaggatccagaagataaattgtaattataaagattactgtggactaagatcctgatatttgcctcatttcctgatccctttcacagtgtaatttatgtgaaggaaatgtacaattattcaagtaaacacggtactagattcacagttcctaagtataataatttataagtggaacattgaagaatccagaattcatgttgctgtaaacatgttacataagcttatttaaatgttttccttttgtgaattcaataaatggtaatttgtaatttataataaaacatacgattatgatttcgtaacttactgaaaaaaactttaagaaaattaggtatcgttcaactgaaaagacaaaaggaatataccagaaattatagccattttattttcatgttcctgatgggggtattgctgtcacaattggggcagagtcattatttttctcaaattcaggattagaaaggtctttgcctttattgcatcagaacataatcacagaatttcttcttgctggttccctggggacactctttagacaagagaaatcctaggagaaatttgcacaaaagatgtacatcagaaactaaactacaagagcagatattagcatgcttttggtttgttgtgcagatggtttataaaatccttaacatcggtattacttgcctacttttaattaacctctaaagaattgtgtaattgttacttctttccttctctatgataagtcagccctctcagctttctttcctgatacagttgaaagcattttaaattttatccttagaaatacaaatactgaacaaattaatgttgtagttcaacatacttaaccaatcttaattataaattaggatgcgatgagactgtttcacttttaaaatacatgattgatgtttaatctttcagaaatttaagctattatagtaatgcaattgcttatacttagttttgtgtttttattaaagtcttatctttaaatggattgtctcattgaagaaaattaaatgggccaaatgtttgtttaacttcggaattctaaataaatatttttcttatagttttattagaattgggattgatatttatgtaataataatggtttgattgtcacttatctggaactctgatttaccagcacagttcaattatctaagttaatatttttcagttcttcaaaaccatgtttctatttgatagttgtaaaatcacctcttcatctttgctattgtctgaaatttaaaataaatataacttgttttttaaaaatcaaaagaatcaggtagaaagtactgctttgttttcaaacttactagcacacctccaatgtattgaattctatttaaatttacaaaacagaagtttcttacatgagtttcatggaccacttcagaggctcattaaatctgatattatatataaagttttatccatgtgggaattcttttgagatgaaatatctgtagctttattggagtcttgacgctttccatcacctaaacaaggttaaaaactatttttataggacctctgaagtatcatactttccaaaagaatatttaaggtaaaattgctttgctttctagaatcacttaattatagaatcttggtgtagccagcctccatttttacagatgccacaagttgtgatttacccaatgatattgtagtttaatctttgtcaaattagcaggggacacaatgaggcgtcctaattggtgtcctaattgtttttggtgtcctaattgttttttagggcctttttagccttgcagcctctgcatagaggttatggagctctcaactaggcaagcaggtattagtatttgaatacaaagcttttatgggcacaatagagatctccgataatttgcctcaattatttcatgaagtgttaatgtgatactgtgtcatctctttgctgtatatggtgtatgttcttacactgtatatggaagcccctgtagttgcagaggaaaatctgtctttgacagcatctgtgttgaggtagactttcaggagtgagatcatgagatttcagactataagaatctcagacctgtgagcatttcatttattcatttaacaaagatttattgtgtgcctgcttatggagatgtaggttttactggttttgggataccaaaagagccccattgtgtcccctgctaatttgacaaggattaaactacagtatcattgggtagatcacaacttgtggcatctgtaaaaatggaggctggctacaccaagattctgtgattaagtgattctagaaagcaaagcaaatttatcttatagaatacttgtggaaaattatagtactgtgttcatttaataatatcggtttggttaatattgggaaatgtttttctgattacttaacctgaagaataaaatgccatacagtaatactgacagcagttcttacaaaatagtccttagcgtagtagtctcacagagttatgaaattctcagactactaggaattaaagaaatctcctaatttaaatataggaccaaagcccaaaaaaaatctttgttttatttaccattttgtactatttgataaagatttgactgtcgggcttaagttagtgattttttaaatgttttaatttagaggttatgtttcacattgtaaacctagatcctgaatttttatatttagtaatataagatggcatacttaacaaatgcaaaggctacaacaaattaattgagagtattcttaaataaacttaaattttaatcatttttgtgtatacttaagatgatttcaaaataaaggttttatgatttaatgtgctattacatttcaaagagttaaagacttacgccattctacaatattcattttaactggtatacttgaggtttatgaactgtgaggttttgtgtgtctttccaatccctgttaatccatttggcttttcaaactggaacaagattcttcaatattctaaatcctattttaagattccttagccagttcagctcatgtaaagaaatcatccaaaaggaatattaacaatgtaatatttatattgtgtttgtttttacacactgtgcttttgtggttttactttatatgcttagggtgtataattggtttccaagggtcaatatgtgatcaacagtgttttacctatgggaagtggggttctattgatataggaacctcaattatacatccttcctctttgttcccatgaatagtatcctgagctcataacctataaccttatgatgtttacatgttattttaattacctcttatctcaactaaatctccctcaaatccttgagaacagagacatcagttaaatcaactttgaatcctcagaatgtagcacacagcagacatgcaaatattttttaaatgaatgaatcaattgtgagacatgagggcttatcttggatcctctatagtcactaaacaggattttaaactggagaatactgtattggccaatggttatctggaaaaccataatcaatgggagtattgtttgtgtttgtggcaggggctggggctggggctggggaagattttcaggaaatggctcagtaattgtaggtgctggagagtctgaaatctgtagagtgggctggcaggctggagacccagggaagagttgatgttacaacttgattctgaaggcagtcctgaggcagaattcctttttccttgggcaacctcagtctttttctcttgaaagccttcagctgattagataaggcctactcatattatgaaagataatctgctttactcacagtttactgatttaaatgtgaatctctttttttttattattatactttaagttctagggcacatgtgcacaacgtgcatgtttgttacatacgtatatatgtgccatattggtgtgctgcacccattaactcgtcatttacattgggtatatctcctaatgctttccctcccatttcccccctccccacaacaggccccggtgtgtgatgttccccttcctgtgtccaagtgttctcattgttcatttcccacctatgagtgagaatatgcagtgtttagttttttgttcttgcgatagtttgctgagaatgatggtttccagcttcatccatgtccctacaaaggacatgaactcatccgtttttatgtctgcatagtattccatggtgaatctcatctaaagaataccttctcccagacagctaagctggtgtttgaccagatatctgggtacaatgccttagttaaattgacacataaaattaaccaattaagtgattaatttcagtgggaagattcagcattctcgtaaatgaaattagctataaaaaattgaaattattataaggaatagtcacaagttataaaagaaacattcattgctatggccaggaatatattgctatattggaatctttaagggcagaatggaaaaaaaatgaaagcatatgaacaattattacataacatataaattaggaaattttaaaggagaaatgatcagaatttaggaaagtattcttaaaggatgtgaattttgataaaaatttgaagaaagtatgcatgctgtgcatatatggagttggcagagaagcctgataagtagagtaccacaggccttatgagaggcttggggaaggaaggacagggagaaactggcaaagagcgttgcatatacattttaaatttgtttagctggagaattaaaaaaacaaaaacaaaaaacttctaggagttaattaggaaggaagagattaaatgaaaacatttcttttacatttttcttttttttaattttaagacattattttagattcaaggggcacatgtgcagttttgttacatgggtatattgcataactctggggtttgggcttctattgaactcatcgttcaaataatcaagatactacccaactggtagttaaaaaaaaaatttcttaaagatctagttttacatgtatgatggactagagtggttgctaagcccaagtacaggagatgaggacctggacaaagatttataaatagaaacaaaatccaaatagagaattgagacttctcagagactgctgagagaattgacagaactttgtgatttaatgttggagacaacacaagagaggatatactgattttgcctaaattgtcaatctagtattgtaagaatgatgttgttaattttgacagtgatgtggaaatttaccaagatgggcaagtggaatataaggaatgatgtacacatgtgactcagatattctgtggggcgaaagtggttttatcattgtattccaatatactggacattctgagacacaaaatatggtatcttcctattaagggatgttattctactaggggaaactggcatacttttattataaacttcatagtataacatataatatttgaagatatcagatatatcacataaatggtaaatcatctctctcagtatagtcagtgtctactgtgacaaagcaacaaaaactgtagcagtttaaagtgggaaggtatttacatgtattttctgcgaaggatttatgagtgtctcagattgaggcccttatacgtaggatttttaaaaactttatttacacagtgggacaaatagggaagcaggaagccccataagttggaggcttagctatgacttaaatatactacatgtttttttccctaaactattaatttggaatatcttgtaacttatatacagcccttctactattttattatgtatgattgatctttttttttttttttttttgagaccgagtctcactcttttgcccatgctggagtgcaatggcatacatgaccttggctcactgcaaacctctgcctcctgttttaagcgattctcgtgcctcagcctcccgagtagctgggattacaggtgcccgccaccacgtccggcaaatttttgtatttttagtagagatggggtttcaccatgttggccaggttggtctcgaactcctgacctcaggtgatccacccgcctccgcctcccaaactgctgggattgcaggcgtgagcccagccgattaatcatttttatatgcctaagccttagtcctattatataaatcagagccctgtagcttcacttttataaaatccttttattgcatattccccattcccttctttagtctatcagtctcagaagttcgtcaaagtattgggcatttcttgggagcagcattgcgattatgtttttttgttgttgttgttgtttttgaggcagggtctggctctgtcgcccaggctggagtgcagtggtggtgcaatgttggctcactgcaacctctgcctccctggcccaagccatcctactgcctcagtctcttgagtagctgagactacaggcatgtgccaccacgccctgctaattttttgtattttttgtagagatggggtcttgccatgttgtccaggctggtctcaaactcctgagctcaagtgatccgcacgccttggcctcccaaagtgctgggattacaggcttgagccaccacacctgtctgcattgaaattattatgttttttatttcccattcgttgttattttgttgttacttatactgtgtatgcctttgctttcattatttgcacatagtcctgacaatggcattaattgggatattccttgggccagagatacatattcttactattgtcactgtgcttgagcctacatcctcttgctttctttccagataggaatttctttcggtgatagtatttattcctgtgcttgtttctcaagccctattctaatttccatcctccaaaccttattgcctcttactattattactctcatagtaaatatcttctttggattgcattcatagcaatttatatgatacgcatagaatgtgaattactgaaataaaactattctgttcacctcaatattctgtacctcagttttcgttaagtcaaactgattttctctgcaagtagtttgtgttttcagtgtttcagtacatgttattatcttacagtatggaaatattatctagtagtgtaaagatttgtcacataaaattactagaaaaatagaatgtttaaaatatgcatgcaatttacatgggaagctttacacagttctatagttttagtgttttttttttaaatgctgttcatttataagagttaatgagtcagtgaaactacatttttaataataccaggaggaaaggatttaatagatctttaacatcttctgttttttttgtttgtttttgatagaacctcactctgtcacccaggctagagtacagtggtacaatcagagctcactttaacttccaactcctgggctcaagcgatcttcccacttcagctttccaaatagctggcactacaaatatgtaccaccattcccagctaagtttttaaaaaaatttttagagatggcatctcactatgttgaccaagctggtctcgaactcctggctgcaagctgtcctttcacctctgcctcccaaagtgctgggattacagccatgagccactgcatctggtcagatccataacaccttaatgccacatctttttctgacagttttattgattgggattactctagagatcattctttggaaaacagctcctccttcctccttttttttttttttgttttctttctttcttctttttttgagatggagtctcgctctgtcgcccaggctagagtacagtggcgtgatctcagctcactgtaacctccgcctcctgggttcaagcaattctcctgcctcagccttctgagtggctgggattacaggcacacaccaccacacccggctaatttgtttttgtattttagtagagacagggtttcaccgtgttgcccaggctggtcgtaaactcctgagctcaggcagtccacctcccttggcctcccaaagtgctgggataacaggcgtgaaccactgcgcccagccacttcgtcctttctttaccggaagtcagaatacaagaattccttccttatcaggtagtttaatctttgttagaattattatgccttcaccgtttaattttttcttgttacttcttctgtcgtttcaaaaaatactcattataattaaaatttaggaagaaccctggaacttaatgtagctgtcagagagattaactacaatttgctgacaagtcatgtgattggggaagaatagcaacaagtaattggattgttaagtagtaaagtttagcaagtttaaagtaaaggcagggtctcagtttgtctcccaggctggaatgcagtggcgtaatctcaggtcactgcagcctcgacctcccaggcccaagcagttctcccacctcagcctccccagtagctgggactacaggggtgcaccaccacaccgggctaatattttaattttttgtagatatggggtctcaccatgttgcccaggctggtctcaaactcctaagctcaagcaatctgcctacctcagcctgcctaagtgctgggattacgggcatgtgccactgcgcctggcaacagtaaggttttaaaaaatacactctaagttattttccaaatttacgtagtaactagcactttcttgaatatttctttaggtaatcaagacaataaatatattttggctaataaataagtaaggttaaattaaaaatttaagttatttttaaataaaataaatattatttaaataaaacgttttaaataaaatattctccaatttctttaatcattttataaaaatttgttatcctccatataaaagtagatataaaaacattgtttagtatgttaatgtgaactaagcagtgtcatgtacatcagcctcagaaatggaattttaccaatactgtggaaactccctgtgtaagcctgtctcaacttattcctcttcctgcactgttccccagtgtgtgaacactatgctgaattttgactgttatgctcttgatttttaaaaaggttttactgcgtatgtatctattcctaaattatctattgatccacttattttatcaaactttttaaaaaagataagacgtacctacaagatattgtgggttcagttccagactaccacaataaagcaaatattgctataaagtgaatcacacaaattttttgcttccccagtgcttataaaagttacgtttatgctataccgtagtctatcaagtgtgcaatagcattgtgtctaaaaaaatatatataccttaattaaaacatactttattgctgaaaattgctaacgattatgtgaactttcagtgagtcataatctttttgctggtagagggtcttacctcaatgttgatggttgctgactaatcaggatggtggttgctgaagattggaatgcttgtggcaatttcttcaaataagacagtgaagtttgctgcattgattgactcttcctttcacaaaagatttctctgtaacgtgatgctatttgataacattttttacccacagtatatcttctttcaaaattggagttaatctcaaactcagccactgctttaccaagtttatgtaatattctaaatcctttgttgtcatttcaccaatgttcacacagtatcttcaccagaagtaggtaacatctttaaaaaccactttctttgcttattcataagaagcatctccttatccattaatgttttatcatgagattgcagcaatttagtcacttttcaggctccatttcgaattctggttctcttgctgtttttaccatatctgcggttacttctactggtcttgaactcataaaagtcatccatgatggttggaaccaatctattccaggctcctgttaatgttgatatttgatctcccatgaatcacgaatgttcttaatggcatccagtatgatgaagcctttctagaaggtttttagttactttgcccagatccatcagaggaattactatttatggcagttatagccttatataatatatttcttaaataataagatttgatagttaaaattactcattgatccatgggctgcagagtggatgttatgctagcaggcaggaaaacacattaatctccttgtacatctccatcagagttcttgggtggccaggtgcattgtgaatgagcagtaatattttgaaaggaatctttttttctgagcagtaggtcttaacattgggcttaaaatattcattaaactatgctgtaaacagatgtgctgtcatctaggatttgttgttatagcacacaggccaggtaaattaaacgtaattcttattggccataggatttttggaatagtcactgtgcactgtctttaccttcaagtcaccagctgcattagcccctaataagagttgagttagcctgtcctctgaagctttgaagctgggtgttggtgtctcctctctaactatgaaagtcctgaatggcatcttcttccaatagaaggctgtttcatctacattgaaatctgctgtttagtgtggccactttcatcatagttagatcttctggataacttgctgcagtatgtccatcagcacttgctgcttcaccttgcacttttatgttatggagacagcttctttaaccatcatgaaccaatctctgttagcttcaaacttctgcagcttcttcatctcgctgtcttcatagaattgaagatagttgggggtcttgttctggattagtttttggcataaggaaatgctgtagctggtttgatctatccagaccactcaaactttacccatatgagcaacaaggaggctgttttgctatcttatcatttgtgtgttcgctggagtagcactttaaatttccttcaagaacttttcttttgcactcacaacttggctgactggtgtaagaggcctagttccagccggtcttggcttttgacatgcctttttctctaagcttaatcatttctagcttttgatttaaagtgagagacatgtgactctttcacttgaacagttaaaggctattgtagggttattaattgacctaattttagtattatcgtgtctcaggtaatagggagatggctggtttggtggaacagttagaacatacacatttgttgattaagttcgctgccttatgtgggcttacatgttcatggtgccccaaaacaattacagtaataaaatcaaagatcactgattacagatcaccataagagagataataataatgaaaaagtttgagatattgtgaggttttccaaaatgtgacacagaggcacaaagtgaacacatgcttttggaaaaatggcaccgacagacttgcttggatcagggttgccacaaaccttcaatttgtaaaaaacacaatatctgcaaagcacaataagtcaaagtgcaataaaaggaggtatgcctgtatattgtatgtattctactatctacctcttaagtttttaaaaatttttaagatttatttatgttgctctgtagaacatttattttcctgggtttatactattcagttaagggtatgtgacagtttgttctattgttgattgatacattgtttttttctactatgaacaattgagctatgagtattcttattttgtggtatgcatgtgcaaaagtatcccttcctagaagtagaattgctgagttatggggtttgtgcatattcaatttcagataatgccaaattattttccattttggtttgtggcagagggtggctagatatacactgaaaatttcctcttcttcctgggcacagagttaggttgaattttccacctctgttgcatcaggaatggccatgtaaatgaattctagtcagtagaatgtgagtagaagtaatctatgccacttttaggcctggcccacaaaaatctgccatgcatcatcattcagtttctcttctcccatcttttggccaagttttgtttctttcataccaattcctgtaccttttcctacctgttactgtgctggctagacttgtacagcgttgtatagaagtggggattaatgagtgttatttctaattttaaagagcgtgcttcttatatttcacagatatctacagtacattctgtgttctctagattacctttatgaagcaaggaggttctctttaagattttttttaaaaaaatttatcgggaatgctgaatttaatctgatgttttaccagtaatgattgagatgaacatttgggatttctcttttgtttccttaatcttgtgaatgatatttataccttcataatttttatttttttatttttatcattattgttattattattattttggtgacagagtctcactccgttgccaaggctggagtgcagtggtgcaatctcagctcactgcaacctccacctcttgggtttgagagattctcctgtctcagcctcccaggtagctgggattacaggcgcctgccaccatgcccagctaatttttgtatttttagtagggacagagtttcaccatgttggccaggctggtctcgaactcctgacctcaggtcatccacccgcctcagcctcccaaagtgttgggattacaggcatgagtcaccatgcttggccttataccttcataatgttaaactgcacttatatttctagcataaactcagcttggtcatgagatatattaatcttttgttcatcactttcttcagtttgaagtattttttgctgtctccatattttcagtcttagtttggatagtgagaaataccatgttatatgagtatttcagatactcccaaactttccagttcatggtgtcctcaagtcaaagaaatacctaacagctacgtttatttagtttcaaacaagttagtatttatgtccttataacttattagttatttgaaaaaatcatatgcataaattcgatatatttttattttaattgtaaataaccacagtcccttgctaatgggatatgtgtgcacctcagagcaatgcataacttctcaaaccttggaatcagataaggcattgccattgccaccctcacttcttgttccatgttgattttcacttggggatgctctttttcacagcaactaccataaactcagatttataaggataacacatcattgaaaggaaagtggtactatttaattttgaaattatttggtgtcagacagatgttgtatagcataatttgggaaaccctgaattttggagagtgaatagttagaatgtgaacagtgaggggtactgtgttttttttttttttgagtctatttgatatttatattttattaagataagttggaataacaggatatcagctatatctttaataaaatttgctatagtcattttctgtgttgagtttttaattatgagggatacttgtgttttatgtactgttttgcatctatgatcaagagtgagattggctgggcggttttgcatctatgatcaagagtgagattggctgggcgcacggtggctcacacctgtcatcccagcactttgggaggccaaggcgggcggatcatgaggtcaggagatcaagaccatcctggctaacacggggaaaccccatctctactaaaaatacaaaaaatttagccgggtgtagtggcgggtgcctgtagtcccagctactccggaggctgagacaggagaatggcgtgaacccagggggtggagattgcagtgagccaaaatagtgctactgcactccagcctggatgacagagcgagactcttgtctaaaaaaaaaaaaagtgagattcacctactttagtttcttacactatttggttttggtattaaggttatactggcttcataaaacgagttggggaatgaatattttctctttcttgaagagtttacataagactgaaattgttctttgagtttggtaaaactcaactttctttgtgagattttaaaaaattattatggttgaattcgtttttctttttgcctacctgtattttcttatttactgtaataccatacaatacacttttaaggctggacaatcttataccaagaacacaaaacaaagcctgtttggagttgattctaagtaggtttatcgcttagtcaccaaatcttgtacttttaagcaaaactaactcatagttttagagaagattttaaactgttgatttagtttccttcatgactataggattatttagtcttttcatgtctttttgtgtcatctttcaaaaaacttttttagcaataattttagatttacagaagagttgtaagaatagtatattgaattcccatatactcctcacccagttcccctattattattattattattattattattattattattattattattattattttgagacagtcttgctctgtctcccaggctggagtgcagtggtgcgatctctgctcactgcaatctccgcctcctgggttcaagcaattctcctgcctcagcctcctaagtagctgggactacaagcacgtgctaattttttgtatttttagtagagatggggtttcaccctgttagccagcatggcctctatctcttgaccttgtgatctgtccacctcgtcctcccaaagtactgggattataggcatgagccaccatgcctggccagttctcccattattaacatttgcattaccatggtacatttgtcaaaactaagagactgacactggctcactgaacttgacaccttatttagatttcaacaggtttttttgttttgtttttttcttgttgttgttgtgttttttttttttttttttcatttatatcctatatcctctttctgtccagggttcccacagtatcacattgtatttaattgtcatgtcttcccagtctcctctggtctatgacactttctggttttccttatttttgtgaccttgacagtcttgaggagtactggccagatattctctctgttggggtttgtctgatgtttttcttgtgaggttgtgggaagactaccatagagaggaaaggcccttctcatcacatcattttagggggcacataatatccatgacatcactgatggtgttaaattaacctccatcacttggtaaaatagtgattgccatgttactcactgtaaagtcattattttttcttttccttacttaattgttgtttgaaagcaagttactaaatcaccttcaaggggtgaggacatgggaattaagtttcacctcccagagggaggagtagctacataaattatttggaattcttctgtaagaaagatttgtttcttgttctccatttaaaatatttatttaaccatatgtttatatcactgtgtcctaggttagttttagtgggttatgtatctttttaattgaatttactggttacatttgttttcaaatctattacttaaatgttttcaacaaaaacattgatctttgctttgtcagttgttaagttctccctttcatttataattaccttgtattattttctttcttgatctcattggcaggatttttaaaagtcatttcaaagaaccaggctgggtgtggtggagcagggccatcccagcaactctggaggctgagactaggaggattgttggagcccaggagttaaaaggctgcagtgtgctatgatcatgcttgtgaatagccactgcacctccagcctgggtaacatagcgagacctcatctcttaaaaaataaaaaaggaccaacttttggtttaattattctctttattgtgcatttgatttctgtttcatcaatttgtgcttttatatttgtgccttttttttttcttggtgaggaaattctttctggtaacttcttagacatttagctcagttttcagtcattcttttctaatgaaagcattgatgggaatacattctctgagtattgcttttactacattttatgattttgaaatgtagcgttttcattattttttcattcttgggtttaaaaatatttataattttttccttgagtcatatgttatttagtgatacggttttaagttttgaaatgtatgacaattttatgtctttttcttattggctttgatttcattgcattgtgatcagggaatgtagtctttctggtagtaattgttccattttctctaccatgtcttttaacctttctttcatattttgcatttctttgtgactataggctgcattcttttttttttttttttttttttgagacagagtctctgtcgctcaggctggagtgcagtggcgtgatctctgctcactgcaacctccatcttccggttcaagcgattctcctgcctcagcctcccgaatagctaggactacaggcacttgccaccacgcccagctaattttttgtattttttctttttttcttttttttagtagagacagggttttaccgtgttagccaggatggtcttgatcttctgacctcgtaatctgcccaccttggcctcccaaagtgctgggattataggtgtgagccacagcgcccagcctttacgctgcattctgaattgttttgtcatttctgtgtaacagttcactgactctgtttatttacttcttccattatgattttacttgtgatgtttttcaattctagtagttctgtttggttatttttcagatttgcccattcattttttatattctctcgagctttactagtatttttatttgttccatctttttctcttaatatattaaacatatttaatattctatatttgataattctaatatctgaaattttacaacaaattttgttgtttgttttctctggctctttctaatagtgccttatttacttgtatttattgtggttttttttttttgaatcatgaacttcttttttttaactggaaccctgtgtaactgtggaactctttagacttgagttcacagtgcattcctccagggaagattttttatttccttctactatgtgcttggagttaggggtctatgaacataggttttaacttgaaattctccccttttaaaaaattttttaacttttattttagattcagggagtacatgtacaggtttgttacatgggtatattgtgtgatgctgaggtttggggtgtgaatgaccctgtcacccaggtagtgagcatagtacccaacagttaattttttaacccttgctcccatctctccctccctgctctgttagtcccagtgtctattgttgccatctttatgtccatgagtgcccagtgtttagttcccactcataaatgagaacatgcagtatttggttttctgttcccttgttaatttgcttagaataatggcctacatccacgttgtcgcaagtggcatgattttattttcttttacagctgcataatatttcgtggtatacgtgtaccacatttaatttgtctgatctactgttgggcatctaggttgacttcatgtttttgctattgtaaagagtgctgcagtgaacgtaagagtacatgtgtctttttggcataacaatttatattcttttggatatgtacctagtattgagtttgctgggccaaatggtagttctgttgtaagttatttgagaaacctccataccgtttcccatagtgggtgaagtaatttacattcccactaaaaatgtataagcattcccttttttgttttatgaagttggtgctccagtgggtttatatttaggatagttaagtctttttgttgaattgaaccctttattgtaatgtaatgtccttctttgttctttttttactgttattttaaagtctgttttatatgatgtaagacttgcaacccctgctcctttttatttttcatttacatgatagatctttctccaaccctttactttgagcccgtgggtattgttatgtgcgggatgggtctcttgaaggcaacagatagatgagtcttttttttttaatccaattcatctctgtgccttttaagtggggcatttaaaccgtttacattcacagttaatattgatatgtgaggttttgatcctattgtgaagttgttagctagtcactgtagtttctattgtgtggttgctttatagggtctgtgagctgtgtgcttaattgtgtttttgtggtagaaggttatttttctttcatttccacgtttagaattcccttaaagatctcttttaaggctggtctagtggtaacgaattctctagcacttgcttgtctggaaaagattttatttcttctttgcttatgaagcttagtttggcaggatattaaattcttggttggaattactttaagaatgctgaaaataggcccccaatcttatacagtttctgctgagaagtccactgctagcctgatgggatttcctctgacctttttctctgactacctttaagactttttcattagctttgaccttgaatcgttttgtgattatatttcttattgatgtttgttttgtgtagtatctcacaggtgttctctgaatttcttgtatctgaatgtctacctctcttgcaagattcgggaaattttcttgaattattccctcaaatgtgttttccaggttgtttgctttttctccatctcaggaatgccagcaattagtaaatttggttgctttacataatcccatatttcttaaagactttgttccttttttttgaattcttttttctttatttttgtctgactagatcagttcaaaagggcagtcttcaagctctgaaattctttcttctgcttggtccagtctattgataaagctttccctaatattttgaaattccttaagtgagttttcaattccagaagttctgattgacttctttttaaagtatttaccgcttccttcatttcttagaatgatttagaagtttctttgtgttgattttcaacctttttttggatcccagtgagcttccttgtaattcatgctttgaattctttatctgtcatatctgagtttccattttggttaggggccattgctggagagctagtgtgattattgagtggtgtcactacgatcagatttttcgtttggccagaattcttgcactggttccttctcatctggagacactggcacttttgatttttgtaattattttcatgcaggtaggatttttttctttttttgttcctgtccctgtaatattttttttttctttccctttccattccccaactccctaggggatatgattgtagagaatgctgggtagcatcttttggctttgcttctatagcctatgtacttctttgggcagattttatattgggctgtagggttcaacctacaagccagtagatggcgcttacgggtaagatcacttagccagctgtagccagtgtgactaggtatacacttgatacttgtttacaggaagaagctctctgttgcctcaggcattgggctgatacgtggagtgcacagtggtctgagctacttgctcagccccaggggagtgggaagcaagatgagtggggccaggccacctacagtcccctgatggcaggcacaatcactaacactgagggagaagccaatgggcagccaccaagcacccagaggtggtcctaggcatggagctggcaaacctccttggccccaagttctctacacaggcaggggtggaggcctgaactcttaatccaggagagtgggtactccaggtacctggagatctgcctgggtgctgcgtacagagggccctgctgtaccacaatctctacacaggaaggatggggtgtctcaggctagcaatccatgcaaatgggtcctctgactgcctgaagctatgcccgggaatggggcagagagtgccctgctttaccatggtcttggcatggggagagtgggctggcttagcctgctgatcccggtgaatgggtgctccagttacctggagatctgcctgggtgtgaagcagagaaggtcctgctgcaccccgacttttgagttttaggagtattcacatagcatagatgattcaggcaccaaatcctcatgatgtctttgctaaggccaagaggttttctttgatgtttgcctttgaaggtgtttttaatgtttgaatttacccttttcctggtgttattgtccttcttgggccctgtctttgtctgatagtgtcttacctgactttcagaggcctaaacttttttctcaatcctttccaaccctaggttactaggattcatatatgccccaggagtatctggaagctttattacttgcttttctgcctattgtatcgattcatttccattcttttttttttttttttttttttttttttttttgctatggggtttcattctgttatccaggctggagtacagtggtgtgatcacagctgactgcatgcagcctcaaccacctggggtcaggggatcctcccacctcaacctcctgtgtagctgggactataggtatacaccaccacacctggctacttttttgtttttgttttgttttgtttggagagacagggttttgtcatgttgttcaggctactcttgaactcctgggctcaagtgatctgcctgcctcggccttgcaaagtgctgggattacaggtatgagtcattgcacctagcccattttcattctttatatcagacgtttaaaatagaaatgttttaagatctctagcccagcatattctcatatctcaggcagtgggaatcctcttggaaaattttcaaaagaatagtttctaaagcccaaccacacctacatgtcagaatctctagggtgcagggcctgtgggtatgtttaaaagcctcctagataattctgatgcactgcaagtctgagaaccactgacatagaaaaagttatttcttcatgtaaacttagataattaaataataacagctagtgtttattgaaaataaggtaacatatattgtaagcatgcactaattctagctgttagtattaatattgttatatgctaggctccattctaagtccttcacatatcttgtcatttattattcacaagaatcctatagctaccacttgtattcccattttagagattagcaaatcaaagcacagagaaattgaattattcaagtttatatagctagtgggtagcagaattgttatttgaatccaagtagtcattctgattccagagcatgtaatcttaacctaccatctttacagtcttccaggtgattcacagagttaattttattgattcccaaagggtttgtgacattacagaatatagcaagaaaaatatatttggataaattatgtatttatgttgattttgtgtaggtattgaggaagcagaataacacagtagaaatggcctcagtttacagtcagatagacttaggcatgaatctctgctcaactgcttgttactagtagctatgagaaagtaaattatcacagacctcttattattttgttggtaaaggaggataactatttttacttcatggggtttttgaagaaataacataaaatagaacctgtaatatattgcttggcacacagtagatggttagtatcagaacttaaggaatcctctaagaagttatgttggcttctctgcaggagattgtagtaagccttagtctaggacgttgttgatggaatagctgatgggtactggtcgatggtgctggtgggggccaatgctgactgtcaatgttgagaatctaacaagtgccaagcattgtcctaggctctggagataaaacggtgagtgagacatagtctcactgctttcaagaagcttgcagttaacttatctatataatcagatagatacatacacagttactttttttgttagatgctaggacacataggagggttactcagccaaaccattgcagatgaggaatggctttctagagggaagaggatgagaatgtgagggattagagtagtaagtccagataggaggaaaagtaaaggctggctgaaatttgtcattactacaaaggtgttccattcatccaacatttatgaaaagatcagggatcttaggaaacttttataaggacagtgttagaatattaagagcctacttttaggttcagtttttactaaagcagacaatttttcaaagtaaaataaaaatggcactctttatatgtaatactgaattttctatcaaatagcactttttggagtctacatgcttgttacttggtagcattgtcacattaggttatacattagaggaagagagaagagaaacaaaggaatagtaaccttcagaggatggaaatgatgatttgtatgtggggtgaatttcatcatgagttgtgtctgctatttgcacatttcccttttcctaccatcctttttcacagatgatgaaaaataatttgttacatagttaccatagtacatagttttaatttgataccgtttgttgctcttgtatggatttgatagttgagatttctttccatctttctccaatgttcccaataaaatagcatattaaaaatgcaagagaaataccatttcttttggcaaaactgggaaaagtgaaagggaatgaataaagaatttcttggaaggggaggaatgtgagtctaggggaaggaagatgatgttgtaatggataaaatgatatcggggattataggaaaataaatgaagttggtctttaaaaatacccccaaaacagaggcagcagttctgcatgttttggtaacctgatgagtgtgacttgatataagagtacacttttgatctcctacttgcatatctgtatgacacctacctagaagtactgtagttttttatatgtactgtagtcctgctcaggacatgagcagtccctgactagaactgaggaaagtagagcagttagtgtgggtatttggaaacattggaaaacagttgttaggggacttaagctcttaatccctgaggatttagcagaggctagaaagaggaagggaaaaatgaaatccagtctgtaaaaaattgattctgaaagcgatactttggaaagtttataaaatgaggtcgaaattgtgaacatagacatgtttactgtgatgacaaatcttagtatactaggagtagccaaaaccttggatggagagatacagttttagacaccacccctcaaaaagagactttataatactgtcctacaaacttaccatcaaatacttgtttgcatctttatggtatgaagttggggaggatggtagaaatgttgaacataaaagcatgttgctccaatgactgtggtgttgttggggtatgttgaatttcagggccctttgagagaagagtattcatgcctaattggggtttaaattttagcagactcttcattacctttgggcacttttttctaagagtttgttgtgattgttttggcaggtacaaaaatccttctcgaaactgaacgttatgatctctccacctcaacttctgctggttttccttttacctctatccattttctctcttttttacttgttcttccagctgtaacagtgtccctcttgaaatattgcagtgcttccatagtaatccattctcttctctttctgcacacgttctgttggtcatctcatacactccactatcattaatgtgttagtgattccagaatcctttatattccacttctttgaaagtcatctgaacatatcttcttgggtgtcctgttgccacctcatgattaatgtgtacgtaactgagttaatcagcctctccctcagacatctgttatctcccataaactcaggcttggctaaatggcattaatgagtccctcatgccaggaaccttggtgttcataggagcttattcagagaatataaacaaagttttagccagaagatgcctcatcacagtacctgtattttatttaataccaaaaaacaaaaaattggagccaatctgaagtcataatcactgcatttcttaaaaactgtgatatacacacacacgcacacacgcagaaatattttacagacagtaaaatctctgtggaatatttaatgacatgagaaggaacatatgtaaacttagtgaaaaaagatgctcttaagcaatatattcattataattccataattattaaaataaaactatatagagatatttatagaaagaatgcatatgcagatattcactttaattctagatagtacagctatgggtgattttaattttatttttatttacctgtattttccaaagttgtgtagtaaaaatgaattacttttgtaattcacacatgcagacaatttggcctccctttttcactcccaacacttgttgaattagtttaataatgtcttcttcactccaactattgctgcttagttcaactactcattatatctggataagacacggcagcctcttgactttgctgctcagctgccaagctcccttcctgaaaatccttactgatgcagttcttcacttgcttcactgttccatttaagtggctatatattaaatctcaaaaaccatcaagaacagaggaaattgtgaatgttattccttgtaactagtttaccatctggtctgaagaccttcagccaatggaattcagccaactcaagatttaatttaatatattcacctaaccttaaccaagtgacttttaaccagagcatggatagttatgcagatttggggtgaggagaggtgaaggaaggaagggtgggagagaaaatatgatttgaactcaggccttcacaaatctgtgctcattccttctgttctacctctacaaactgccataccttgcccttgctgggtgtatgttcccccctcctgtattcaataaacagttcattggttttttttttgagcatttagccagtaagaacaaataggcaaataatgaaaatccatccattttagtgccagttattctatcagcagatcctattagaagtatttattgaggcatgtcatgctaatagtcccaaagtgtaattatacttgcagatttttcttgctttcagagagtttgtaatatgttccagatggttaaataggaaagaggagacaatttatactgtcttttcacttatgattaaaaatttgatgttacttactacttatgttaccattattgctttgttggatttttacgtgagaggaatttaaacaaaatgtgtgatttttaaaactcttctgctatagtcaacaattaacaggacgtttcatagtttctttcaccttgttagttgtttaattgcttctatttaggcatcattaaaatgatataattgtgtcataagtagtaattcttttatgaatgtaacctttattcttggaaagtattcacttgggtttgttttagacttaaaattaaatggtgaaccttcttgtgaaagcttacatgaaactgaaaaagaataattttccaaactgttgaagattctttgaccttttcccacaaagtattaataatatggccttagattcaaaattagtgaatctactaccaatagtaggagtgatcatttctcattgattcattcatactctctcaactacccttatctgactaacgaactacttcttttgaaaggcagcttaccaaacattgggaatatagcctgtgaactcagtttagaacagttaatggatcaaaggggtccagacccagagccttgacttcattatgaccttgagttaaccaataaactgactggttggttaacttggagaaatatgttgtttttcagtaagagatagaatacttatggtgtaattatttggtcggggcagggggacagattggttttgatccttagactaccattctctgtccttgaagttctcttccagacttcttacaaacaagaaaacaagcaaaacattttaaaaataattatagttatataattacaaagataattataaaattatatttttggtgataaataatagagattattcctaaagggttttttgggggtataaaaggagtagtttgatccagcaagatttacttcctataaattgcctttaagtatctttgttctttctcagattttcttgttcttctttaactggccacatcctacctcttcctgaccttctctccccaaaacagcctaccctctcagtcttttcagactcctcagtcgttcctcatacttactgtacagaattctttccagtttttctgggtaaaattcttatcctttctacaaaatttaaattccttctcagcaagttcaaagcccaaactaagactaagaaaagcatgcctttggggagactcagttcatcttgcaataataaactggcaataatttcagatttctattttcattactattgccaaactttgtataatttggtttgttcagcttttacagcaaacctcatgttcagattgttattaactattcaatattggctgggcgtgctggctcacgcctgtaatcccaacactttgggaggccgaggtggacggatcacctgaggtcaggagtttgagaccagcctgaccaacatagagaaaccccgtctctactaaaaatacaaaaattagccgggtgtggtggtgcatgcctgtaatcccagctacttgggaaggctgaggcaggagaatttcttgcttgaacctgggaggcggaggttttggtgagctgagatcacgccattgtactccagcttgggcagcaagagcgaaactggtctcaaaaacaaaacaaaactattcaatattatgagtctttctgggaatatgcaaaataatatagacaaatttaattcttatttttgttgtatgtttttaaagtgttttgtatgttcactggctcacatgtataaaaatttgattttatacaaatgtgttaagatgggattaattttttaaagaatgattcacagaatttcattgaatggaatattgtagcttatatataaagaatgtaatttgatttataaaaatttaggatatgcaggacctttctatgctacttaagtaagaattgcatatgtgtgacaaaatttaagctaattagggtaagtatctttctgtgttagtggtaagagataataacaggatatttgaaaagaaatgctactttgaattcatgataccatgtttcttcttgttaactaagctagaaatttttccttattccttctttggagtatcccagccctcttatctaccctgctttcgtcatgggaagagttgttactgtgattctcataatcttgtgtggtatgtggggggtggggaggagttcccttattcacctggcccctttcctggaatatggcatgtgaaatgccttgtcttgttgtgaaacatttagaaaattacagtaacggcacttcagtcctcatctttcctgaggcttcctttgtccccttattatatatctggtatatttaaaatctcttgtttttttgttttccgtttgaatacttgaaccacttcagtgtctaattgaacattgttattgtctagaaattcagatttcattttttgtgttatgtgtgtattcaggcagatttttttttttttttttttttttttttttttttgagacagagtttccgtctcaaggctgcagtttcactccgtctcaaggctggagtgcaatggtgcgatctcagctcactgcaacctccacctcctgggttccctcctgggttcaagtgattcttctgcctcagcctcctgagtagctgggattacaggcacctgccaccatgcccggctaattttttgtatttttagtagaggcagggtttcaccatgttggccaggctggtctcaaactccagacctcgggtgatccatcctcttcggcttcccaaagtgctgggattacaggcatgcgccaccacgcccagcctttcaggcagctttctaagcagcgctcatgaatttgaatccctgtaggtctaatttgtacctaatctctgtctttctgtatcctaggaagctttgttaggaattgatacatgcctttgtctcatttccccaaacctaatgtttgaccgtatactgttagctgactgtcaggttctgttcacagagtgacacctctagtccccgcatgttttgacatgttaactgtgtgagaggaaaatgctcagacactcctgagaaatcaggctgcatccacttacatatccagcaaaatagatgatgaacataggagaaggagaaccatacagcagtttggtttaatgcacactgacctccagtatagccagttagtatacaggaatttgacctaaataagaactgttgttttttttcccttctgaggagaagcatttgtagccacaatggtaaaaaataatttatcctcatataccactgtttctcaacaacagcactgttgactttggggtcagataattctttgttgtggggactgtacttatgcattgtaagatgttcagcagcatctgatatctacctagtagacatctgtagcactctccaccctgagctgtgataaccaaaaatgcctccaaacattaccagtgtttcctgggaggtaatacagccccagttaataactactgccctatacttatgattatgtctttgtacttttgattatatggtgaagacaaattcttagaagatagattgtgcattgtaattattttggtaactccagaaggatataccaatttctattccaaaaacaatataagacattgtatatttccctagacccttaccagtgctggattttgtcagtttttttagtcttttgccattttgatagatgagtaattacattgccataattttaattcaaacagttattaagaaggttgggtatatcagaatttttattgcccatatgcagatcatcttttgtgcattgcttgcttttgttcttggctcatttttctgggggtattaatttggtcatttatggtttctcctagtaggttgaatttattgaggtgtcacataaaagatactcaatagatttttaagttgaatgtagaagaacattggtacttctctaaggaaagagagtatgtatgtgttgcatgtgtttgtgtatgaccatgtggacacatgtacatatgttcatgtgtatatatattcatggggacagaagagcagagggctaaagacttgagctgtgtgtccacatttaccaggcattacaaggatattgagaagaagcggaggacaaccagtatacttttcttggaatatgtctgaaaggtcaaagagaaaagtgactaatttgctaggaagttcacctcaaacctccctagccaaattctgtaaggtcaaacaagtgatgaatattcaaaggactaaaagaagttagaggtggaaactcagaaaagtgatatagtaagagtatgagaatgggaggcttaaatttcatagcattgtctaagtaatgtggtatttgggagagctaagtatagattggtgagacagcccagcttatatggattacctatggaatttttttactttctcatttttatcagggaatttatcttcttcactgttcttggatatcatctaattttctttttctgggctccagatctctgtctttgtctttgaaagggtctttgccctcttccttcagagcacataaaaagataataagaaatatgtatctagggcaaaagttctcatcatatggtctgcacacccctcggagggtctgtattaggctgcttggactgccatagcagaataccacagactgggtggtttaaacaacagaaatttattttctcacagttccggaaactgaaagaccaagatcaagataccgtcagggttggtttctggtgaggcctctctgtatttggccgccatcttcctgtgtcctcacattacctttcctctgtgcctgtgcactcctggtgtctcttcctcctcctataaggacaccagtcttattggactggggctccacccttaggacttcatttaaccttagttacctccttactagccctgtctccaagtacagtcacactgggggttagaacttcacatataaacttgagaaggggacacaattcagtctataacagagcccctaagaccttttcatggagtccacaacatcaaaattgttttattaataatattaaggtgttgtgttccttttctgttgtctagacattctcaccaatagtgcaaaagtaatggagggtaaaattggtgccttctcataaaccgaggctatagtacccaattgtattcttggttattttctttgttactccataattgcagtaaagaaaaaaaatgggttattaaagggctattctcagttttaactgacaatacaataaatattggtaactcatattaattaaacctctttgggtccttgataatttttaaaagtataaagggatccttaaaccaaaagaatttaagaactgatgatctatgggaaagaaggggctattaatcaagtaaatttttctattttctgttcttgattcataaggcaaatagttctgtcataatcagagaaaataagcttttatttttagaaagtagacagattacatttctgtatttaataagaacaaaaagttttcaatgtatgcatattcaattttcaatagattctctgcccctgttctccctgcctaccaaccctgcttcccccaccagctttggtccttgcttctggtgagaagagtcaagggagttttcttaactctggtccatttacttgttcaaatgctactgagtgttttgttgatgaatggcagatacaattcctttcttagggaagttgctgctaaatgatgaaacaatatatacatatgcaagatattactctacgtatcaatatagaatattttgaacagaatattttccaggaagtaaaaataacagttcttataagtggattttgagctgactcttggggtggatgcatgaattgacagagagaggagaggaggaggagaaagagtatgtgtagagaagggtttgacaaacttttactgtaaaggaccagatagtaaatgctgtaggcattgccaaccatacgggagctactggactcagctggtgtagtgtgaaagcagccatagacagtaagtcataaacaaatgagtgtgagtgtattccaacaaaactttgtttatggacagtgaaattgagttttatataattttcttgtctcacggtaagaaacaaatgagtgtgactattccaacaaaacttttttatggacattgaaattgaatttcatgtaattttgttgtgtcatgaaatattatgcttcctgtgttttttttcaaccatttaaatatgtaaaaactggccagatgtggtggtatacacctgtaatccctgctactcaggaggctgaggcacgagaattgcttgaacccaggaggtgggagtagcagtgagccgagattgcacactgtactccagcctgggtgacacagcgagactctgcctcaaaaaaaaaaaaaaaaaaaaagttgaaggaaaggtgagaatgtgttcatggccacatgaactggggatttaaaaattttgttgatcttttcaaggaactaacttttgctttgttaattttttctactgttttatttctttcactgatttctgcatttagattatcttctttcttttacttcctttgggtttactttgctcttttcttcctagcttcttaagatagaaccttgaaatctatttcccccaaaggagacatttaaagctataaaatcttctccctcccctctaaacactgccttctctgtgctctccagatgtttgtatgtatttttatttgtacttttcattacattccatttgaaataattcagtgttttctgttttgttttttttttttcctccatggattatttagaagtgtgttggttttaaatatttgaagttttggagtttttctaaatgtcttactgttactggtttttaatttatttcagttgtgttcaaacagcacactctgagaagtttaatccttttaaatttatttcgacttatcagcataaatcatatcagtcttggtgaaattacatgtactcaaaaacaatgtattctatagttgttggatatagtgttctaaaaatgtcacttaggttgaggtggctgatcagatctaccatgtctttattgatttttgttttagaggggtctggttcttctatcaaatggtgagagaggggcattaaaatcttcagctgtagcagtgtgtatgtttttctctatttaatttagtcactttcctcatgtatatttaagctctgtcattgctggctgtgataatgggagaccttgaatgcaaggtagcaagtgtgaattctttatggaaaggcactgttgagtggtgactaggggtgtgacattgtgacatgagatgtggggacttgttcagcaggatatactgcataggcagaccagggataggagttagacgtgctgctaaagtgcttcagacttggattgctaacagtatggagtataatgatgatttgaaaataatgaacgtgatgctgttctgataaacactggagagagaaaattagcaggagatttcaatggattgaatataggaaaagcaaggcaagctgactgaagcagttctaagaaccgagagagctgggaaagtggtagtatggttgctggtgatagcagtgtatttaatagtgactttaagtggtagagatgaggattttctttttgacctaataaattttggatgttacctggatatctaaatatggcatcattttgttaatagtgagaagttcaagattggtaaaggaggataagaatttctactgggttttcattgcatgcatactatgaaatcattgatttctgaataattgtgggattaagattttatatgtggtcttagctcagatattcccctaatatataaactcttcttaatcactattctaaagtatctctcctagtcactctctacttcattattctgttttcttttctcctattagaatgtaagctaaaggagagttcaactctgtatccctagcacttggtacaatgcctatcacatattaggcttttaaatatttgagaattgaatgactgcctgttagaaagagaaaatatgtatactgaggtatactgagtaaaagaaataaaaagcaaatgttttataatttgattttaaaattccttactaatgtttaatacctgtttttttgttttttgctgttttttttttttttttttttttaagttaaggctaggtctctgtttgtcattcctcaccccctacccccactactgtgcatgtcaccatatggaaagtgatggttacatgtgatataaattagcacactttgttatataattaaactttgcatcccccaaaaatggaattacttattaaaatctctaagtacagatgctggtcactactctactttaaaaggtaatatgtaatttagaaatatgataaaaataaatctaaatacttggaaacaaatagttttactgttaactttagtagctgttctttgctatccttaaggggtacgaagaactggtaagactgtcgttgtcagttagcagtgtggtagagtagatagaacctgcacatagaaaaaattagtaatgcaaacagttatctgataaaatctatgccagttttaactatcacctaaagagatttaatatttactttttcttgggccttagtagaatgccatcttctaacacatataaaacctatattggaaattaaaatcctatctgagtatcctgccataatgttttggagatttagaacaacttggttttgatggtcctcagtagaagctttttgattaagtagagttgttctttaggaaagaactaaacacttgcagtttaggtgttaggtttaatttttaggtttttgagtgtggattttctctgacatcttgttttctcttgccttgtggcaaatacagagagaaattgtattgcagaatgatgatacaaaaatgctcttcctccaagtaatagaggctaatctagcagttttactaattgtgttttagtttttcttcctccctctgttctcaccttcaaatctgtgcctaattccttatattaataatctgggaggccgggcgcggtggctcacgcctgtaatcccagcactttgggaggctgaggcgggtggaggacctgaggtcaggagtttgagaccagcttggccaacatgttgaaaccccgtctctactaaaaatacaaaaattagctgggtgtggtggcggacgcctgtaactccagctacttgggacgctgaggcaggagaattgcttgaacctgggaggcagaggttgcagtgagccaagattgtgccattgcactccagtctgggtgacaaaagcgaaactccatctcagaaaaaaaaaaaaaaaatctgttatgtaccccacctcgtgccattattctgaagctcatgggtttgtatagaaaaatgtgtaatgttctttgaccagtttaatgatcagagcttattctctttgagcttttaactatattaggattgttgaattagagcaggttcattaattgcatatattaattttttttaatgttgtgtatctactctgctccagattaaaaatacctacacggagcttacagttgagtgagagagatacacaataaacacataatcacacaacaaatatgtaaataaaatagtggaaaatatgctgtgaagaaaacgtagaaaatgctatgaaagtacagtggaggctgatttagattactgggttaagagaagtagaattttagctgaagtttgaacaatgaataggaattggatagatgaagaaggtatgagggattattcacagcagataacatattgtagggaaggccttagagtaaggaagaaagattggggaataggagaaacttttaggaaagaccagtgtggttaaagcatagtatgctttggggagagtggctatgctgtgagttttggattttatcataagtgagataaaaccctgtggaaggggtgtgtaagcaggattagaatagtggatttgtgtgtgtgcaggggaatagataaggtggggcttggtgattgaataaataaagtgtgatagtgtaaaaatttaaagggtggtgatatctaggttttgggtagcagcagttgaatgggtataaaggtacctttttaaggatgggaaaaagtaaaggagaagggaggaatttagtttggaacttaataaataggcaaatgcatgcaggcccttagaatagagcattaaaaaaattagcaacagtcttttgagaatagtttgtcttcaaaatagatgtgtttatactgcacccagaattagtaatattgaaatatactagtctatttcagtgcttatctgtttaacataaatataatggtgcgtgtaagagtcatgaatattttagatttagtagttgatatacagacttgtaaacacacagtttataaaagtttataatctgccttttttcaaaaggagcaggaagtaaaaattaagatataacaaaataactctgggttgacctcttactgtactgtttgggttttttttttttttttttacactttatcattaaacttagaatgtaaacatttatatcttcctagaaacaatgagatttaaaaacaaaaaaaggtacctaaaatctcctgaatatatgttactgaaacaggaggatataatgaataattaaaggaatgtgtgacatccaagtcagggaaaaactaagggaaaacatgatgccgcaatcatttgttagaaaggtggctgccaagtagaagacaaattaaattaaatttagttggctgtagtctggttattaatcaaacactttcatgttgtttatcatgtgccagacactgttttaagtaacatacatacatatatatatatatatatatatatatatatgtatttttttttttgagatggagtctcgctttgtcgcccacgctggagtccagtggcgtgatctcggctcactgcaagctccgcctcctgggttcacaccattctcctgcctcagcctccggagtagctgggactacaggcatctgccatcacgcccggctaattgtttttgtatttttagtagaaacggggtttcactgtgttagccaggatggtctcgatctcctgacctcgtgatccgcccgtctcggcctcccaaagtgctgagattacaggcgcgagccaccgcgcccggccgtaacttattaatgtttactctctgaacaattcttgactaggtacaagtgttatcccactttttgtagatgaggaaatggaggcatggaaagattaaggtcaaaaagctgtaaatggagttgaactccagaatctatacttttaatcttaatgctatactgtcttggttataagaagggaatgtggttacctgtaggcagatgtggataactgaagctgttaatttatttcactggtgtgaagttttattgtatcaatataccagattctattattgatgggcatttgagctgttcctattttttgctcttataaacattgttagcatgaactttcttcatatatcttgttgcacatatccaagaaactttctctgaggcggtggttctctttattactggtccactggtggaattcttgccacttactaatggtgctcagatatattacttggaattcttgctctggccacagagcaacagttttcatatctttccaacataatgcagttatgtcttctaacagcactcatgaattcttagattttttaagtcacctaaaaaattatgtgaagaaatgagttcttttctggagagagactgcaagtttttcataaaagcattttgtaatcataaaaacaatgaaatcactttttttaaagtgaaagataaaaaaacaagtaaatattgctattctattagaaaaagcaaacaactttattgtaaagtctatgggaaagtcaaataaactttatacatgtatcgaatattttacagcattttcagtgtttacaatgtttttaacattaatatggatggtttgatttcaaattttttaaaaatctttttcatcttcagtttggaaagcatgacttgtgtcatcattgataagaaagttggtaatattctttcttcattcttttattaaaatcttgcattttttcacccaaaatttgatctcttaaaaccacctttttcaggcaccttctttttaaattttatttggggtaaaattaacaagtatacataagctactgtggaattataactccatgctaccaaaataatttataattgccattagtgttaatggtttatttataatgactcactactggatggcagtacacctaacctaaactatgagtcccagaacactgggaattttgactagctttattcttttctctccccatcaaaaagtatatcctaaagaagataagttaaagccacgttataataatcttgaatcttctccaattttaaataaataatatgtaaatcattggtattttaattgtttttgataacaaattttcatcacacctcacagtcagtataccggggtgagagaatttactgtcctttaggcatgtaaatactgtactctagttggtaagtttgtttttttacttccttacaagagagaacattaagcgatacttagataaaatggacttaagaacagtgataaaaaagagagggaacattaagccacaatttcttttgacagtcatatcataaggcaatatttggtaatggaagatggattttttttcctgctttataaaagtcacaatcaatggtgtcagcttgtgtgtacagagggacgttctcttggttgaaagctggttctttttcacaaacctttccaatgaactgttgcataggccttgctgcctattgttaactctatttctgtcatacaattctttatgttattgagtaatttctgttgcttactgcttctcaatgtcaggatagtggattcttaaattcacgaaaaaattaaggtgataatatatacatgaagtaaaaatttttgaataattacaaaataacaggaagattgaaataaataaaatgttagaaataatatatagtatttggttccatgtaaaagtggtagattgagcacttagtattgttcactctcaaaacagcagtttagttaaacaacaacaaaaataggataaataaggattttttaaaagtcataaatccagggagactaggagaatgggagggaatatgacaaaatttttgaaggggtagaacagctagaatagtagtagcaatctcactaaacttgagaaagccagttttaagggaagaaagctgatgaccagttggactgatactggtgaatcttcaaaaggctcggatagtagtagtatgtaactctggaagttaagaagggaagtgaactaaaatgaggaagatggtttcaaagctatttaaaaagccactagatgcactgatatccttcttcactctctgtcactgtgcttatgcacttctcccatcctgacaagtgggaggcttgaggtccatcttataggttaaaacagagggtctcttggctagtggacaccagtcacattgaaggtggagaggaattaagtgagtactgacatttccaatgctcagaacccctggcccccttctccattattggctcccaaattgaaaactaggccctttagcatccaggcaggaaataggaggaatctttttgggaatcccaccaactcaaggagaaaaacctaaagacaaaaagaactatacataaatactgtactccacttggtaagtttgtttcttataggggtataggttaacagtgtaaactacattacctgtatacaagtgtttgaaaaataagctaagcattagaaaaggggagccaggtttctcacataaatatttatgccctcacaaagagcctggacagattgccttgttgtagggaaggtcataattgataagtcccatgtatataactagaactttccatcaactttgtgtacccaaacaactaaataccattgggcatctgagaaagcttctaatatgaataacagaaaccaaaataagcaaatagagaaaaactggagaaaatagactatgccacctagaaaacttgatgtatatgtatgcatgtacatacatatatacatatacacacgtacacatacagccatatatagatacatatgcatacacacacacatatatatatacaaatacccagatatgtgcatgcagaaagactggatgctgcacccataaagcaagaatgggatatttaaaaaaaaacattcagagaacaaaaaagaatttttaccaattaagaacatatagtagaaaagaaaaactcaaagaaatattggacattaagttgaggaaaactttctagaaagtagagcaaaagggcaaagaaataataaacagaagataaagtaaatatactagtgcaggagggccagctctgtattattaaacattccaaaaaagggaaaacagaataaatgaaaagaaagaaaaaatgaatagtatatttcaagaaaatttctcataattgaaggcgaagtacttattgagtgcttggcgtaatggatgaaaagagaccaatactcatttaaagaataggaaatataaaaagcaaacttagatgcctaggctccataatattcagggaaatacaaattgaaatgagatactatttttcatccatttgatagggtaaattaattatatcaatagcattgggaaggatatggggaaaatggctgtctcaaactacacactctgggggaagtctgaaacaattattttggtaaacagtttgccagatggcaagtggagttggacatatgcaaatattacaatctagaaattctacttttggatattgccattagaaattcttctacttatgcatatgaagatctggacaagatgctatgtataagaacattcactgagccattatttgtaataatgaaaatgtatggacaacctaaatacaaaaatggctaagatgtggtatattcacatacacatatgaacagaacacatgcacacttcaacatggatagaactccaaaagataatgtatgaaatcagcaaaatgcagaatatgtatgatatatatacattttaaacatatatttcaaaacataaaacgttatattgtttatggatatgtgtatgtcctaaaataatataaaaaattgaccagaaggtatgtaccaaattcataataatggttacctctatcaaggggagggggaaggaacagggtaggcttgagtatggggactttagctttatcagtgatgcttcatttctttaaaaagaaaataaatatatcacaatgttactgttgttaattctgagtgatagatcataggtatttagttgttgtgtttttctttatatctttaaattctggccctttgcctaactccaaaataacaaacaagaatgttttctagatttcctttttactccttctatgtgttaggtacattataggtactcttctatcaccttgctttctcatctgattcttaaatgggaattcaggtactgcattaaccagtacatacgccagaatccagcatcagaagtagataatgaagacagaaggtcctttacccatgagagacaatttaaaactaggaattggaagcttcagtcatgtccaatagctgtgggggtttattaagggtttgctccatccatctcaggtctcctaccctggattcctaggggaggaaccccccccccccccgcccccggagacaagaccacactctttcgcctaggctggattgcagtggcacaattatagcttgcagcagccttcaacccctgggcccaggcaatcctcccgtttcagccccccaactgagtagctgggactacaggcacacaccaccttgcccggcttatttttaaattgttttgtagagacggggcctcactttgttgcccaagctattctcaaactcctggcctcaagtgatcttcctgcctgggcctcccaaagtgttgggattacaggtgtgaggcaccctatacctgccctagaaaacactttcaaaatactgaactctggattgcacagatgatcatgtaataaccatgtaataattactaaataattaatatttagaagaataagcttactgattccataataacaaacatcagatgatctgcatcattcttccccccattccttcatatttctcctgtcttttttggtctctgtgtgtcacctatctcttggtttttatatttttcacttctgaccatttgcatatcttttttgaatatggattcatcatgtacttttctgcctttgtgcagtccctaagtaagtgtgctcagcctcccatcagcatggtttccctgttcccttgcttgactggccatgagttcgtcagcatgagcaagctgttctggggatcctgaatcattagtaggaatccatctggcttcagttactgcttggttttgaaaaagttctcacaaaaaaataaaaataaaaaaataaaaagtactcatgaaaactgtcaggttttataaaagacagtggcattatttggcaaacgtagtaaagtacacaaatgatttttgggagtgccttttcttggaagtcaaataataagagagaacctaggtttgtggatgactatctttgccatatataatgactacttatcaattacaaagtaataatcaaaaggaatctcatcccctacgaaatgttttagggcactaagtttattacaaatgcagataaactagacatatacaatgagaacaatgggctaatctaactataaatccctttctttaatagtttaactataagccaatatgaagagctggaagtttaagtttctttgagtttttgaagtatgagtttaagtcaaggaaagaaaaaaattgaaaatataaaaagcatttaatttggaggggcagtaagaggtcaggatccggttgataggaacaattcaatttgctgacattaaacattccaccttaatatggaatttaccattggggaaatcatcatgatttagagaaaatacagtttttatataaaaagcaaaaacccaaaacagacattaaaaagcattacaaatgtattgttaaaaatcggtttgtatttattgatagtaaaatacatcagatatgcataaagtaaaccattcattttcttttcaaatatatgaattaatctgggagtggactaacatcttcacactattcagtctttaaacccatgaacatgttaaaccactgttttttagatctctttttgtgtctttcagcaaagttttaagtcttgccataggttttattaaattaattccaaagtattttgtttttgatgctattataaataaaattgtttttaaatgttattttccagttgtttgctacatttgtatagaaacaattgatatttttatattcaccttgtgaattcaccttactaaattcacttattgcattcaactttgtatagtatattcaccttgccaaattcacttaattctaataattggttctcagattccttaaaattattgacacaaaattcatttttaaataaataaagacaattttagttctttctaacctaacttttatttctctttctggcctttttgccctacgtaggaactccactatattcaatacaatgatgaatagaagtagggagagtgaacattcttgacttgaacgcagtattatgagaacttgcagtattttaccattatataaaatactagctgtaggtttttcatttatctcccttatcagattgatggaataacttttaatttttagcttactgagagttttatcatgaatgggtgctgatttttctcagatgctttttctgcatccattgagttttttttaagattctgttaatatggtaaattatgtagatttaaattttttatgttaatttttaaattgacaaataataattgtacatatttatgggatacatagtgatgtctgatacatataatgtatggtgatgagctcaggataattattaatagcgtatccctcatctcacacatttatcatttctttttttttgagattttttaaaatcttttttttattattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccacgtgtcagggatctagaacgagaaataccatttgacccagccatcccattactgggtatatacccaaaggactataaatcatgttgccataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacatttatcatttctttatgttgcaagcattcattaccttccttctagctgtttgaaactatacaatatattgggggttttttgttttgttttgttttgttttgttttttgagatggagttttgctcttcttgcccaggctggagtgcaatggcatgatttcggctcaccgcaacctccgccttctaggttcaagccattctcctgcctcagcttcccaagtagcgggaattaaaggcatgcgccaccatgtccggctaattttgtattttttagtaaagacggggtttctccatgttggtcaggctggtcttgaactcccgagctcaagtgatctgcccacctcggcctcccaaagtgctgggattacagacgtgagccactgcacctggccgaaactatacaatatattgtttactgtagttatccaacagtggtatagaacactaggacttattcctcctatctagctataattttgtatccttcaacaaatctctctctatccctatccctcttccccctacccttcccagcctctagtatcttatgttctacttgtatttctatgagatcaacttttttttttttttttttttttttttagctttcacataggagtgagaacatgtgatgtttaattttctgttcctggcttatttcacttaatgtcttccagttccagtcacattgccatgaatagcaggatttcattcttttttatggctgaatagtactctgttgtgtatctatgccacattttctttatccattcatctgttgttggacacccaggttgattccatatcttaactattgtaaatagtgttgcagtcaacatggtagtgcagacgtctcttcaataatactgatttccttttatttacctaaatgccaagtagtaggattgctggattatatggtagttgtatttgtagtttcttttcttttggggaacctccatactgttctccatagtggttgtactggtttacattcccaccaacagtgtttaagagttctcttttctccacatcctcatcagcatttgttattttttgtctttttgataatagctatcatcctaactggggtgagatgattacctcattgtggttttgatttgtatctccctgatgattaatgatgttgagcatgtttccatatatttgtatgacttttggtcatttgtatgtcttttgagaaatgcctgttcagattatttgcccatttttaaaatcagattgttgttgttgttgttgctgttgagatatttgagttccttgtatattctggatattaatctcctgtcagaagattggtttttgaattttaaatcagccttacattcctcggatataccacttgataatagtctattcttaaatatgtctggattcaatttgattttttttgtaaatctgtactcatgaggctgattttcttttccgttaatatcttttccaggttttagtattagggttttgtttgcctaataaaacacattgggaaatatcctctcctattttcctgaaagtgtgtaagattgctattattacttccttaaatgttggatacaacttacctgtgatgccatctggacctggagttttgttttgtttttaattacaaatttatttaatacatacagtctgtttctttctgtggttattttaataaataaaataaaaaaattaattttttgagatttttcatgttatctcagttactgaattgatttttattacgttgttcagaacactatatttgtatgatctgtggtgacatccctcatatttctagtattagtaatttgtgtttttaactttttcttgatcaatcttgctaaagttttatcaattttttacctttcaaaataaaacaacttttagctttagtttttttcagttgtccatatttattccattgattagaatattaaatgtattatttttagtttatacctatgattttaaactttttaaaaatatataagcagagtataggctgagcgtggtggctcatgcctataatcccagcactttgggaggccgaggcaggtggatcacgaggtcaggagttcaagaccagcctgaccaacataatgaaaccccatctctactaaaaatacaaaaaattagctgggcatggtggtgggcatctgtaatctcagctactcaggaggctgaagcaggagaatctcttgaacctgggaggcggaggttgcagtgagcagagatcgtgctattgcactccagcccgggcgacagtgcgagactctgtctcaaaaaaaaaaaaaaaagtatgtgtgtgtgtatatatatatatatatatatatatatatatatatatatatatatatatatatattcagagtataaacgcaacttcagagtcattcaacagattttgatgtcttatgtttactttattgcagtttcacttattttctaatttccattgcattttcttctttcactgtaggtcattaacaggtatgttgtcaaatttctacctatttaagacttttctggatatgttaatggtttctaacttaattccatagtagtgagagaacataccctttaagatttcaatctttagaaacgtgttatataaaaaatggttcaccatttgtttcatgttgagtaatattttcatgtgcacttgaaaataaatgtacatttgccagttgttggatgtactgttctacgagtgttcatttaggacaagctagtcatcactcttcttcaaatcttctgtttccttactggtttttaaaaatctagttgttttatctattattgagagaggaatgttaaaatcttcaatgatatgtacagatttttctatttctcttttaagttctgtttatgcttcatttattttgaagctctgttattatttgcataacttatgattctggccgggcatggtggctcacatctatcatcctagcactttgggaggccacaggaggaggatcacttaagcctgggagctcaagaccagcctgggcaagaccccatctctaaaacaattaaaaatttctttaaaattctgattctgtcttcctgatgcattggctttcttaagaaacttccctttttatgtttagttacattcctagtcctgaagtctactttcgctgatatttatattgctttcttatgtttgctgttcgtgtaatatattcttttccattttttaaactttcagtctatttgtatgtttatatttaaactatacctcttattgacagcatatagtgtgggtttgctttttccctagtttccatcttttaattgtaatgtttagttattttatatttaatgtaattaatgtggttgggtttaagataccatttgctccttgttcttcttttcctactttcttgccttctttcgggttaaccaaacattttttagtagagtgctaacaattcctgttaactttttagctatactttcttatattttcaaattcctttataaccttttgaacactactcttttataatttttaagtggatgctctaggaattaaaatatatatccttaatttataaatttatttgtagttaacattgtaatactttatgtaaaatttaagagccttgcaacagtgtaattgcatttatacctttgtgctattattgtaatataattaacatttaatatattataaactccacaatattttatatattttaatatatttttgtataatcacttatcttttaaagaaaatacatacttcttttaaagaataaaaagaataaatacatcttttaaataataaaaaatacatagtccgttttatttaccctcatatttatgatttctgatgcttttgcttctgttttgtagatctgactttatctagcatcatctccctttagcctgaaaaagttcctttagtatttcttatatattaatcttaaaacagattatgtttggttatatgaaagtgtttttaattttgccttcagttttttgaaggatatttttgctggatgtagaattgtgggttgatagggctccccaccccccttcagcattttaatggaagaaattattccattatcttcttgcctctgttgttaccaatgagaaaccagttaccatttatatctttgtttccttgtatgtgacgtgctaccttgcccaagctagtttcaaaattttgtcttaatttttttttagcggtttgactggactttgccagagttggtttctctatatttattctgagtgggatttattgagacactggatctgacagtttatttttcaccaaattttgggaattttctatcattatttccccataatactatttctgccccagtgtctttcgcctctcatcaattacatgcttggtattgccagcagattacagagggcgtgtgtgtgtgtgtgtgtgtgtgtgtgtgtgcgcgcgtgcgtatgtgtgtgtgtatgtgttttccccagattatagtaggggtatgtgtggttgtgtggtttcttttctctttcttcttcagactgggtattattttcatttcaagttcactgacttgtttttctgctgtcacaaatctgttgttaagtctggccagtgaatcttagaatttgctattgaaggatctagctcttgaatttccatttatttctttctcagtttccatttgctgccagtatttctcatgtgtttacccattatatgtatataaatatatatatatatatattttttaaaatctttaaacatatttataatagctactttcacatctttgttaggtgtttccaacacctaaatcatcttgtggtgtgttactgttgactaccttttctcctgatctggagttacattttctaccttctttgcatgtttagtaattttttattgtgtactggatattgtggatgacattgtggattgttatctctttttgaagagtattgatttatcttctagtagacagctaaattactggctggtaaacatacacttaactatacaactcagcaattacagtcctgggcattgaaatgaaaacaaatgcttttacaaaagcctgtacagaaatattcatagcagcttttatttgtaatagccgaaaactaaacacaacccaaatgcactttaaaggacaaatggtgaaaaaaactgtggcacaactgtaccatggagcaataaaaaggaatgaactattgatacgtgcaccaaactggatggatctcaagggcattatgctgagtgaaaaaagccaacttgaaaagattccatgctatatgattcaatttatgtagtattctcaaagtgacaaaaattatagaaatagggaacagattgcagttgtcaagagttaaggaaaggggaaggtggatgtgattataaacagcatgaaacaattcagctgtggtgatgaagcagtgaatctcaattgtggtgtagttatatgtatctgtacatgtgctaaaatgtcatagaattgtaaaaaagacatacaaaaaatgagtgcatgcaaaaactggcaaaattcaagtaaggtctgtaatctagtctactcaatttccagctttcttttagctctgatctacattctttaatgcctcaagccaataagactgtggttttctcctttaaacctagcctctctgcacttaagtgggagtactgggaagagttccgagttcccttccaggagagtctcataagtgtgtatctcacccagtgtaattcctttctttcaatgatcagaacccctacaatttctgtctgccttggtcactttccaatttcttcaaacagttgttttttatattttgtccagagtttataactgttaactgtgggcaaattagttcgatataaggtagttcatcattactagaaccagagctcaactaacatctttttgaagttttacaaacataaaatgtttataaactttttcagttagaaatttgaagacaaaatattataggagtattacataagtaaataattatgtgataactgaaaacatgaaaaaaatcagaatttataagtaggaagaaggataaatatacaaatgcagccagaaacaacttttaaaagacatgtaaatgagtctttcagaagtttacagatagatgcaattatgtattacctaagcagcattctcaaataggagtatatacttaatcaccagaaaggacttaagctgtaaaatgagatctttattcattgtcttttggaaatatttttccatttcactctaaaagttgcatttttttttctttttctagcatatctgacctttattatttattggagaataaaatggcaatctaacgtcccttctgcttttatttttgtctttttattctagttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtaggaattgtagttctatttttaaagagctttgtctctgcaaaagtatggaaggaacatgattacctgttgactgttatcttttatggaaatatgtgtttgatctgggttgcttcaaggttagtgtaaaacaggtgctcacattcctaagtgaaaatgataggaaagttctaggatacactttatgaagctattttagtgtatgtcgaaatcacttatgatgagaccctcaaagtccttactgaattgaaaatggcagcagaaactgtagtaaaccatctccagatttgcttcatatatttctaacatatatccagttaattttatacatatatgcataaaattacataatatatacctatataattataggtatacctgtataatatataggtaattgtaggtatacccatataatatatacctatgtaatttatgtgtatgtagtgtccatatgggcatttttacattgttgctgtttgagtttgtgagctagctgaatagaaccagtatatccgtgaacatactaatgggagcagtagaaaaataaacatgtaccaagccaagacagtagataaaagagttgaagagtgatcagaaactgataaatcagtaagggaaaacttccaggagaaaatttgttaattaatagacttgtaattgaattatacatagataaaaataaaaaattataagcatataactttttatttattatgtactgaacatatttgtgtaaacatcgcctgggttaagaagtagaacaataccaccaccccagaaatcctcttcatccatgtgtcccagctgcacgcccattcacttttaaaggaggcgacagttgtcactatggagagtgatacctgtcaacctagagtgtggggttttatagatcactgaagttaaaggcagtaaaatttagttggccaacaatgcctgtgtttggaattaacaatgagtttggaagttggaggcaaaactctcagttggcagagagctttaatgcaaggactggaggtacaaaattatttaagaagatattcatctaatcttactatctctgcctctttaaaattgcatcagttttggccaggtgctgtggctcacgcctgtaatcccagcactttgggatgctgagacgggtgaattatgaggtcaggagattgagaccatcctggctaacaaggtgaaaccccgtctctactaaaaatacaaaaaaaaaaaaaaaaaattagccaggcgtggtggtgggcgcctgtagtcctagctactcgggaggctgaggcaggagaatggcgaatggcgtgaacctgggaggcggagcttgcagtgagcagagatcgagccactgcactccaacctgggtgacagagcgagactcctctcagaaaaaaaaaaaaaaaaaaaaatttcatcagttgctagagcaaacacaactctttgtttctggcttttattaactgatgatacatttgtatttacacgttgagtgccccatatctgaaatgcttgggactagaagtgttccatattttggattttaaaatatttgcagtatacttatcagctgagcatccgaaatctgaaatcctatatgctcccgtgagcatttcctttgagtatcatcagattgtggagcatatcggattttggacttgggatgctcaacctgtattaatttatgttttctgttgtttccaatcaggactgttggttctccctaaggagcaataaatgaattaagtattctgattaaaaaagaaagttttgctgagtaggatgtattataataaagagaaattttaattaagtaggagagccatctctttaagagttttcaggaaagtaatgttagtacctcgactttatgaaagagaaaggaggagaaaattgatagaataatgcagtgactgaacattagcttggtgtctgtctttcctcattgttcagtgagtgactctaagaaagtcattttcctcattataatgacatttttcatcttttctatttcttcttaacattaaaaacaatttcaaatgtaccaaatagttacaaaattgctagactgaacacctgcatgcccattgcccagtttcaccaattataaacattttatggaatttgctttatctctctctgtatttacttttccttttccccttccccctctaccattacgatgacaatgatgaaccatttgagaaaaagtggtagacaatcatgatccttcactctaaaatatttcctacttaaccacaatataataatcaattcaggaaacaacattttttattgctgttatctaatatatagttcacattaaaattttaccatttgtctgattcacaatcatagattgcatagttgtcacatttgtttggtttcctttaacctggaatagtttattagcttttctttgtttttcatagtagggccttccatgatagtgacattggagaagagtacaggtcagctattttgtacaatggtcctcatttcaggattgtctgtttccacctatttccttcctaaaaaggctgtgataggggatggagattcatggatttttcttttttcttctttcttttttttttttttaatgaaaaggttatcttaaataacaaagtctacaaagagttttcaggataaagtctgttggaacaaaggaaatctagaaactagaatcactaagataatttaggtgttattgaaaggaattatacacacatacacacacacacaaattgtaggacccaagatttataaactttggaacaaaaattagggtttgcaaaagcagaacttttgattttgattgaacagtgcattttattttaaagtccttgacatcttataagaaataattggttttatattataacgtatgatagaaggtaagtcacgattcgctatatgaataactttattttcatgtgatgtttggactaaggatagaaaagattctttgtttatatgtttgagtaccttgtatactacctagtttttagatgtggtatattttaatgtcaccttttctgtaaggctcttactggatatattaaggaaatattttgatgtggaggccaaagcaaaagattggggctatattgatgggttttctatttattagttatgtgactgtaggttagtgatataacttaaagcgtatgcaaattctggaaccagattacctaagaccgatttcttcctctgccgcttaagttgttgagcagattaagtaacttgtccatgcctcagttttctcgtcactaacatggattataatattacctacctgatgttttatgagtaaatgagttagtaaggtttatgagggaattaattaacataggttaggtgcttagaacagtgataggcacatggtaaatcttacataagtgttagtattcattatcatcatcatcagagcataatttattagtatgataaaactgtcaaaatggaaataataatgtatacttcatagggcagttgtgagaaataagtgaattaatgcatataaaacatatattacatgctcaatatatatataatgtcatatcctttagatgcatattaatgggcttacattttaacttgtaaactttttattattttgtttctctcaaattatttgttactattgactttataatgtgaaagtggcaactggaagggtaagcatgcttataccactgaagtggcctatagtcgaaatatttgagaagtactgtactgggtgacaattgcaggggtccttattctaaaaatttaaaagtctgcatctccagtttaaaatgtgtgagcattctttttattgttattattctgtttgttatcataattattattctattgagaaccccggaaaatggaatttgagtttcacttgttccaagttagtctttagctggtcgttgcagcagaaggaatatagctagccacatttagtgttagcattaagaggatattgatgctatttaaccagccatttacatgaaatgcttgggattttttttttcatttttcagtggatatcaataaaatattgccgaatataaatgaatcaagtaagatgacttaggttttaagctggactttacaaaatgcatatcttttctataaatgtggtcagtgaagattggctcatattgtgattttttttttttgagacggtgtctcactgtgtcgcccaggctggagtgcagtgatgcagtctcagctcactgcatcctccgcctcccgggttcaagcagttctcttcctcagccttccaagtagctgggattacaggcatccgccaccacacctggctaatttttgtatttttagtagagacggagtttcaccatgttggccaggctgatctcgaactcctgacctcatgatccacccgccttggcctcctgaagcgctgggattacaggcgtgagcaactgcacccagccctcatattgtgattttatctgtgccctttccctttcaggttgggagggtgaccctgaagttaaccggaggtttgtctgacttaatcattttataacaccctcaaaatacaattccattattttggtcaattattttgactcatttggctctatgactttggtacttcttctaccatataccattaaagaacagattttagtgtatttatttttcttttattggtgtagatatatatatttaactatactgtattctgaaatgggtttctaaaatagttgatcaaaattgaatagcttctgatctgggactgaattctttattttagatattgaagtaattttttgtgtaaatgtagttatttgattttggataatcatttgtggattatctgtatctaatgcagatcttcattttcttttggttctggcttctagctgtttttctgcccactattatctgaatctctgaaagaggttagtaaaaagaggcagacatttaaaattttttttaatttttatttatttattttatttttttaaaaagagacatagtctgtctgtgtagccaagaccacacttgaattcctggctcaaacaattctcccacctcagactcctgagtagttgggattatagacacatgttactgcacccagcaacactgaaatttttatcactcagttttgtctgtgcaaatgacaaagcaaaatgatcatttacttttttaaggctgcttctgctaaactcttataaaactcttttgtacgcctgcaagtaaatattaaatacttatattcttgtttataccagctgaagatagctatagttaggacgactgatttttcctcaagaaataccaacacaaattaaagtggattttggaagacatgtgcagtatacctgcataactctatgtcactcttaagataactggattcatagtttcataaggaaatgttgagttattttgctaatttgttctaataagatagctgccacaaatatgtgatacaatgctattttccctcagtcgtgaatatactaggaatattttaataaggcaaatgtttattcttcatcttaaaattaaattttaaatgaagccaatatgaggaaaatattaggttttaaaactaatttggttttcctttttctatgtatttgttaatagaaaacaaaataaacttttcttttttcaaacttatttgtatttagaaaaattaatgcaaagaaaaaaagcattgtcgcttagtctgtggaataagcttttagtggtaaacacagacgtattaaatatattgtttcaaacattaagatacatttagagggcaagttaccaaatccttgataatgtctttattattagcataataaatttaaaagactgcacaggattctcttttacaaaaagcactataagaaaaatctagtattttatagtagaatatgaaataagattaaatggtgttttgatttttaagaattcattgattgctttgaatccatttatttgattttgctttttattcttggccataatggttaagaacgttggcagtgatttatggtagaagcttaggggagcagggtctcttctctgggccaaggataactaccatctcaatttgggccctggcattgtggattttgagagaacttttgtttccagggatttcaggaaatccctacccattcaattagcttcaaaatatctagtattcaacaaaaattaggaggcatgcaaagaaacaaaaatatttggcccatatacaggaaaaataacaatcagtagtatctgtccctaagggggccagacattggacctattaaagaagaaaaagtagataagttggacttcattaaaattaaaaacttttgttcattaaagaatactgtaaagaaaatgaaaagagaaaccacagaattggagaaaatcatctgtaagtcatatatctgataggggtctaataccccgaatgtaaagcactcttatgactcaataaaaagacaagttaaacccaacccaaaatcctacaactcaatagcaagaaaacatataacccagataaagatcaggcaaaggacctgaaaagatatttctttaaggatgacataaaaatggccaacaagtatatgaaagttgctcaacatcataaaatgatcaaggaaatgtaagtaaaagccactttatcacctcacatctaccagctattaggatagctgttacaagttgagtatcccttatcaaaaatgtttgggggaccaggattgtttgatattttggatttttatggattttagaatatttgcattatacttaccagttgagcatcgaaaatctgaaatgcagaatgctccaatgagcatttcctttgagtgttatgttggcattcaaaaatttttggattttggatcattttaggtttgggatttttagatttgggatgctcaacctgtatcaaaaagacaaaagataacaagtattggcaaaggtgttgagaaaagggaacccatgtacccttttgatgggaacttagaatggagcagccattatgaaaaacagtatagatactcctaaggaaattaacatatgactcagaattaacatatgacccagcaataccttttctgggtatatacccaaaagagatgaaatcagctcataaagctgtctgcactcccatgttcattgcagcattattcacaatagctgagacatggaaacaacctaggggttgctcagtggacaaatagataaagaagttgtaatatatatatgcaatggaatattattcagccattaaaaaggaggagatcctgccatttgccacaacataggtgagcctggaggacattttgctaagtgaaataagtcagacacagaaagaagaatattgcataatctcatttacatgaggcatctttaaaaacaaaggcaaatatacagagatagagaataaaacattgccatagtggggaaaaatgggtaactatgggagatgatggatatgttcatttgttcatttacaataataatataaccatcataatatatataataaccattttactacatatcctcatctcatgacatcatgttgtaaatcataaatatacacagtaaaatttagtttttaaaaaataggcaaaggagctgaatagacacatctccaaataagacatacaaatggccaatgagtgcaagaaaagatgcttggtgtcattagtgattagggaaatagaaatcaaaaccatgagataccatttcacaccctcaaggatggctgtaattttttaaagacaggaaataactctttatttggtgaggttgtggaaaactggaacccttgtacattactggtgggaattttaaatggtgtagttactgtggaaaactggctttgataattcctcaaaaagttaaagagttactgtataacctaacagttccactcctagttaaatactcaagagaattaaaaacatggccacataaaaacttgtacataaatgttcacagcagcattactgataatattcaaaaagtgaaaactacctaaatatccatccactggtgaatggataaacaaaatatggcatctccaaacaatagaatattattcaattattaaaaaggcagtgaaaatcctgaagtccctatccttccttaccacatgagaaagattttggttgtcattgaaatgaacagctaaaatgaaaacttgtttcaaagacccttacgtgtcttaggactccagtttgagaaacatttttttggaaattacctagttcagatctctatttatcatgtttttcctgtgtgatgcccttcatacaactattaacttggggatatttagctctcagagtatccttctcactatatataaatgcttcttcgtgctaactgcctgctaagcatttttaaatatattattagaaatgtttattaactaattggcagggactttttaaaattatgcagttctcagctaaatccaagaaatgaatgacagatttcttatgtagaaatttaaattcaactgaattataaggcacagttctatttctttagccttcacctgtttggtttagtctggtacatttgaacagagataaatgtagtttctagttcctaaaactactctctagagattgcataagattgggtataatttagcaactctttttaaatcaacagggtacttttacttagaaaccttacctctttttaaatagtgatatgcaaattggtttcctgaaaccagcatttattttcttaatgattcttatttaagtaccctgactgcgaaatacaaagccatttcacataaatacaactgtaatagtttttcctcatgagaagttttacattgccttgtttattgtgttttgtaaacaggaagcagttaataccagaatcatactatcagcaaattatgggtgactgtctcatagctcttcagctcttggctcttatttcagtaggccagcctgtctggctgctgttgtttgttgtttgctctccctagccccagaatctcagatatagcagttgtgaatctccagctagtagtctaagggtagtacatatgggaatcttgctttagatccagaggtatttattactcaaaattattcaatctgtgagattgtattattcagatcatgtaactgcagcatggcttgggtttgtagtactgtgaaatatcacgggttgtttttttacaaaataatagatctttactttttcaaaattagaatattccctaatttctagaccaagaaggcagtttgctgtttttttcccattgaaagacaataaggattttaagaaatttcatgtttctcaattataagaaataatttcaaagattttaaaaatatttcagaaaatatttaaccatacaaattaaatatctttgttttagaaatcttaaatgttgtattagtaagataggttaattgtttttaattcatcacctatttatttagtttctctatcctttaggtattgtgttagatattggatatacaataaaaagatctaataactggctttgagttcacaatcccaaaagggagacaaaataattgtaacttatagcacattgtaataaaaaaacataggcccaggattattttgagaacaagtagaatttcagatggataaattcttagatggacataacctaatttcattggaggccgaaaagatgagcagctaaggaaacaaaaaatggcccctgaacatgaagtaagcgttagccaactcttttcttttgaattgggcaaattctaaagtcatgtctttcaacttccttgttcagcattttcttctctcttttgtttctacttttgtagaaaagtttagaattgatgcttcattattacaaatttattgcattatttcatttttgtattactaaattttaaaatacattttatttatatgaaattatatgacttctttacttatgtgaactttggttaatcttatttatgcttctgtgaatctctgcaggaaaacaaggtgtatattttgttagttccagtaatacaatggactgattatttttattttgtgtttgagttttagaatggatggtaacaaaaccatgttggtcttttgactttgttttgtggtggctgttgcaagtctggtatatttgccttgcattggggttgttcatattaaattgtaaattttgcaaaggccaactaggcttctatattttccttattgtgtgttccttcctctccagtcacccccatagaaggtttaataaattgttttttaagacattaatctgtaatgcagttcatctcatttatcattaacagaaatctgaaatttaaaagtatatcattttttatacatgtttaatttgaggtgacagtgggatatccaaatgaaaacatccagttaacaagtggacattcagataccaaattactaagatgagaaagattgtggacattcagataccggattactaagatgagaaagattgtacttactcttcacagaggaagtcttagaataaaagtcaaatcctatcatccttctgttgttaatcctccagtgactgcctcagtcactgggacttagtccttgcaatgacttttaagaccttacatggtatagcctcctattatctctctgaactcgtcacttactcccccatcccccaggttctagccatgctcacctctttcatgtttctcaaaaagcagttatgctcctgctttaaggtccttctacctccccttgccagaagcacccttcttccatttatcattctcttggctgtctctcccttacccccttcttacctttgttcatatctctcactttttcagtgaatcctttcctaattaccttacttgcttcccttccacttccacatacctaagcctctgtttttgctttatttttctccagagtaagtattataacttactttttaattttatgtgttgttgtctctgtcacaatagaatgaaacttaatgaggacagttattttgtaaattttattcactgctctatctctagtgcgtagaacagaggttggcatatggtaagagctcagtaaatatttgcagctaatttaaattggtcttctcccacactgagatcaatttaaagttttttggctagtatttacctttttgtctaatatttacctttgctgagtacatattaccaaggattttatttttaaagtcttttcttgaagttgaaactaaagttaacatatataatctatatgcttgtatatacagatgatatatataacataattttatttatatgtagatcatatagtaatatgcaatacataatacatggcatatataatctatgaacacttgattggactgtcatttagtaattcattcaccagatcctataatagactcacacaataggtgagagcagatgcaaactttatatattatgtttaggagattggatgttgtcctatgggcattgaggatttagtgaagggttttaagtaagagattgacatgattagatatacacttggtagcctactctggtgggtctgcagaggataaacttaaggaggacaagaccggaaacagggagaagctatttgggaagctattttagtagtccagcaaaagagttaaatgagaacctgaattgagatcttggtaaaggagaatatgaagaaaggatggattttggaaatatttaagaagtaatggccgggcatggtggctcacgcctgtaatcccagcactttgggaggccgaggtgggcagatcactaggtcaggagatcgagaccatcctggctaacatggtgaaaccccatctctactaaaaatacaaaaaattagccgggcatggtggcaggtgcctgtagtcccagctactcgggaggctgaggcaggagaatggcgtgaacccgggaggcggagcttgcagtgagctgagatcccgccactgcactccagcctgggcgacagagcgagactccgtctcaaaaaaaaaaaaaaaaaaaaaggaagaagtaaaaactgacatttgcttgcatgcaggatatgagagaagaggctagaatgactgcagtgtaccaactgagacaagaaatacatgagaaggaaataggtttatagagagactttgcccaaggacaggcaggtagtgtttaatccaggatttaaacaaagtttttctggccccaaagcccatgctggttttttgttttgttttgtttttgcttttattattatttttaattgttgcataataattgaacatatttatagggtacagtgtgatactttgatacatgtgtacaatgtgtgtgatcaaatcagagtaattagcatgtccctcacgtcaatcatttttcatttcttcgcattgggaacattcaaaatctactctttttgctattcgaaaataaattgttgttaattatagttacctacaatgctatagaacactagaactaatttctcatatttagctatacttttggatctgttaaacaacctctggctatcctctcctcctcacatccttcccagcctctagtaaccactattctgctatctacttctatgagattaacttctttagtttacacatgagtgagaatatgcagtgtttgtcctgtggctggcttatttcacctagcatgatgccctccaagtttgtccatgttgccatgaataacaagatttcattcttttttgtggctgtctggtatatttcactgtgtatatataccacattttctttacccatatatctgttgatggacacttaggttgatttcatatgttggcttattgtgaatactgccacataaatattggagtgcacatatctcttcaacatactgatttcatttcctttggacatatgcatatttgtaggattgctgtatcagatatatagtagttctatttttagttttttgaagaacctccatgctcttttccaaatggctacgctaatttacattcccactaaaaatgtatacgagttcccttttctcttcatttcttcccggcacggaagcccatccttttaactaccatgttgcagtaggcaaatctagttgactccttatcagggaaatgagaccttgaaaatgatacttaagcagggatgcttttgctgctgtttataggacagattagaagtgagaatgactagaattgagaagcaagattaaaggatcttgcattaatctacaattaggtatttggttccaaatgaggattataactgtatctgggaatgaagaaggaagagacaatcttgttaaggaaaaattagcaggatctgaatgccagttagaaatgagtaaaagagaagaataaaaaattgtaaaattatgatcctaagagttggaaattttcataaatagcacttctaatatggagaaattgaaaatgtgcctttttggttgcatgaaataataagttcatgattaaaatgttagggattatttgtacaccaaaaaatatgacagtcattaatcttcagaaaagggctagaagcagagtcagttttaagactagagaaaagggtttactcagacataccagttaaagccatgtgagagattctcagcattctttataataaagtttttcagtatggctgctaacatacagtgctgtagtttaataatttagaatttaaggaaaagctaaaggttctcccatttaacaagaattttctttccttttataagggtagatggagtaaaagagaatggtgaagtgtgttgtttggcactaataaaatccaaaaggtagtgatgattgtaagaccaaggataggattctgagtttcattagggattatatggagaataatggttgatgagggacagatcagcagggatctttaagtgcagttgctaactggtgcaacatgtgagagacctggctggtgtgctaggcggaatgactttgtgttctctgggatctataccaagatcctaacatagactaaacatttgatctttgttgcctgactacataaacaaaaggttaggagtatagaactcacagcgtacaattcaaaatctaaatctagtttatcactttaacttaattatgtatgtactatttatcttcctatcaatataaaatcccaaaccttatgagtgaaagttattttaaattcttttgaaaagcagcttctaaataataaatgcaaagaataatttctctgactccagttcaacattcggcttctacatttacacgtgaaaatgattattttctctttggaaaaaaaaatctcagtatctatttaattattctaaccatgttttcatcctaattggttgtaacaatttcacaaaggattattaattttattttacagatgtagaaaagaaagtatagaaacactatctgatgacctctgtacttttatgtagatcttcatgtttttatgatggctgtaattatctattcattgatatagcacaatttttagaaattttctaacagaggggagcttccctacctttatttggttggaaaggtcataagggtagatttcttactgttgtccttcctgtttaggtgtgaagtttttcaacatgagtggcctcggggacagttcatccgaccctgctaacccagactcacataagaggaaaggatcgccatgtgacacactggcatcaaggtaggaacactcctcttagtctatttttggcagagctgctttattactttcactgccacttcagagcttttgtttaatctactccaagttcagtggctttctttgagtctttcatactcaccatgttgtcttccttcccccagggtctttgcacatgtttctccctcaatccagcttgcttcctcttgatttcctttagttaacacctactcatccttcagatgccagcttagtcattacatacttaaagagagccttctcttccttccataactgttagatcaagttcctccattcatgtatctgtctcagatgtttttatagccatgatccataattgcagatttttactagtgtgattatttcatgaatttctggcttccccgctagactctaagctgccacttggtaaaggaccttgtttgttcttgctcatcattgtatccttagttcctaaaacagtgtgtggcttatatatagtaagaacacagtaaagatttgtcaaatgaatatataaatctattatacacctttaattgctatcttagaacattatggcattaatggagctaagaaatatcaggattttaaaaaatgattgtgtagttaaatatttggtttgttataaggaatatgaccaccttgaacaggctaaaaggaacctaatgctaaggagaccctcacaaatgccagatagagaagaaacctcaaatgccagataaatttaaatatgcatagttatattcagtcctattaacttttgattagtattgcattacatgaatataccacatttgaaaaatatgtttttctgcagatacataccctagctgctcatttaatattaggttaaaagagcagctagcttcctacctgagagcagcttcctagaatgagtggagattttattccactcatcttctaggatttagaggaaagtttttcaaactccacactattgacatttcgtgtcagataattttttgttgtgggggagctgtcctgtattttgtaggatgtttagcagtatccctgcttctacacaccaaatgtcagtagcatcttagttgtgacaaccaaaaatgtctccaaacattgccaaatgtcccctggggccaggggaaacaaaatcacctctagttgataatcactgatctagagagtaaagctacagaagactcttctgtccttggattacatgctgctttctctcatgggaggaaaaaaaggaggattttaacaggagaatgccagggctccaggctcgagaaagaaaagtgactatttatcttactcagctcagagagctgtcagagagagacaataacctgagtactcataatcacaagtaagtgtccagatgctgggaggaaggttgagatcaagatgcaatctagaagtgtgtcaaaaattaatgctcttgttttatctgtgtataaaatcagtccttaaaggaaaagctaagaataaatatcttttacatttaattttttgtttggggaaattttttaaatatataaaagaatataggcgaagacactatatcatacaacagaatgtaattgataatattttatcatattattattttgttaatatgttatcatatttgcataatcctgtttaaaagtaatacaatattaacaattgatttgtctgcagtattttaatctatttttaataattatgtgtgtattttatatatatacacacacaggtatctgagcaatatagaatattacatttacataatttatgtaatactgtatatattttctatagtatactttttcaacatggattttgaggtttaaatatgcatagatatattcagtcccattaacttttgattagtattgcattacatgaatataccatctttgaaaaatatatttttctacaaatacattccctagagataaacagcctgttacaaattttcaatgttacagccagccctgcagcaaatatcctcacacatatctcctattttatacataaaagtttctttggctgggtacagtggttcactcctgtaatcccagcactttggaaggccgaggcaggtggatcacctgaggtcataagtttgagaccagcctggccaacatagtgaaaacccatctctatttaagaaaaaaaaaaattgccagttgtggtgccgggcatctgtaatcccagttattcagaaggctgaggcaggagaatcacttgaacccgggaggtggaggttgcagtgagccaaaatagtgccactgcactccagcttgggcaacaagagcaaaactccggctcaaaaaaaaaaaagagtttctttaatatctaggtaaatttttatgttcactaggtaagtaccacattgtttttcaaataacaggcattgagaattcctcttttcccacattcttactatcactgttctcttctcatgttaacactttgccagtctaatgggtgtggggttatagtttaaagggcatttccatgatgattagataaactgatcacctttttttggtcttttactcatttatattttcctcctttatgaatttcttggttgtatcttttgcccatgttcctgctgggttgtttgttcttttattttttgtttctaagacttactttaaattttctggttattaaccttttcttgtttataactgatgcaagtatcttctcccaacctgttggttaacattatttatgatgtctcttgacatacagagccataggttttcatgtgtcaagctttttagggtcttgtttaataatttttcttctactctaaggttttaaatgtatttttatatgttttcttctaatacatgtttagggttttaattaatctgaaatttatttttgtgcatggtgtaatatagggacctaattgtatttattgtttttcccagttatcagtaatgacactacccttgactgtttttattccgttacctttattataagtcaagttcctgtatatatagggatctggttctgagctttcttatgataattgccttgatatgtgatgaaacaagacgttcttggttattcttcagatccatccattgtgctgaatcttcttatgtgttttaatggtttatctgtagatgctctgatgtttttgtgtatatagcatcattacaaatataaaagtttcatatcttttttctcttctttagatatcttaaagataattatattcacatttgctttaaaaatatttgaaagtaccatctccttgaggtttataactgaaatatgggcttcagctttaacaaaacaatgtatttgatatggtaaactaaaaatgtataattttgaaactgagtttatgtatgaatgccaccttgtaatgtttctgtctccccaaacagaattgaattctttaatcataaagagcatctgttagacatcagggtattgccagcattgtgcacagatccttggataggagtttctcagcaactgtttggtggagtgagatatctcatatcttcctcctgttacctcttctccattcattcattcttctaggagaatgaggattaaaacgttaatctcaaaagtataggtagctgtgtttatgcttgttgaatatttccaattcaactcaagtacatgttaagtgcgtactcttcagccagcaccatttgcatgatgttttaaggatacaagtgaaatgtgagacatgtttctgtctttagggagcttacaaatctggtcatggcactcattctgcttcttaaatttctgggctccccatgtccctgaaaataaataatcataatcaaaatgatgataatagataacatttactgagctaaaagtatataccaggaactctgccaagcattttacatgtattctcttttttaatataaaaccctggaaagtaatgtcattatcctagttttacagataaggaaatcgaagcttagaaaagttaactttccactaagtgacttgcctagggttgcatggctagtaaatgacaggaagtttgggcctgtgcatttttttttttttctgttaagggacaggatctcattctattgcccaggctggagtggagcagcacagtcataactcactgcagcctccaactcttgggctcaagcaatcctccccactcagcctcctgagtaactaggactacaggcgcacaccatcacgcctggctaatttttttttctttttttttttttagagacagggtcttgttgtgttacccaggctggtcttgaactcctagcctcaagcaatcctcctgcctctgtctcccaaagttctgggattacagatgcgagctgctgtatccagctgaacctgtgcttttaagcagtataccatgcattttatcatggcaagatccctgtgatctgatctggaccacatctcttgcccttttgtttcttatctatagtttagctatactgaactacttatagattcgttaacttggtatcttcactcttactttatacctttgaaaaagctgtttttttctttcaggaagccagcctctccctaccactgagttcatgtatcttgttctctaggtctagatgtacttctatagtattctagtcttgctgcatagtattgtaatggcctgttttcttcattttctgactaattgagagctacatctaatttattcttggatcctctagacacagtagtacatggttatctggcatataataagtataggagtatttgttgagttagctagtttgttgaaggaaaaaaggcatgcacctgagaaattaactcagaatagcattagctagaaggtctgcaatatgaatggtaataaaagggattcgtaaagagagaaatatagttgacccggagtaataaaggaagacttcttttccattaaggtagaatttttttgccatctccagttttgactttgaacatatctgccctcattttatctccttgcttattggttacttcatttcatggtgatttttcctagtctcaatctctagtcattttatagacaccttgccagttcattacttttagcttcttgctttctctatcccctctctgtctgcgtgtcctgcctgttctatcacttttttcttttcctctatactgtcttcaagttctttggttttacacaaaacttaccatcaaaaacatatttgagagttccacgaagagagtccagtttactcgtgttgcagtttagatccatggatttaaatagatcagaactttagactgaatctactacatatatcttatatcaattagtttctctaaggtaaaagtagatgtcttcaaacactgtgaggttgcagagctgaggttccctaaaaccttgtatgtatcaaaatgtatgttactcattttattcatgccttggtatgtaatttgtcaaaatatcttgctgcattttcttgttgtgggagttataaaatacaattttaataactacaattgggaaaactcatcaataatgaaagacttaaaagacaaacgtgatcgtcacagttttaaaatttggttttgttttggtatttgtaatattttgttttgtgtaggtaaatacatttgattagttgattcttttcaacttactatattgttttgtgctattgtttttatagtctttaatattattaagaaaagtaaatggggctgggcttggtagctcacgcctataatcccaacactttgggaggctgagacgggcggatcatgaggtcgagagatcgagaccatcctggccaacatggtgaaaccccgtctctactaaaatacaaaaattagccaggcatggtggcgtgcgcctgtagtcccagctacttgggaggctgaggcagaagaatcacttgaacccgggaggcagaggttgcagtgagccgagattgcgccactgcactgcagcctggcctcacagcaagattccatctcaaaaaaaaaagaaaaagaaaagaaaagtaaatggtatcttaattgttgccaattatgagctctatagcaactgatcttcccctcttctgtcctcttttttctgttacttttatatgtagccaaatgattttgattgctgcttataaaacaaagagctacttgtgaccacttcttcctattatattagtttgatgaaaacaaaatttcaaagtcatacttaactgtctttatatgtattacaaaacaagttgtctgatgacttggctaaataaaccagggctaaagactggaaggcaaaaatgaatcatagtcattcagtacatttggtatatttttttaaaaaggtgctacctgtatgcaccttgttctcattattttgctttaagataaattgtttgattttgtttattgcatttataggaacttacaaatcatttttttttctgtctttttaggacacagctgtatacagaatacattgttcactgtaccttcgtctctaattattattatccttattttgcctttgaatggatacttttttgatgaggatcaactaatggtttaatcataagaattaagagtttatcagagttattggatttctaattataacttgtgaattctattatcgtattctctgcttaatttgtaacagttatttgaaaattcagatttttctatttcaagaagttattcataatataaagtagttccaaatgtaactgctgtgtttattacttgtttgcttttactatctagtaattgttatttgaaaatattcaagatgtatatatgattggggaaatacatctgttatagcagtcaatttactttatatattttagccagaattgttttctaaattttggtattttgtaatgtccactttttagatgtgaatttatatcactttctaaatctggttttatattttcgataaaaataaagatctcactaaatgtgtaagcatagatacttgatcagagaaggaaatatggtgatacaaatgtacactaactggattttctttgtgtaacagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaaggtaaaaaagaaaaagaaaacccatggctgtgtgctttgttattaagacatttataatatgtgattttactttattattattattattattattttattattattattattttttgagatgaagtcccgctctgtcgcccaggctggagtgcagtggtgcgatctcggctcactgcaagctccacctcctgggttcacaccattctcctgcctcagcctcccaagtagctgggactacaggcgcctgccactatacctggctgatctttttgtatttttttagtagagacggggtttcaccatgttagccaggatggtctcaatctcctgacctcgtgatccgcccacctcagcctcccaaagtgctgggattacaggcgtgagccaccgcacctggcctacttttttattattaaaaaattatattgaacattataattttataaagaaatgtctttgttaagatgctgtttattttagaaagtgaacctgagaatcttcttgttataacaaagtgtcttattaagttaactcaaaaactggttgctttaggagattatgggactcagtatcataggggattgagtcagaagacacaagttgtggagttggacctgaggccctagcatagagttctttaggacagtaactccatgaagagaaaaatctccacttatatgaggaagtttgtctctacctgggctcttctctgaaaaaacccggattttttttttttttgagatggatcctcattctgtcacaggctggagtgcagtggtgcgatctctgctcgctgcaacctctacctcctgggttcaagcaattctcctgcctcagcctcccaagtagctgggattacaagtgcgcgccactatgcccagctaatttttgtatttttagtagagatggggttgcaccatgttggccaggctggtgtatttttaagcttcatatttttactacctatatttactggaaccccataccatcaaactccttggttgcctaccagaaataaaggcaaagcactttgaagaaacaatcccacaagctggccccatgggagtgccacagaaaaagtgcttctgagggtgattttacactgcaaagttatttaacatatgaggaaataatctagagtaacagcacaaataacaaacagaaggactaaccccaaagaacttcagattattagcattaaagttttataattttaagattttagaagctggaaaacagatagtctagtgacaactgatttagcaaacaggagaaaccgtactgtaaaactgcagagaggagcactagcaagaggctctctgccccttccctgcttggtctcgaaacactaacagcctggctcctactccctaaattgggggtggcagtatacctctgggtaaactgagcagtcggaagatgaagtcatgtgggggtgatcctcaaatgaaaaaattcattccttatcttgcccccactcctcacctaactgccagtcaactatttaatgtgaacaaaaagccaggtattgggggaaagcctgtaatataaaagagagcaaaccaagcaaacaaacagaaaaaagggaactcagaggaagcagaaacagtgcagggaactgaagaaaacttaaaaagataccagtccctgggagacatgagggaaggtatttcatcaaaagatgagaataagtcctataaaatgaaatattcaaaagaagaaatagcttttggaacttagaaacaggatagctggaaaaaattttacttctttacctttgtttcctcacactctctgccctgaccagtggcaggcacactctgcccctgctatttacagttgctgttccttctgtctggaatgctctgtctctagatatccacatgctttattcacctctttcatgtctttgctcaaatacgtcttctgagtaaagttgttcctaactaacctatttgaaatatttttaaaaacagaaaaaaaaatctatgcatctttttataccttccttattttccccacagtactttttacatctgacatatgacatactttatatattatttgcctgcccccactagagttccacgagggcaagcgattttgtttgttcacgactatatcctcagtacctaaaacagcacttggctacatagtaggctttcaatgcatatttgttgaatgactggatgaagggatgtgatttgaagaaatctcttagataataagcaatggaaaatgagagaaaaaataagaaacttataggattagttcaggaagtctaacatatgattaatcccagaaaaagagaatagaacaaatggaagggaataaatgataagagaaataatgcaaaaataatgttctcagaactagaagtatattagtttccggattgaaagccctcatgtagtgcccagcacagttgttgtaaaagaaagataaagtaacttataccaatgcacaatttagtgacatttcagaacaccagggagataaacaagagagaagaaaaaacaggtctcacacatactagattgctttcagaataggttcagatttctaaataacaacattgaaaactagaattctagacccagaattctgtgttcatccagttgaagttatgagtgccaaatagacatgctcagacattcagagtctcaaaggtattacctccagttatacctgtttcagaaatctctatccaatccaagatagtaaagctagaaagaagggcataggatcttaatccagggaaaccatggaatcttaacacaaagaaaggtaaaaggagacccaggattacagttgtgcagcaacctagaaaatagccagtcctagttggagcaggtggatagaggactctagggaacatttccatagggaaaaaaaaaaggaacgcataagagtatctgctaactgactgaatcgagatgaatttttcagctctggaggggagtttagggttgaattaaactatacgtaagatctgaaacactaaatataaaaaaagaaatgtaagttataacacacacatcggctcccttataaagtatatttatatgaccctagtgacatatatattaaatattggttacgcaaaaaattgttaaaactatactgaaagtaagagaggaggggtaatttgtatagcaggttggtgtaaataaattatttacctttcatggtagcatgtcagtaggttatgtctaacatggacaaaatcaggttatagcaaattagcatgttactaagaaatataaagcatattaggatataggctaggttagtataacaacacacccaaaatacaatggttttaaaaagatggtctaggaaggtgtgagggattgactccttccatctttttggctctgccattcctagggtattgccattatccatgttgttagacatggcccccttgtccatgtcccagctaacaagaaggagaaagaaaaaaacaagaaggcatgcttcttttccattacagataagacccagaaattgcatgtcacttctgttcacgttccgttaggccagaaactagtcacatagccattcctaccttaggttttccctaaaatgttagatattttgcacgtcacacaaaattatttaatctacttgaacttgatagtttgttttttagaacttgcttacaaacaaaatcctttcttaccctcatgtaataaaacacatgaaataatgaaggaaatgtatcttaaaatgagaaactcctgcaccataataataaaaagataacataatttaaaaataaagaccctgaatagacatttctccaaagaaaatgtacaaatggccaacaagcacatgaaaaagatgcccaatatcattagccattagggaaatgcaaactagaatcaaagtcacataccatttcacactcactaagatggctataatcaaaaagataaggctgggtgctgtggctcacgcctgtaatcccagcactttgggaggccaaggtgagaagatcgcttgagcccaggagtttgagaccagcctggacaacatagcaagaccctctgtctacaaaaaaataaaaaattacccaggcacagtggtgcatccctgtagtcccaactattcgggagaccaaggtgggaggattgcttgagcctaggagtttgaggttgcaatgagctgtgattgtgccactgcactccatcctcagcaacagagcaaggagtgtcttaggaaaaaaaacagaaaaaggtaataacaagtgtgggtgagaaattgaaagccacacatacttctgatgggaatggaaaatgatggagccacgttggaaaacagtccaacagtttctcaactggaggagagtttggggttgaacatagagctagctatcatatgacccaataattccagttctaggtgtatccccaagagaaatgaaaacctgtccatacaaaaaatttgtacatgaatgttcacaaaaacattatcacaaatagctgaaaagtagaaactacccatacgtccatcagctgatgaatagatatataaaaggacatataccactatgaaggactattattaggcaataaaaaggaataaagtactgataaataattcaacatggttgaaccctgaaaacatgctaagccaaagaagaagccgagtcacatatgaccacatattgtatgattccatttataggaaatgtccaaaaaaggcaaattcattgagacaaaaaataaattggtagatgcctcagacttaggggtattggaaaaatggggagtgactggtaatgggaatggagttttttgggaggtgatgagaatattctaaaattggttgtgacagtggttgcacaattctgtgaatatactaaaaatcattgaattgtgtgccttaaatgagttaattgcgtgttgtgtaaattatagctcaagaaagccattattataaatagtatgtgagataacattttacaccataggtttgcaaaaattaaaaactatgatattgtttttcagtgaggatgcagaagagcaaaaccaatgttacaacctctttggagagcagtttgtcaatacctagtgatataagttacgcagaccttatgatcctgaaatttcactctagtatttatcctgaagaaactgtgacatgtgtacaaaagaggaaataccaaaaatagtttattatagcactgtagttatcaaaagacctaccagtaggggaatagaaatccactgcagattatttatataatataatactcttaacagcagttaaaatgaatgaatcaaacctacatgtatcaatgtggttaaatctcaaacataatattgagtggaaaaagtaagttgaaaaagtttgtacaattgtcccttggtatgtgtgggggattggttccatgacctcccactgatactaaaatctgagtatgctcaagtccctgatataaaatggtgtagtagccaggggcagtggtgcatgtctgtaatcccagctacctggaaggctgaggctagaagattgcttgaatttaggagtttagggctagcctgggcaacatagcaagatccctgtctcttaaaataaaataaaacaagcaaaatttaaaaataagataaaatgtcatagtatttgcttataattgatcctgtcatgtacttttttaagagagggtctcactctgtcacccaggctggagtgcagttgcgggatctcggctcactgcaacctctgcctcccaggtccaagcaattattgtacctcagcctcctgagtagctgagattacagacatgtgccaccacgcccggctaatttttgtatttttattagagataggatttcaccatgttggccaggctggtctccaactcctgacctcagatgatctgcccatctgatcatcttcccaaagtgctgggattacagacgtgagccaccttgcctggcccatgtacttttaaataatctctacattacctattaaaatacttactacaatgtaaaggctatgtaaatagttgttgtactgtattgtttagggaataatgatgaaaaaatctatatgtattcagcacagacacaattcattttcaaatatttttgatctgtggtcagtagaatccatggatgtggaggactaatggtatatataactatacatttatgtaaaccttaaaacatgaaacaataacattgtttatatatatgtttatatatataacaatatattgtttatgaaatcatacatatgtagtaaaagtataaaaaaatgcttaaaatgattatggcaacctcagaataatggttacttctgaaaaaagggacagaggagggagggcagggctttctctgtatttgcaacatgtatttatttaaaaaggaaagatctgaggcaaatgacgttaacatctgtgaataccgaatggtggctatattaatatgtgctgtataattttctgtattttttggaatacttgaaatccttcttcttgtttttgagacatggtctcatcctgacacccaggctggagtgcagtggcacaattatagcccaccgctgcctcaaattcttgggcttaagcgatcctcctacctcaccctcctgagtagctaggattacaagcatgcaccaccacacctagctaatttttaaaattttttgtaaaaataaaggactcgctatgttgcccaggctgttctcaaactcctggcctcaagcagtcctcccacctctgcctcccaaagcactgagattacaggcttggggcactgcacccaacccggaaatacttcctgttttaaagtgaaaatatgaatttctgtgctcaataataccatatttggcttttggttaactagtctgacagatcagaaacttttattatttaaatatgattctgctttaagatgatgggatatgcaacatcacctcacaaaagaactcccaattacttagcagtttcagttttatcaatcagagcatcatggcacgaatgtgaaatgttagtgagttcatgcaggctctcaaaaggaaaaatcatattttcattctctcttcaatggcacttgatcaaatcagaaaaagaaagagaaaacttgaaataatttttcttttacaacttacccatttctcaaaacttctggtatggactttttaaaaaggcaatatatttatagcatttttctcattgttgaaacactggatgtagtattcaaatgttcatgctaccatgtattagttgtatgttttcaggcacattacttaacctttgtgatgttccattttatgatccataaaatgagtataattaagattagtgtgaaagtgcctagatactgactaaatgttatttgaatttgaaatttggtggatctatgtcttcgtaaacttgactttatggaaataagctcttttcagatatgtgatttttttaagtttctttattatagagaaatcaacaactgatgacgatgtacagaaatcagacatctcatcaagtagtcaaggagtgatagaaaaggaatccttgggacctcttcttttggaggtaggtgtcttcattgactcagaaagtgattaaaatctttgttgtagccagtttggttttttcttttttaaatgccttatatccagttaataaattataaaacaaagtaaagaactttttataattattttattatgagaactatttgacagttgttactgtttcagaatcaaaagtgaataatgaacatgagaaattttcatgaaggcattctaagcagtgagatggaaaacttgaagcttattatatggctttgccttttatttctgtggtggttaggcctagttgggaaaataaaatattaatattagatttacttagctagctagtgttatctatatgtataccatagaattttacttttgaatgaaggatcccacagtttattgcagtacgtgattttctgcagttttctgaataaaaatgtttaaattgtttatataaacattctaagagaattactattttaactgtcaaactttgtaatgtgaagaacttttaaatttgaatggctttgtaattactgtgtaattttcacccctgcattttctatctaatctttactccctgcattctcaatatagatgtcttgtttccaagcatcctcattactttaaatgctttctctcctacatgaatgtttaaagacatatgtatgtatgtgtgtgtgtgtgtgtgtgtgtgtgtgtatatatttctatctctaggtctaattatatatacttatttatggcccttgggtacccctttttttttttttgagacggagtctcgctttgtggcccatgctggagtgcagtggtgtggtctcggttcactgcaagctccgcctccccggttcatgacattctcctgcctcagcctcctgagtagctgggactacaggcgcctgctaccacgcctggctaatttttttgtatttttagtagagacggtgtttcaccgtgttagccaggatggtctcgatctcctgacgtcgtgatccgcccacctcggcctcccaaagtgctgggattacaggcgtgagccactgcgcccggcctatttctctttttaaaaatataaaataaaggtagcacgggtaaagaatgaaggtactagaagaaattttcgcacatctaatgagagggtaatattataatgtatttattcaacaaagatttgttgaatacctacagtgtgttagacactggatatctacatcatggaattattttaaaaattaagtgacacaatttcttagcagagtactttatacatagttagtactcattaagtccagtatgggcatttttttttaagctcatttcctccctttgctgtctaaaattcctctgcctgctggtcagagttctgcattatctgactctaaccctcctgtttccattggtccataagaaaactgcttcagagaggtctcactatatcttgcacatgcattctagcttccttaacttgctttgcaccattccctacatttctttgtggcttttgacacttactgaccactcattcccactaccttacacattccatggcccctttcacagtgttctttctctacccctctggttactcctcagcctttttctcagatttctttccttaattgcctcttaaatgttagtatcccctgggagtctagccttggctctttcccttttttaattctgtgcacatttactgggaaggtttatctgtgtctttgtctatataacatatacacatatatgtgaattacatatatgaaatcagttgcatttctctgatttgaagcaatagaaatcaactctgactaagcaaatatgaatttattggaatgctatttggatatcatagaaccatgcttggaaatgggatgaaatcaaaatatcttaaggaggctagaaaccaaaagctttgttaatggtctcttagaaagaaccatctgggcagtgccctgctgctagaatgagtgtactcctgctatgtttagctttttgtaattattctcaagattcacatttgaggaggaagtctcccaatggcctgattaagaatcccataaggctttgtgtagtggggaagaaaatttcccagaggaaatccgagtattctttactaggggaaaagatgatcgtagttaaaaacaaataaacagtccgggcgcggtgcatcacgcctataatcccagcactttgggaagccaaggcgggtggatcacttgaggtcaggagttcaagagcagcctggccaagatggcaaaatcccatctctactaaaaatataaaaattagccaggcatggtggtgagcgcctgtaatcccagctactcaggaggctgaggcaggagaatcacgtgaacctgtgaggcagaggttgcagtgagctgagattgcaccattgcactccagcctgcgcaacagagtgagactctgtctcaaaataaataaattaataaataagtaaaaaataaacaagagacccaaatgattactatatgtacctgtgaatcacaaaggtctatccttagcccagatctgtcttccaagcttctctttcaatacatcctgctgccttttaaagatttccaattttcctagagtggcctcactttggaggttggaggtattttggggtttctcagcagacttctgtggcagtggggtcacctcaagttttggaacagcaatgaaaaatgaccagtgctatgataacatccagtttactcatgtgacctgggatagttccttttgtactatccgtcccagatttgttgccataatcatagacatgacttggggaggagagttgcttgtgctcccttttcataagcattctggaaagaaatcaaaacttggatgtggtgctcactttggcagcacatatactaaaataggaacaatacagagaagattatcatggcctctgcacaaagatgacacataaatttgtgaagtatttcatatttttcagctgaacccaacttataccacaggcaaaaccaagggcatcaaagaatataaaagcaaaaagctccattgaaaggacagcacctttgaacattaaaggagcatcagatgcgaaagaaccagtaagaactctggaaacgcaaaaagccagagtgttttcttaacctccaaacaactgcactaactccccagccatggtttgtaaccaggctgaaatgactcaaatgacagactaagaattcagaatctggatggcaacaaagatcattgagattcaggagaaagttgaaacccaatccaaggaatcttaggaatccagtaaaatgatattagagattaaagataaaacaggtattttaagaaagaaccaaactgatctgataaaactgaaaaactcactacaagaaaaatttcataattggaaatattaatgacagaatcgaccaagctgaggaaggaatctcagagctcgaagaccagttaactggtcaactcagaaataaagaaaaaagaataaaaaagaatgaacaaaacctctgagaaatatgtgattatgtaaagagactaaacctacagctggtatccctgacaaacagggagagtatattagtcagttttcacactgctataaagaatacctgatttggggccaggcatggtggctcacacctgtaatcccagcactttgggaggccacggcaggcggatcacttgaggtcaggagtttgagaccagcctggccaacatggtgaaaccccgtctcaactaaaaatacaaaaatcagcctggcatggtggcacatgcctgtaatcccagctactcaggaggctgacacaggagaatctcttgaacccgggaggcagaggttccagtgagccaagatcacgccactgcactccagcctgggtgacagagcaagaccctgtctcaaaaacaaaaaaacaaacaaacaaaaaaaacaaacctgagactgggtaatttataaaggaaagagggatgtttttgtttggttggttggttttgttttttgagagagtcttggtctgtcacccaggctggaatgcagtgacacaatctcggattactgtaacctccacctcttgggtttaagcaattcttgtgcctcagcctcccaagtacctgggactacaggcatgtaccaccatgcccggctaatttttgtatttttagtagaaatggggtttcgccatgttggccagtctggtctcgaactcctggcctcacatgatccaccccggttggcctcccaaagtgctgggattacaggcataagttaccatgcctggctggaaagaggtttaattgacttacagttccacatggctagggaagcctcaggaaatttacaattacagcagaaggcaaaggagaagcaagtatgttcttcaccaggcggcaggaaagagaaagagtgagagaatgaggatgtgccacacttttttttttcttcaacttttaagttccggggtacatgtgtaggatgtgcaggtttgttacatagctaaatgtgtgccatggtagtttgctgcatagatcaacccatcacctaggtattaagcccagcatccattagctattcttcctcatactccccctcctgccacccctgcccccaacaggcctcagtgtgtgttgttccctctgccatgtgtccatgtgttctcattgttcagctcccacttataagtgagaacatgcagcatttggtttgatgttcctgcattaatttgctgagaataacagcttccaactccatccatgtccctgcaaaggaccatgatctcatccctttttatggctacatagtattccatggtgtatatgtaccacattttctttatccagtctatcattgatgggcatttaggttgattccaggcctttgctattgtgaatagtgctgtgatgaacatacatgtgcatgtatctttataacagaatgatttatgtctctttggatatatactcagtaatgggattgctgggtcatatggtatttctgcctctaaatctttgaggaatcaccacactgccttccacaatggttaaactaatttatactcccaccaacagtgtaaaagcattcctttttctctgcaaccttgccagcatctattgttttttgactttttaataatcaccactctgactggcatgaaatggtatctcattgtggttttgatttgcatctctctaatgatcagtgatgttgagcttttgatatgtttgttggctgcatgaatgttttcttttgagaagtgtctgttcatgccatttgcctgctttttaatggggttgtttggttttttcttgtaaatttgtttaagttccttgtagactggatattagacctttgtcagatggatagattgcaaaaattttatcccattctttaggttgttcactctgatgatagtttcttttgctgtgcagaagctcttgagtttaattagatcctatttgttaatttttgcttttgttgcagttgcttttggcattttcatcatgaaatctctgcccgtgcctatgtactgaatggtattgcctagatattcttctagggtttttatagttttgggtgatgtcttttattcccggaactttgtcccatcacagtcactttggtagtctcatttaaagccagggccctgtgagaagccttggctaatgtgaacccttccgtgtgacacacggtggtcttcttcaaaggatgacatcctgggcagagtttggaaaagttctcagattgattactgaatgcataggcatttgttgtcttctctgtatgcagtacaacataaaaccagctgtcaggacttggaggaataggaagattcctttccaggagcacactttgaagttaattagataaacaacatatgagggaaacttgtagaacaagaacaagtaataacagattatattaaccagatatacttttagaaaatagagatgcttctatattcataggaatagtctcaaaaattattccctgaaatgttactagtctcttgagggtggaattctggcaggtcttccactatcaacctcatttttacattttaatctttataagtatatatttataatacaaagcaagttaaattgtatttacactgatgcaaagaacatttttaaagaagtttcaggtctatttttgaaaaataaatctgtttttaaattatttctatttttatataaacttcaaggtaagtaaatggacattgatcacctattatgagatttatagctaatctaaggggttttataaacccaatttagatatgagtgtactttcctgtgctcatctaaacccaaaatattttaaaaaagagtttatctagtgttgagattttaaagattattaatcacgtccctatctcctttgcattatggactaagtaagtcacggcgatcgggtagaataaaaatagctttattcctttttgttcttgctaaagaaaatattagcaatattttaaatgagaacaatgggttgtgcttcaatcttgttttaaatcttggttatattctttgtgatggagtgataatggagatgtattactaaatttcatttattttaatatttggtttaaataatcttgtccattcatctgttggcagacacttagcttgatcctcatatcttggctattgtgaataatgctgcagtgaacatgggagtgcagacatctctttgacatactgatttcatttcctttggatatatacccagtactgggattactggatcatatggtagttctatttttaattttttgaggaacctccctactacttcccataatagatgttctcttttcttcacatcctcacctacgcttaacagatatgaagtgatatctcatcgtggttttaatttgcatcaacctaagtgtccaaaaatggatgaatggattaagaaaatgctgtgtatacacagagcggaatactattcagcctttaaaaaggaaatcctgtcatctgccacaatatgtatgaacctagaagacattatgttaattaaaagccagacgcagaaagacagataccacatgatctcacttatatgtgggatctaaaaaagtcaaactcataggagagagtagaatggtggttaccaggggctgcgtgaagggttggggggattggagggatgttggtcaaaagatgaaaacctttcaattagatgggaagaataagttcaagagatctattgaacattatggtgactgtaattaataacaattattttatacctgaaaattgcaaagagagagcttttaagtgttttcaccacaaaaaaaatgataagtatatgaggtagtgcttatgttcattagcttgatttggccattctacaatgtatacatatttgaaaacatataccataaatatatattagtttttctcaattaaaaaacaatcatcttagctgaaaaatgcacctctcaaaaataaggtagaggcaaatggaaaagtatatcattggatgtgtttactaaattacgatagtcatttttaaatcctacccacaaactgtgcagaggtttttattgaccttccagtttccttgattttaaaaaaaatgattcttccaaacatcagaagatgttgcattttcacataaaaaaaaaaaaaaatagggctgggcatggaggcccatgcctgtaatcccagcactttgggaggccaaggtaggtggatcacctgaggtcaggagtttaagaccaacctggccaacatggtaaaaccccatctctactaaaaatacagaaatcagcggggcatggtggcacatgcctgtaatcccagctacgtgggaggctgaagcaggagtatcacttgaatccaggaagcagaggttgcagtgggccaagattgtgccactgcactctctcaaaaaaaaggaaaagaaaaaaagggccaaagcccactgagaatctaattggaagatttttcaacagaaaatgctctaagattttaaactgatgagataagataaattatacaagctattcaggtcattttcagtatcacgtcattttcagtgtcacgacattttcagtatcacgtcattttcaggaacaaaattgtaacagtggtaacacttccaaacatccattttcacatgctatctctatagcattagtgtctttttaaaaagcagtttactttttattcattgttaaaatttcatcttaatcctgaaggaaaaaaaatttgtttactttttggagagtatctgctagacagcaaacttggtaccctggccttttttttttttttgagacggagtcttggagtcttgctctgtcgcccaggctggagtgcagtggcgcgatctcggctcactgcaagctccgcctcccgggttcacaccgttctcctgcctcagcctcccaagtaactgggactacaggcgtccgctaccacacttggctaattttttgtatttttagtagagacggggtttcaccatgttggccaggatggtctccatctcttgacctcgtgatccacccgcctcagcctcccaaaatgctgggattacaggcgtgagacactgcgcccggccccgtggccttttttaaaaggaaaaatgagtaacccgtcagcattgttagataggtcttttaatttcgccgtagataaccagcagaccctgtatgatccaaaggatttttatggtcattttacattttgttacaaaattctgtaaatgttctattttttcaggatcttgattttattgcttatatatattctgcagcaagtaagctgcaacatgttgcaataaatgaaaagattacaaataagtaaggtgccacagtcaacctctgcattctggctcttcctcgggataccagggtttgtgtgatatgtgactgtctgcaccgagtcaggcaccatagtgttaatatgcttaagcttcatgtctttattatgttttagattacaatatacatagaggttctaacttttcccgtgctcccttgtggatattatatgccccgtaggacgcatatgtcttcttttggagacccctggctccatctcagtgcataggaagcccctgtgatttggctcctgtccacgtctgctgactcgccttgtaccatatactccagcagctgcaaactgcctgttcgttttctttttgtgctatgctctctccacttcctggaatgttcttccttcaatcctcttcctccccaactatgccttttatatgttaggtaggggtctgtacctttctttgacccccaccctgatcccaaattaggcatccttctgtgtgcttatggactattttgtgtatgtctctgatctgcattttatcactgatattttattatgtttatgtctctctctcctgcgtatcacaatttccttgaggacagagaccaggtcttgacatatatttctgatctcttttttaatagaaaaatgtatagtttaatttttcttttatctttcaacctccaaaccatttttttcttttggttttgcaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactaggtaaacagaaatgtgtttttaaaaagaatactagctctctgtatcttctccttatataatatgtataatatgtgattattatatttataatacacagtattatatatgttataatatgtgtttaaaatattttttcagtgtggtttcagtctcagatataaatatgaaggggagtttcatcaaatagctgatggagagtattcctttcagcttcttcctttatactgtgtgaattgttttcaattttgattatgttcaagaaagagacaaatgtgtatcctttccattaccctgctcacagaaaaaagaatagaaatgagaaagagagggagtgagaaggagggaagaaggaaagaatatatgtcatatatctactaaaattaatgtttttagacttaagtgctttaactgaggaattccaagtatggttggatgggctattcgctgctgaggagcctagctgagaggatggatggagtctaatttctagtgtctgttctattcactgaaccctgtgccttggggcagggctgggaccttaggagttaggggactttttctaattcttgtaaaggcatggatggactaacagcaagcctttgtttacttcttgaattttcaggctcctctaaagtttttcagtgctcaagttctagttactcctggtgattgcattgctacctttacatctgagtgggggtgtttttcaatagtcagtgtatattttgtagataaataagaaagttttcatattacatttcagattccattccattttagattttttgttactttttttccccatagtttatttgttcagtgagctctgaaataaaagcgatttaaaatgcagataaatttaccacacatcagtttttcagacagatactgtgtgataaagtatctgagttggagagttaagactctaccataccgtttagtatgggaactgaggcatgtggtcagggaagtcaaacaatgtaagattcccctgatgtcactataggtaatacttaattaagatttctttccttggccatggactgtagattcttttgctctactgttcacaaattttgaggactactggtgtatggattgaactgagctattgcattttattttgtatcaaaaaaactaatttaattttagtctcatgttgggtaacaagatatttgttgggtttagcagccttcctggttggaaagaggcctacagtcacagaaaacaaggatgagctgttttctgactcctgaagaacgggcttattgtttgtggaagggccacattacctgttctgcctggttctcaggatgctgtagatctatgactatttgggttcccccaaatcactgccagtagataaatttggagggagtgtcatctactagcttatgtgcttgctagtggtgctgctcccggctgcttacaagacagtgatcctcagctggcctgacaattcattgttgcctctctgagcagcctttcacaatagggaggaatgtgaagtttttgctacagagatatctttctctcattcccccaataatggaagaacagaaacattgaaaaaatactactactttcttatacaatagtgtagagaagcaaagatagggcaagctcagtaataatagaatagatcacctaatcttacagtgttggttgatcatccattagaaaccaatgagatggtcccaccaaaagaataaaggccaactacactaacttagaaaagccaatagcttctttcaaggtatttccaaaaagcatttaggagaaaataaattatagtacctatatttaaacctttattattagaataatcaaagtattagaaaattaaggaaagagaccaagtagaatcattttatgtgtaattcattatcaaccactggggaaaaaaatcaaatcaagattcagaacctatcaagaaagaaatttgaagaaaaatttaggatcattatttatatatatatattcaccttatatacatatatcacatatacatgattcaaagcactgccttcttattttttgatttgttctttccaaggagaaattttgaagaaaaaagttaaagtcaaacttttaaaattgcttttgaatttacagatttagaagatttcagtgtctaaaatctgtactttttaagcataacattttatttataagaaacaaaatctgaatgctgggaagctggtatggtgagaaattttgtccaaaagaacaagtatacatggatatacttatacttgcacagatggttataaaaagattatattgtgaaaggctaagattacaaagaatgagatgttagtgaacatagacttatttgtgaaattctaataaattggaacttgaagtttgaaaaaaaattttaaaaagcaagtcgttataaattcataccatttatatctcaaatgatggagacacgatagtgcttaagagcatagcctttctggtataaaatagaaatggctgtgtctgactctgctacttaattagcagcgtgaccttgaacaagacacttgaccccctctaggcctcatcgttggtaggaaggttaaagggtaagtgttgcttagcatatttcctggctggtattaaattctttttgttttagctgttattattcctgtgactggctttatctaaatgttttggagcttttaatttctgaatgatagatctacaattattattaacaactactagctggttttgattatgcttttatcttagaaatcaatgtgaaggaaggacaatcttgtcctttcatagtgtgctcttagaagcacatagaaattattctgtagaaattgaggcaaatttttttatagatcacattcagtaggatagttccgtttttcttatttctttatattttgagacagagtttcactcttgtcacccaggctggagtgcgatggcatgatctcagctcactgcaacctccgcctcctgggttcaagcaattttcctgcctcagcctcctgagtagctgggattacatgtgcccaccaccacgcccagctaatctttgtatttttagtagagacaggggtttcaccatgttggccaggctggtctcgatctcctgatctcaggtgatctgcctgcctcagcctctcaaagtgctgggattacaggagtcagccaccacgcctgaccctgttcttcttttttgaattgtagctaaactgctacttcttcctgtacagggggcttttgttagtaattttttaatactttgggtttgttttactaggttttttaaacattatcaggggcatttatccttttaaagaggaatcatatggtgagttaagaaaggacttgcatgaagattaggcatgctgctttctagctagataatgtaaactacctcctcccacacacaaaatactgaattttgtcagaagctttgtacctctagtatagatctatcctcttatttccattccacagagtattcaggaccttatgtgagtgatgctgttgtctttttgcataaatatgtagctcagtgcctactgtttaaaagaagatttaggttcaaaaaagttttgtcatggtaacctattagtagttcagttaacttaaaaaaatcgaattaatcttgtgaaatcagggtatctagaaagatcacctaaaatatttagcagcttatatttgaggggcctataagtttggaattgaacttgctgttaattattgttgttgttttaagaagataatgatagttgacatgtaaattattaccagaatgactttagtttctttagttttggtgattatttttcaacttttttttttcacatctcagaaagtgttttgtacaacttagatatactgaccaccataacaggtcatgaaattaaacttcaaggaagcgcctttctcctcttcatcactgtatgctcttctcttggctccttatttcctaaccattcctccttaattcctaaccgtaattcctacctaccttaattaaggtaggaattggcctaccttaattcctaaccattcctccacctcttttccttttctctaccttctttccttttacctgaactgagtgtgattagatatttagctcttcttctagtaacattccgcaagtagctttctttgtagacaccttcagaaagctgaaactgtccctgataaccgaatagatcaggataaacattatctaagccaagctataaacaaaaatgtaaagcctttttttttttaacttttattttagattcagtggtacatgtgcaaggtttgttatataggtaaactcatgtcatgggggtttgttgtacagattatttcatcacccagtgtattagtccattttcacactgcgataaagaacttccctgagactggggtaatttataaaggaaagaggtttaattgactcacagttccacatggctggggaggcctcagaaaacttacaatcatgagagaagaggaagcaattgccttcttcacaaggaggcaggagagagagagagcaaaggaggaacttccagacgcttataaaaccatcagatctcttgagaactcaccatcacgagaacagcatggggggagctgcccccatgatccattcacctctctccctcaacacatgtggattacaggtccctccctcgacatgtggggattacagtttgagatgagatttgggtggcaacacagagccaaaccatatcaaccaaggtactaaggctagcacccaatagttattttttctgatcctcttactcctgccagcctccaccctcaattaggccccagtgtctgttcttcccctctttgtgtctatgagttctcatcatttagctcacactcataagtgagaacatgcagtgtttggttttctgttcctgcgttagtttgctaaggatgatggcctccatttccatccatgttcctgcagaggacatggtctcattctttttatggctgttatagtattccatggtgtgtatgtactacattttctttatccagtctgccttgatggtcattgaggttgactccatgtctttgctattgtgaatactgtggcaatgaacatacacttgcatctgtctttatggtggaatgatttatattcctttgggtatatatccagtaatgagatatttgggttaaatagtagttctgtttagctctttgaggaattaccacactgctttccacaatggttgaactaatttacactcccaccaacagtgtataagcattcccgtttgcccacagccttgccagcatctgttattttttgatgttttaatgatagctattctgactggtgtgagatagtatctcattgtggttttgatgtgcatttctctaataatcagtgatattgagctttttttcacatgcttgttggccatatgtgtgtcttcttttgaaaagtgtctgttgatgtcctttgcccactttttaatggggttgttttttccttgtaaatttgtttaagttccttatgaatactggatattagacttttgtcagatgcatggtttgcaaatattttctccgattctgtaggttgcctgtttactctcttgacagtttcttttgctgtgcagatgatcttatatttaggtcccatttgtcaatttttgcttttgttttgatcacttttggcatcttcatcatgaaatctttgcccattcctatgtccagagtggtattgcctaagttgtcttccaaagttttttatagttttgggttttacatttaagtctttaatccatcttgagttgatttttgtatatggtgtaagaaagaggtccagttttaatcttctgcatatggctatccagttatcacagcaccatttattgactagggagtcctttccccattgcttgtttttgtcagctttgtcaaagatcagatggctgtaggtgtgccgccctatttctaggctcggtattctattttggtaccatactgtttttgttactgtacccctgtaatatagtttgaagttagataacatgatgcccccagctttgttctttttgcttaggatcgccttggctatttgggctcttttttggttccatatgaattttgaaataatttcttccagttctgtgaaaaatgtcattggtagtttgataggaatagcattgaatctgtaaattgctttgggcagtatggccattttaatgatatttattcctcctattcatgagcatgggatgtttttctatgtgtttgtgtcatctctgatttctttgagtagtgttaacgaatcctttttttttttgagatggagtctcactctgtcacccaggctggagtgcagtggtgcaatcttggctcactgcaagctccgcctcccaggctcccaagtagctgggacaactacttggtaggtgcccgccaccacacctggctaattttctgtaattttagtagagacagggtttcactgtgttagccaggatggtctcgatctctgacctcatgatctgcccgcctcagcctcccaaagtgctgggattacaggcgtgagccgccacgcgtggcacaaatccatttttttatcatagggtctatttactttagttggagagttttcctaataattagacaacttaatccatttattcagtacatgagaagagagctctaaaaatgaatggatatgctaatttttacattcatttttctttttttcctccctttccttccactctttagcctatatatgctccaaaagtggaggggaggaccttggacagaaatcctatataactaaaccagacatgcatataaaaatgttattcatagctcttcattttccacattgttcccccaacagaatagaaacttcatttccttttgaaaatagtcatatatgtttgttgtaactggggacttgaaatgattctttctattaaaatcactactgatatttgaatcaagtatcaaggtatcttatgtattttattttgaaattttaaagtataaatgactttagagataaggtagtagattcttttattttaaaaaatgagacaatgagcatcaaagattaacccaaaccttagaacttgctaatagcagaacccaggacttcttactccagtataggtttgtttccatgatttcctctaacacttaataaaggatgagatggaaaaaaggaaggagggtcattggagagtttaaggtaggaaaacgtttgggaacagtaaaaaagcagccttggccaggcgtggtggctcacacctgtaatctcagcattttgggaggccgagatgggtggatcatgaggtcaggagtacgagaccagcctggccaacatggtgaaaccctgtctgtactaaaaataaaaaattagcccagcgtggtggcacacacctataatcccagctactcaggagactgaggcaggagaatcactttaatccaggaggcgcaggttgtggtgagccgagatcacaccattgcactccagcatgggtgacaaagtgagattccatctcaaaaaaaaaaaaaaaaaaaaaaaaaaaggcagtgttaaaaaccctctgatcatctcatgaccacgtgatttaaacatgacactgtgactgggaaattatgagctaccacacgtggtttttacttgaaatagataccttttcaacaactgaattcatttttcctatactggatcaggtaacatttattttttagcagtctttttttacataataatattgattatccactatatccaaggtattgtagcatatgaactgtgctagttaagtaaaataaagcaaaaggaaaaaatggttatgagaaattgagattgcgctatattcttaatactttttttgagtgacagactctgagaaaattgaaatcttcttccccagaaaggtgcacatccacacaaaagccaaccttaagaatccgtgattgccaagttaaaaccccacttaccaatgtacctgtggttttgaatcattttttcattgtcaaagtataactggaaaccaactgaaaaactcattaactgctgtaaaattctgagcaaaatggctagtaagttttaatttttaatttttgcctttgattatagtatttgaggggaagatcatacgtattttcttggaaatgttacagttttctaattggtagacatttagatttgctagggagataagtattctattgcctcaggataatgttagatctgaagaggtcagtctgtcttttaatctgagtatctaattaagcagatggcttaaagtacatcttttgtatcttcagagtttgtgctttttcaccatattcgcaagcacataatcaatttttcttcctcagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaaggtaaagccaaacggtctttttaaagtgtttatttcttctgtgactttaaggaaaagagaggaaattaattataaactgcctttttcagatagtatttttggttactataatatgtatcatagtggctattccatttgctatatattcttaatacttaaaaaacaataattactaacatctagaatcattcctttaatatgccccccagattctcagttttaagctggcattcccactaaaatgtcaaataattcaaaccaacttgctgtctagaaataagagatgtaactaactgctgccagttggaaatgtaccagatgcagcagactgttgaacagctctgatttttagaaagtttcaagtttagagtgtagggaacattggagaatagagttggcatttttcaggctatacaaggtaatttataaggagaaaacttaagaacagatggaaacatgctgaagctctaatatgaacatggtgtcaacatggaattagttaaatatgtgacagtggatgagttttccatgtaaacttagactgggctaagtttagaaaatcacaaattgggaactggagtaaggacaagggaaggtagtagacaagaagtcagtcagatgcaagaaagccatgtatgtagcaggtctcaccaggaaacggaggtaacaatcaactggagactttttacaaaatacacatgccaaatcttacttgattaaagttcatttttagctgtgtgatattgtgtttaacatcctcaaaacaaaacttgggaatgggactttgaaaaaattgtatatcctaaaaacatgaagtcatctgtcaagagcaaaatagtgcttcagagttaaaggttgtttttctcatataattatctacactgtggttataagaataatctttttagccattaagtactggtgaatataagaaattgactacaaaactgtattttaaaaaacactgtgccacttatatctaaccaaaactactacttgtagttgttatcatccagtacatgagatgcatctctctcctctggtatatataagagcattcaataggaaggaatggtttatgccaactaactctctacctggagctgtcagtttttggttgccagcaattttatttctaatacactattagataagaatgatttcagtattatgcaatattatgtcaggtgctgtaacacgtttttgtttttgtttttttgagacggagtctcgctctgtggcccaggctggactgcagtggcgtgatctcggctcactgcaagctccacctcccgggttcacgccattctcctgcctcagcctcccgagtagcggggactgcaggcgcccgccaccatgcccggctaatttttttgtgttttttagtagatacagggtttcaccgtgttagccagcatggtctcgatcttgtgatccacccacctcggcctcccaaagtgctgggattacaggcgtgagccaccacgtctggccaacatgtattgtttttatgaaaaccattaatggcgagtgatagatataaaccattttctactctctatccttcaatttccccgtcttgttttgggcagatttccagtcatgtctgatttgtattgcacggcgattacctcggcctccagctattacgggtgtagaatcctttatgaccaagcaagatactacaggtactaattgtaaagttcagaatgttccataggtattaataatgtgactctgcccttaaaactaattatatccagaatgtctttctgttctatgagatttaggctttgctccctagtcttatacagaaaacattttaaatggtgctcttgagattatacaatttagatactatgatcattatcatggtcagggtgctggggaacactttttataactttatatacctatatttgtttgattacaaattatttttcaaatcatggaataaaatgtttaaagaaattgagaagatatagatatgtaaatatgtagatatacatacatttatttaaatagatatgaatatggtagttttactattatgcttaaacgtatctggctatttttttttttaattctttttctttaaatttatttagcacataccgattgagtccctagaagtgcctgtcattaggtgattcctcaagatgtatatggttgaacaaaaatgattcagtgacaaattgtgttatttttgatgatggaagttatgagatggtataagggaggatatatgaaattagttggtcagcaaaggcctgtctgaggagctgatactgagccccaaaggatgaagtggtgcccactacttaaagtatgggtcttggaaggggggcagcaagaaagggtcttgatgcagaacgagtactcctaattgaggaaccagagctgcagaagtctaaagataagcaagacagagaggtaagttagaagtactagaaggagggcaggagagcctcaaactgagtaacagactgcctataaataaggcattcttcttaaaggcctacttcagattttattttcagcaagaacaagttgttactgttctttatagttgatgaagtatttttcttatattatttgattttatctttacactaacatgttgtatgttcatgcttttacgacaaccagagttacatatatatcacttacctctctaattttaaaatagagataaatattaaaggtatattttctagcagactaagattttaaaaataatttcttctgaattttatgctttgtgaaagtttagttttagtgtacattttgacttttaccacctttttataagatcctatttcattatgtattaattttttagtgccaataatctaatattctaatgttgtatactttgtgcttgtgtttttagagataaacttccaactgctcttactaaagaactagtatggataaattagcacagataatagaaaatggtaaagagaatgtctctgagcatggagagatggcatctaaggatagtaattatcaattatcatagccttcttcattctgtttttgagtctaccatgtattatgttcctttccagtctctaccatgaacaacactggaaaaatttaataaacgtactatggatatgtaggtttgtccaaaaacaaaaatttatttaaatttttttaaaatttttttttaattattgaaaattgaaagtattttgcatgaaggaaaaatagagtccattgaaaaagaaaattggtcttttctgtcagtaaccagttaacataaaaagaaaccaaataagggctttgtgagatagcagaatgaaaacatgttgaaaaaggttattgtcaggtcacagaaaaaatgtcagagatgggggaggcctaaaagttatgaggctaatttaggaacaatatgtttcagcttttcctcatattgcatttgtataaattgaattctaaattggattgctttgaggactgtattttcccataagaacagtgttatccctggtagttttgtttctaagaacccagctgttaaaattttagatatacctggtaatatgtataaatatataaaaataaccataatcatgtaaaataaaaaattagcctctgggccataaaataactatatatatatagagagagagggaacctccaatatcacagaatccaacctagatttacaaatgaggggatggtgatttgatcaaaaccatacagccctttgccgagaatggacacctttaggccctaatgtggagccctttcttgtattacattacttttcactaaagcactattaaaagggcatcactatactgtacacagttattgtacaaagataccaaggaaatataaaatatgcttaaaatgtaaaactaacattatataaatcatagaattgacttagctaaaaagaataagtataataaatgttaaacatttaatttcttaagtttttgtagtactttttaactcttcatgggatgatccatatctcttaaaaaaagaaaaaagtattttactaggaaatgttgaacagtggggctttttattgttgtttagttggttggttaaactttcctgtagtaggcagagtattctaaatcaagctgttcatgattcttcactaagatagtcattatattacccatctggtaccattgctgataacttaatcactttctctcctgccagtccccaaactctaaactctcatgctctctggtggggccaaccctgacatgaacacacacatgcatatgcctcccttagtcactgcctgtgaggagcattattgtataggaagattatgtagcagtggaatccctgctataaccaactttttatctctgacataagaaacaagggttgaacaattaaaattcttaaaaatctaaaatcttttatagtttcagttacagtgttcaccaggctttccccaaactgttcttaaatgacaaaatttccttgagtttcagtttattttctttctactatttacatttatgccaagacttaggtgataacctgatcaagtaggactgggtacatcagattcaagacccgaagttaaaaaggtctaatgaatattttatttctaaacaaaatgagatatataaagaggggattagttcaatgaggaggcacaaactggatgatagatttgagttgattgtatgaagaaggggaagatggggaaaatatttaatcaggcattcatagaagaggaaacattagtggtgaactctaataattgggaaataaaaatttagaccacaatgagatagcatttttcacctactaatttgaaaacataaagaagcctgacaacacaagtgatgaaaggatgttagattagcactaactcttacacattgctggtggaagcatagagtggtacaagtttcaggaagacagtttaaaattaatattataaagttgaacattcacataacctacaatctaacaattctgttcctacatatatacactagagaagttctcacatgcatgtaccatgcaacacgtgaaagatgttcatagcagtgctgattgtaatggcaaaaaaccgataacagtctagatgcccattcacaggagaatttaaagatgggggtggtgacaagggaggagtgcacatgtgatggagcaatattggtaacgtcaagttctgaagttgagtggtgggttggcaggtttttatctcattaattcttaatttatatatatatattctatatatatcttgtattattttgtgtgactgtaagattctgtaaaacgtaataaaacaggtcttaatattcacaaactggattaattggccctctgttaactgaggaataacttacctgaattctctcatagccatttggaaatttgtttaaatatgataacaatggcgaatcaccactaaattttataaagcgtatgttccgtgtgcatactgcctagcaaatcttaatgttctcacttactgtttttctgatttaacttttgttgtcttcagtctttgtttagtcttaaatacagtattgcctacagcccaacaaaggttagaaaggaaaaggcttgcttcttttctcatattctcttcacttagtagttagaaattaatttaaaccaaaaaatatacttcatctttgcctctcctttccaatcggtcatcagtatacagagagcagaatccaaagaccaagccagaagagtttgaactgcattagtctcagtagtgtcaggtcattatggtatgactttaatcctagaccagaattgaattttagaatatgacatactaggacataacacattctaagaccaaaacaatttcttatgtcaataacatacttcataactataataaaaattaatagtgctttttgatgcttttgtttattgagtatttggaaagaatatttcttagatgcagttgttagttttgaaatacagatgatttatataaagaggctgttataaatataaactttcattctttgtacaggtaaaatcatctctattgatactagttccctgagagctgctggcagaactggttgggaagatttagtgaggaagtgcatttatgcttttttccaacctcagggcagagaaccatcttatgccagacagctgttccaagaaggtaaaattttctctctcaattattttcattaacccttatctttactgatatttgaatagttcgtatagaacttatggcttgataagtattttctccaaattatagtttttgcaataatcagttttaggaaaggaagaaatgggtaagcaaagtaattcatgagtggatcctgaaatttgggatacacgttctgaagaataggatgttgtgtggtggtcactcattcattcattcattcattcagcaggcatgtatcaagttcccaacatacgtagaacactatataaggtgccagggatacagtgatgactaaaaaagaaggttttgcccttaaagagcttataatacagtaggaaaatatacgacaaccctaaagatcagtttgatgtggggtatgatagaaccataaccaaagaagaaaaaaattaattctgacttgaagaatcaaggatgacttcagaaaagaagtaatattttgtttggctcttgaagatcattctcagcagaacaagcatgtcaaaggccttctagataatacagagatcagtatcatgcctgtttacttcatgactgttgcagaacctgtatctcctgactcaggttgaaatttcaagtcaaaaaatatatcctatgaaattattaattattgcatagcttctgggtcttagtaagtatcatggaagtataagatatgtatattccctgcccttaagaaacttaacagtactacaggaacgataggaaaagttatttgagaattaaggccagaaagtttacagaagttcagaattaaatggctttgatatactttaaaaatattgtcatttaattatggtagcctaacattctttttccaatgaaatttattctctaatctctagatagtttcttttgtaagaatctcattgtatggcttttcctgaaaaacaatttaaaaatatgtttcattattttgtcattcttaattttaacatttttcccataacattagatttcctaagtttacggatgattttccattcattacattttaggtcaactgcttcctagtgatacatggaggaagtagtttgattttttttcttcttccaggaaacatctatataaatatcacaatccaggtatttctggaacagcttcgtacagactagtggttctctaatgggctccttactagacttataccacctcctaagattgtatttcactgggtagagctaagaatctgtattttttaaaagtttcccaggcaatcctgaagggcagccaggtttggaaaccattacaataagtaactaatgccgtccactggatgtgaactttgtgatttcctctggcaagggtgatgcttgacttttgcataggtttgggactcagagcactgtttcgactcattgcctgaagttctcgagtttatggtacttttgatttttgccttaagttgggccttccaaggctttacttaaaagacttaatttatttgcctataatttacgtacattttcactaaggcaaagcagatctggcttgtcttattatccaaatggctaggctccccatagatgtgactaggctacagttgaaggtttctaaaccttcaacggaattccccatacaatgaattgattaaagtattataagtaactagtttgtcattaatatataaactgaaataatttagagtaaaatgtcaagaaatgtaagtataatccaatacctcttccccattagtcatttttaatgttccctcattctactttttttagggaaaaaaaatcctcaatagaaataactgtatttttcttagaatcaagttgtccaaagttcacgtgactgaatcgagtgttttggagattctaaacaacctgacaaacaggttttgtggattgagcacagccttttttgatattttctattcagcagtatctagccagatatgagaaatgtggtcaatgaaacactttcatgagaatcacctgttaaagatagtgacctgctgaattaaaatatcaaatgaaggcctgcccagatatcttaacaaaccttaaagctaatgcttaagttggccgggtgcagtggctcatgcctgtaatcccaacactttgggaggccgaggcaggtggatcacctgaggtcgggagttcaagaccagcctaatcaacttggagaaaccccatctccactaaaaatacaaaattagcgcgcatggtggcgcagtcctgtaatcccagctactcggaaggctgaggcaggagaatcacttgaacccgggaggtggaggttgcggtgagccaaggtcgcaccattgcactccagcctgggcaacaagagcgaaacttcatcgctaataataataataataataataataataataataatagtaataatgcttaagtttgacaatcattggtccatcaagattggagagaggtgttatttgcatttgcagttttcttgctgccttttcacttagggacagtataaaaagagtgaaacagattatgtactatcttcctgattttgtgtagaactttacagtgaatgatatttaggcaggaaaagtttgtcctccatctgttttcttttttcctgtccattaacttactctttgatggcagcaactagtctaaaatcctaacatgcgttaaaatttctagttttagtttagttttttagctgcttttgacagtcagctcatgaactgctgtcaaaaggagtttactattatattttccagaatcaagtttgaaaacacatttcaccttgcatgaattagattaaagccacggttttacattgagattggagggaaatgggtatcaggatcacttgaggaactttttaaactaggagaagatccatgcaagtgtgtatagtttggaaaaagttcccaggttctgttcaattcaaaactattactttaaagaaatatctaggtcatggtgcttcccaaggtccctgataagatagatttatctggggcagttgttaaactagatttctggaccccaccccggactactgaatcagagtctatagtctaagatgtttacttacagagaagtttgtaaactatgaacctaggttccacaaacttaataactataactaggaaatgatgttttatgggtaatcccactttaggtgatttataagatatatttaaggtatttaagtttctgagaagttctacaataaaaataccttttaaattttgttattgagacttttttttcacagaatactttttcctggagcacatctatcagcagttagatagtagtcatgggaaatgtcaggctatacaacctagaaactagttgtatgaaagttctgtttatatatatatataatgatgtaatggatcatcttttcttgtctttgaaatatccatgacatattgttatattaaaaagtaggtggctgggcacagtagctcatgcctgtaatcccagcccttgggaggctgagacaggaggattgcttgagtccagaagttcaagaccagcttgggcaacatggcgaaacctcatctctacaaaaaataaaaatacaaaaattagctaggcgtggcacacaggtatggtcccagctagtcgggaggctgagatgagagaattgcttgagcccaggaagtgaagacttcagttagccttgatcatgctactgcactcaaacctgggtgacagagtgagacactgtctcaaaaaaaaaaaaaaaaagagtagaccaagagagcacagcatatataatatgatctcacttttacatatctttctatttatccaattctagaaaattaacaaaattttaactgtttatctctgcatgatggaattacaaatgacttgacttgttctttgttcatctctctattaactttatattaaaataaagccattttcatcttttaaaaaatatagttaaggctagccatggtggctcacgccagtaatcccagtattttgagaggctgaggtgtgaggatcgcttgagcacaggaatttgagatcagcctcgccaacatggcgaaaccctgtcctattaaaaatacaaaaattagccaggcgtggtggcatgagcctgtaatcccagctactcgggagtctgaggcaggagaatcccttgaacccaggaggcggaggttgcagtgaggcgagatcatgccactgcactccagcttgggtgacagagggagaccctgtctcaaaaaaagaaaaaaaatatatcatgagtcaaagctggaaagggtttatggtattaagtttggaagcattgctataaaacataaagtaccgatatcaatgattaattagaatgttctttgagacttgtgtaatgtgattaagtccacggtccatgtaacaactgaaaatctttttatgtcaaactttgttaaaaatatttaaaatgtgagtttactgtcctcttagtgattttgatataatagagtttactcattggtgattgagaattttagaacatctaggggtaattattttttctgtacctaataacaattttttaattctttatctttttctgcatatatttaggtgactaccacaaagaaaaataaacctctaccggcattgacccatagtaccctgccacacattttttcacctgcctattttgttaatatcagtcaggcatgcttgtttgaggttatctcagcaccaaattgggagggatcaaaaacccaaaaactttgcttctacagctgctgtaaccagggaaaatttaatgtttcttttgctttgtagctctgttgaggcctattctagggataaaaataaataaaaaataaataaataaaagcggctgtcatgttaaaggttctttggaaggattctgaggtgtcaataatagtccttcaatattatctttcctcactaagtgttctaaggagtttagaaatggacacaggaatcagagatcagaatactaggtataaagatgacaaaattaggtcagaaaactaggccaggacctataaacaaaatgggattccaaaactaaaccttgaaacccacttaaagggaaaatttgatgtgtacggcaaatgtttattgaaccaactctgtaaggagctgtggctaccttactcatctcttaattcaaagtattagtgattgttattcagagttgaagctgttgccataaatagtgtctagggattgactatgtgtgtgactcagaacataaatactttggaagctgcgtatttgttgggtttttttccctctgatgtttattgaggaaatactcattcaatacctgatatgtactccatgctaggctccgtgctagatattatcttacaatgttgttggctcagttttagtaatgagttgactgagatgggtgaatgttaatttgcattaagtcttaaacttgtaaatgacagtgagaggtcaagcctgaatctgactcctaggctgttactcttttcattgatttatgctgccttcctttgacctcttcatctgaacaattaagcaccagacttttagttaactggagagtcttactgagttctaattaattgaagttttaccatattaaatattgcctctttctcatttccaagaatggctgaatgaattattaaatgccaaatcttagtccatacattctcatccaaaacaaataatctaatttcaaaacataaagtgtggtaattgtcttgtattaaattaataggcttccctaaattcaggaatttttcctagtttagatacattatatttagtaagtatgccagtgatttagctgaaattgccaggtgtgtaaagaatgtggttggtcaaatataagtcttatcctttcaattaaatttatattctggttttggtacttaagcagatatattatggtatagatttacattaaactatacctttttcagttggtactgtatacacaggacaataaaatagaacatgtcttgtttaagtaacatgtaacttcaaaaattatttattaattggtaattttaagcctctttctcatggcctttaaaatgtaatcaaagcccctttgaaatgtctttgaaaaattggactaacattttatcacaggctaaattataatagtcatttgtggtagtactcaatctttcttaaaatagaattatatggtattattaaaacatcagtgatattttattacataatagtctggcatagcctttacgtatttaataaatacttacatgattagaattttttctgctgttagtaaagctttaagacaagagtaaattatgctacttataaagtgacttgactgccttaacttagtttttgttccttatactaataaccattggctacatcttaatttgcttactaaactttaaaaattcaaacattaaaaatagtacacagattttacacatatttataaataacttgtcaaatgggaccttagtgattcacattcctgagtgaaaagttaaatttgaatattagttaaggaactctgtaaactgatcaaaacttagtaaattttatggtgtgtcagtcatatcttagtagagctgttatttaaaaaaaaaccagcaaaagagaaaacaaacttgttaaagataatactgagagtgagaggggagaaaaatatttcctggtatttttaatggagacaataaatttgaagagctgcccccagtatagagaaagattaaggttgggccaggcgcggtggcttacgcctgtaatcacagcactttgggatgccaaggtgaatggatcatttgaggtcaggagttcaagaccagcctgaccaacatggtgaaaccctgcctctactaaaaatacaaaaattagccatggtggtgggtgcctgtagtcccagctacttggaaggctgaggcaggagaattgcttgaaccccagaggcagaggttgcagtgagccgagatcgtgccactgcactctagcctgggcgacagagtgagactctgtctcaaaagaaaaaaaaaaaaagactaaagttgatgtttcccagatttggggttttctcataattataacttctctgaggaggcacccattcaactatgactcaattaaaacctgtcatcaagtggtatatttcaactggaatcatcttccccctcagatatctgctttgtctgaactattctttattctgagtctaagcaggcaacagttgggagggcctttaaaatgaggttctaagtagaaataaaacctggtgacttaaagccagcgtataagtatcagaattttaactaggtttctcttctgtttgaaacagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacaggtactacttatttggagagcttcatatgaaataagccagttcacatatctcttattagagaaattttttatactcttgatggctagaaagcagaaattctaaattaggcgtaaaactagtgtgatgagtatatataatcaatatatccatattgggttttatagttttatcatgtaatagctttgttgttcataaagggaggtaggaaagctgaggctgaaaatctgctttttagagggtaaaaccaaaaagatggctaaaaatttacaacattccatatgtgaatcttataagagatttgtgagtttgttaacattgttatttttatttttatttttgaaagtgctctattttcattagggcatacttggtggctcctgagttcaagttgacaatttctcacagaaattacaaatcattaaactatcaacttgatttttgagtgccattgtctctaatttgttcccctaagtatgttttacactgatatatggtaaattcatgaaactattatcctatgaattattagaaatcctacatttacagtggtgaaaatgtagcattaaaaacaaagacatttcccctcacttcatctttttctcatctaatgtatttgcttattggaacatggtaatgccagtcacaaatctgttgtcataattatgaatttgagtaaaggactcactgaaaacctgaattcagtattgtggtttttttctacttttagtttaaattatgcttgtgagtggaattagcacagttctttttttttcatattgtgatttctctttcaaaacatctgctatgtctgcatatcactctttttaatttttacatcagtgacacagtattttccttacccagtcttcctctttggagttgaaatacttaaaagctgtaacaggagtcataaataagtgctttataaacagaggtgtgagaagtttatttttcaaccaaaaaattattataatgttaattgtgtatattaggcttagaaattgtttaaaagaacatatattggattttttccaaaaccaagaaaaatttttacattatattttacataaaattatattttacatataactgagaccattatcaaatgtaagagtcgataagcattatttcttattaagtggtgctaatattttacagtagttttttcttaatttaagaaacttttttcttaatttaagatggtacagaagctctttacttgatagcttgcaatattaatgagatcaatggtcttgttttagaatatgtatcataaaaatattttaatagaaacaaatgaagatgtttgaataataatgtctttttccccctagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccaggtgggtaactgcttgcttcacagaatggtcattcttagtaattttttttttcatttattctattccatctgtagaccagatatgaattcatactatgttttatcctatccattgggcatatattaagaggttagtatcaataactgatcacaggatgccctcagaagttttctttagaacttcagaaggctacagttttaatgcagaattataaaaaaggaaatttttctttctctataaaatcagtgttcacatctttagacattttttaaaataccttccctgcccctctctcccagccctacctattgaatctaactctctaggaataaaacctaggaaccaaacctaagtctgggaacccctgatgtaaatgaagtgggagagaaatgtaaggagatggacaaggttacttagtctggcttgttttttatttcctttgaagcatttcctaaggctgttttttccttctcatctgattctgaccaccctcagcaatcagagaatagggacttgaatattctgggtaacagaatattgcccttatgtaacatgacctgaaacagacgtaaataaagacaaacctttccataagttgttatggattagaaacctttatgtttaggatggggtgaaagtggtgtaaaagtaaacaggtatcttcatttattgtataattgcttatggactctgaaggaatatagtttaaaaaaaaatatggcccttcctaggagctttcaccttatttagagacagaatatagacattcattaatcagcagacaatgtatgtacaaagcagtttatccacgagactccattctaaagcatgagtcacacttagtatgcataggtccttcggtttcttgaatcagcttagttttctgctctcatttcacaagaatcactctcttccctcagaaatactgcattctaggcagatggaagtccttgtcattcctagaataagccatgtctcttctaaacatattctgccttgctcttctttctgtgcccactgaacttctactcatccttcacaaaccaattcaaataacatctgcataaagccttccccaagtatccctagttagacatttcctgcttctgtccttttgtggtgcttcatatcatctctgtttactctttgtagtaacactattttgactggttctgtgcatgtgtgttctttgaggataaggctgtctcgtgtttcttggtacaatgaaactaatttttaagcagaaaacagcattaaataataagtatatttaaaaggaaaagatttataagataatgccattgtgttcagttctggtgcatctgttttgtgcacatgtgtatgtatttctgttgagctgcttcttaggagtagaactacaggataataagatatgcatatgtcctttttcagtagataatgccagttttcctagtgtatcagtattttttctagttgctccaagtccttgttaatacatgatattatcaatattttagatttttagctattctgaggtgtgtgttctaatttgcatttccctgataaatattcattggtcatttggatatcttcttttgtaaattgcctagtctagtctcgtgaccattttttaatgtgtttttattttgcttattgacttttaagagttctttatgtatgagtcctttattggacatatatttgcagacatctttttagtgctaaggcttaccttttctttctcttactggcactttttgatgaggtgaagttcttcactttaatatagttcaatttgtcaatcttttcctttatggttaatgctttttgcacatgtgtaacaaaagacatgttcacaaatgtttttaacagctttattcgtatcagccaaaaactggaagcaacccaaaaatccatcacaatagaatggataattatgttgtgacatattcatacagtgggacactattcagcaataaaaatgaatgaactgctgctaaatgtaacagtgcccaaacttcagaaatataattaaatacatatatgtaattctacttatatactctagaaacaaaaatttcagttgaactagataatgaaacccaaaaagtaatcatagtatagcaatattgtgaaataaaggccagttttcttctctacataacctaagacagatgtaggaactccctatttattcttttttattttattttattttatttatttatttatttatttttgagatgggagtctcgctctgtagcccaggctggagtgcagtggcacgatctcggctcactgcaacctccgcctcccaggttcaagtgatcctcctgcctcagccccactagtagctggagttataggcacgtgccacgatgcctggctaatttttgtatttttagtagagacggggttgccatgttggccaggctggtctcgaacttctgacctcaggtgatccacccgcctcagcctcccaaagtgctgggattacaggtgtgagccatggcacccggcctccctatctattctaaaagatatgtttcttattaagtccttaagtgggaagtaaccattgtgatatctttaaagctgataaataatttatgaaaaagttttccaaacttttttaaattataaaatagttgaatcaatataagtttaaagtaagtcattttatgaaattttgaaaaatatgacaggaaaaagtcacccataatgctatcatcataacacagtactactgacacttttttccagtccaatctttttttatacatagatttttgtaccaagatatagtagccaaatatatgtgtattatttatatcctgcagtatatgaatactattatcagaagcatccaaatattttccccatggaatagttagctcatgtaatttccaagtagccccaatcattctaattatttcttctttcttcattatctcaaagtcacactgaattcatagagtttaaagaagcagcatttttttctacgttgtttcaggtgaaagtgtaaaatatatttcctctaactttggtttccattcttagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagtatgttctggggacaacacctcattttaaacgtttagtgataatgtggattagcattttgtctctcaccagtattacacagatcctttgcttaagagtgaaatatctttttattaatgccactataaataataaaacagttatatttaggcatgtgaacatcattcatcatgtgtattttaaattatgacctctatccttttgtaattaatgttaaggtgagcaattgatgttaaggagaacaattttgtcgtctcacccaaaacaccccataacaggactttcagaaatacagtattgggtcagattgtttccagatatcttccttgaaaactaatcctgtgagttgcagaaataaaagattctgtactaaaatacactgggcaaatgctacatgttccatacatttcatattgatgttttaatgcctattagcagttttgagaagccttgtattaaagaatgtagtttagatttcttttacccaacatttcccaaactttcctgattatggaatttcttttctcaagtaatacatgttataccacagaatgagttttccatgaagttgcttaggagacaactgtgttaaaatatgttattgttctaacccaagttagcattttcctagttgagagacactttgatagtttaatacattaaatttatgaagataaggctgtcagatttttttgcccatcacattttgatgttgaaaaaaccagtggtaagaattccattgtatgaccttgaaactaaaggaaactaatcagcccactttcaaaattagtctggattttcaacgttagttctatcccttttctgatggtatcatatgtgggacttcagttatttcagtccaactggaacttttaactgtcatgacccaattactgatagtttgccaggatttcagacagctgcgaagaataatcttgaatccatctgtgacatttttggaggcagtattttagctgaccagagtattagaggaagagtcagaagcctagattcaaatctcacattctccagtcattaacagtcttacctcaaggaagtacattttttgaaccttattctctttatctgcaatataagaattagattaaatgattttgaaagtttcttctaatagaagcagtgaggctctagactggaatgtcagtcacaattgaggaaacagtaagatgcaaggctgaaaagagataaaatgaaagtctgcatattgattgatttggaggtctttatctccttccccatccaatatgggagactggaagaattttctcaggggacattgaatgggcggaaagatgtctggatgtgagtatataagtacaaaagccattctgctatctcatcatccaacaatgaaggctcccagaagagacaagcctggcactcagccctcccagtccatgtttaagaacactgactgaacagacacagtcaagaatcatcagtacttggaggaaactctgcaacttgaaagggagaaaaagaaataaacagaaaaagtatgcagtggaaatatataatgaatgcataaaccaaaaaagaaaaaaactactagaaattttagaaagataaaaatgtattacccctgaaaatatggaaagggaaaaaaagggacaaagaacagaaaaaactcttggaaattaggtatccaacttttttttttaatgagggaaatgtaagatgatacagctgagaaaagcttccagaaagaacaaaaagatgctcccagaaagacaaatgggaagtagggaagaaaaagttaaggaaattacaaggtccacctcagagggccagtaatgattaagaattacacaaacaggccaggtgcggtggctcacgcctgtaatcgtgcactttgggaggctgaggcaagcggatcacctgaggtcaggagttcaagaccagcttgatcaacatggtgaaaccctgtctctaccaaaaatatacaaaaattagctgggcatggtggcaggcacctgtaatcccagctacttgggaggctgaggcaggagaatcacctgaacccaggaggcagaggttgcagtcagctgagatcgtgccattgcactccagcctgggcgacaagagcaaaactctatctcaaaaataattaattaattaattaattttaaaaattaaatttaatttaaaaaaataaaagaattacacaaacaagggtgggaaacatcaaaaaatataagagaattttctgattccccagattacagtgtttcaacaagtacccaacacaaatggaaaaaaaaagtacttgtaccaaagcttgtcatcatatcattctggaacatgagagataaagaaaagattctaaaacctttcagagagaagttaattccatacagtgaatcaggaattttcaaaggtaatattggaactagaagacatttatgatttgagaaaaaggacttctactttcaactatgacagcaataattggcactggtctagtcctcccactgtaaataacgggaaaaagagcaaatacattaaacaattcttgtaagccaatagataataggcagtgtgagactgtgatctctctgagaaggaagcaagtcaggtgagctctacaatcatctcagcttttttcttggagatgtttaccaaaccaagtacaggtaggaggaacccaaaataagcacggatattttactaaactccgaaaatagtgataggagttcagtgacagtggggcagctagaacttgctgaacaaagtacccgagaagagaaggatatgtagaaaatagcaacaaaaatctgaatcagggttcttttctatccttggctgaatactacactgtgcatgtattcaacgatactccatcaggtggggcaaagaacagtttgtgaaggaagaacaactatcaggaaggagtgagctgaacaactaccagaactcacacaagattggaagataatcaagtcctgaccaatcagagtcggtagaccttcttgaacatctgggacatttagtggaaaatggcctcactttaagagtggatttaccctagacctgctttgacatcttaaaaacaaacctcaaaaggatcaagcttatgtacaagtaaattaactgtctgaaagaacactattcaatagtttttaaagaagacaccaaaattcagacattcagcagcattatattcataatttccaacatataataaaaaaaattaagacacatgatgtagcaagaaactgtgacccatacccaaacaaagtcagttaatagatccagaaatgacagagatgatagaagtaatagaaaaagatttgaaaatagctattctaaatatgttgaagaacttaagggacaacatgaacataatgagggaagagatataaactacaaaaaaaaagagccaaatagagctggtagagctgaaaaatacagtatttaaaatgaaaaatttgttggaggagcctaccagcagattagacactgcaggaaaaaaagagcaataaacatgacatagtattagaaactactcaaattagaggagaaaaagaataccacaaaagtattgaaagacctcagtcacctgtggaacaatacaaagcagtctagtatacacataatatataaataatacataattatggaagaagggggagcaggtgaaatttttgaaaaaacagccaaaatatttacaaatttgtggaaatttgtaaacctacaaatccaagagtttaatgaatcccaagcaaaataaacacaaagaaaactactataagccatgtcataatcaaattgctgaaacaaaaatcttaaaaccaatcaaagaaaaatgacacattatgtcagataaacaagaaaaaactttctatacttagtatcattcaaaatgacacagagatgaaaaaagatagaaaatgatataagatgaacaaagataagaaaacaactaactttctgtatccagtatcattcagaaatgcaggtgaaataaagatgttttcaaacaaaccaccctgagaaaatttgtcaccagcagattacactattgttcaagctaaaataaaatgaatccagatggaaactctaacctacagaaaataataagagagccagataagtaaaggtatgaataaatggaaaattcttttttctcatttgttagtttctttaaatgaaaaataactgtttaaagcaaaaataataacagtgaattatatatgtaatatgtagaagaaaaatgtatgacagtaatagtaccaaaaatggggtagaataaatgagacaatactcttttctacaaaatagtataatatttgaggctagaggctaaagttaaaaatgcatttttttaacagaaaaatattctataagtgtcctgcatgtagaaaatcctaaagaagtgagaggaaaagctacttgaactaaatgaacttagcaaagtcacaatatgtgtactcagtattttaaaaaatcaattgtatttctgtatatcagttacatacaattggataatgatatagaaaaagcaatttacaaaatacataaaatattaagacataaattttagatggaataacatgtgcattactctacactgaaaactactttgctgagagaaattagaggggggccaaataaatggagagggataccattttcatggattgtaagacacaattttgtcaagatatcagttattccaaaatcaacccatgtaaatttaatgtaatcccaataacaatcccagcaggcggccgggcgcagtggctcacgcctgtaatcccagcactttgggaggccgaggcaggcggatcacaaggtcaggagatcgagaccatcctggttaacatggtgaaaccccgtctctactaaaaaaatacaaaaaattagccgggcgtggtggcaggtgcctgtagtcctagctactcgggaggctgaggcaggagaatggtgtgaacccaggaggcggagattgcagtgagccgagattgcgccactgcactccagcctgggtgacagagtgagactccgtctcaaaaaaaaaaaaaaaaaaaaatctgagcaggcattttagtaaaatttgacaagctttttctaaagtgtatatgagaatgcaaaggtcctgaaataacaaaaaccacttaaaaaaaaaaaaaagaaaacttgggagtatttatactgcttgattttaatacttctataaagcaccagtcatcaagatggtgtggttttggaataaaaatagacatatagatcaatgcaaaataatggagagtccagaaacagacccacatttatatggcgaattgacattcaacaaagacaccaaggtaattaaacaaagaatagtcatttcaatacatggtgatataacaactgaacatctatgtagaaaaaaatgaacctcaacctctctcctcatcccatacacaaaaaaatgaacttattttgagttgatcataggcttaaatataaaagttaaaactataaagcttttcaacaaaaaaaagtcattgagatagacacatttttgataggacacaaaaagtgctaatcatgaaagaaaaagattgatacattagacttcgttaaatgttaaatcttctgctctttaaagaccacctcttgaaagaaaatgaatcaataatcaataacctttcaaaacagaaatcactaggctaaacccagatgggttcacttgtaattctaccaaacatttaaggaagaaattatattctctctaatctcttccaaaaaatagaagcaaagaaaatatttcctaactcatattgtaaaacacatatctgatataaaggagtgatacccaaaataaacaaagaactcttaaaatgaaacaatgagaaaacaagcaactcaatttaaaaatgggcaaaagatctgaacagacacctcaccaaagaagatatacagatggtaaataagcatatgaaatgatgcccaactcatatgtcattagaaaattgcaaattaaaacaacaatatgctggcgaggatgtagagcaacaggaactctcgttgctggtgagaatacaaaatggtacagccactttggaagacattttggcagtttcttacaaaactaaacatactcttaccatatgatccagcaatcacactccttgatatttacccaaatgagttgaaaacttatgttcacacaaaaacctgcacatgaatgtttatggcagctttatccataattgccaaaacttggaagcgatcaagccatgaaaagacattgctgagaagaagccaatctgaaaaggctacacatcctgtataattccagccgtattctggaaaaggcaaagctgtggagacagtcaaaagatcaggagttgccaggggtttgttgtcagtggttgccaaaggcaaggatgaataaggagaacacaggggattttatgtgataagtatcatacctaaaaatcccctgtgttcatatcatgtataaataaatgtacatagacatatacacatatatatatataaatcatgtgtatgcaatgacatgtatctatcctgtcattctgtattggtcaaaatatcaaaatccacagaatgtacaacacaaagagtgaactctaatgtaaactgtggactttagttaatactaatgtgtcaatattggcttatcagttctaacaaatgtaccacactaatgcaatagtaggaaaaactgtccaatctaaacactgggcaaaggattttaaaagatatttcacaaaggaagatatgaaaatggcaaatcagcatgtgaaaagatggttaatatctttttttttttttttttgagtctctctgttgcctaggctggagtgcaatggcatgattgccgctcgctacaacctctgcctctcaagttcaagcaattctcgtgcctcagccttccaagtagctgggattacaggtgtgcaccactatgcctggataattttttttgtattttcagtagagatggggtttctccattttggccaggctggtctagaacttctggcctcaagtgatccacccgccttggcttcccaaagtgccaggattacaggtgtgacccactgctcccggccaagatacttaacatctttaatcatcaaggaaatgcaaattaaaactacagtgcaataccactgcatacccattagaatgcccaaaattttaaaaactgaccataccaagtgatggcaagtgatggcaagggtgtggaacaatttgaacttttacattgctaatggcatgtaaagtggtatagcaaatttggaacattgttcagcaatttctcataaagttaatcatacatttaccatgtaacccaacagttcaacttttaggtatttaaccaagagaaatgaaagtccacgtccataaagatacttgactacaaatatccatacagttttattcaaaatagccccaaactgggtgggcgcggtggctcacacctgtaatcccaacattttgggaggctgaggcaggcagatcacttgaggtcaggagttcaagaccagtctggccaacatggtgaaactccatctctactaaaaaaaaatacaaaactaggctaacatggtgaaaccccatctctactaaaactacaaaaaaaaaaaaaacaaatcagccgggcggctactcaggaggctgaggcaggagaatggcctgaacccgggaggcagagctggcagtgagccgagatcgcgccactgcaccccagcctgggcgacagaatgagactctgtctcaaaaaaaaaaaaaagccaggtgtggtggcgggcgcctgtaatcacagcttctagggaggctgaggcacgaaaatcacttgaacctgggaggtggaggttgcagttagccgagatcgcaccattgcattccagcctgtactacaaagtgagactctgtcccaaaaaaaaaaaaaaaaaaaaaaaaaaaccccaaaccggaacaaactaaatgtctgtcaacaagtaagtggtgtattcataaaatgaaacactgctcagcaatgaaaaggaaggaactataatactattacataggatgaattactcttggaaacatgctaagtgaaaaaagccatatatattcagattttttttaagctctcaaacaggcaaaactaatctgtagtaatagaagtctgatcattgtttgcctgagttaggaagattgatagccaaggaacatgaaggaaattttagaggtgatagaaatattctgttttcttgatttgagtggaaagtcctgggtttatacctttctcaaaatttgttgaactgtacaaaatttgttgaacttaaaatgggtgcattttattgtatgtaaattatacatcaatgaagtttagtttagaaatatctgagagtagaatgatttccagccaataactatcacatttcttgtagttgtaaagatagaataaagcattttcagatataaaagacctcagattttatctgcttgatatattcaccttttctagcaaaggtcctggaagatgtccttaaacaggggaaaaccaaaagagacaaaaccaaaagagacggaggaagcaaaggatctgaaaggaagcccaggaatgacagctgatccacaagattagggaacaaccagtgcatattgaaccgggggcctggcgaatcctctagaaaggaggcctccagagaagaaatgaattgatctccttgagtttatagaaaatattattgatagatttatgtcagaatgttgaaacatctgataaattctagaaccgctgacaaatgaaaacataagaaaattattaactccagaaaaaagaaagtatggcacaagagaggaggttcgaacaaagtgcacaatttgacttagcagtgagcaatatttgcataatcataatcaaaatattagcttttgattttataaaaaactatgatctctgttagggaattgggaaccaggatggtagtaagagaggtacatgtggaagaactaagacctcatctataatgaggggaagtcagtaaatctaaaatggagacatcaagaaatagcaatatatgcatatttagaaataaataggcaatgccaaagaaaacagttttcagagttgcagatggttgcctctattgagaaggaggtaactaagtgactggaaggggtgaggcaagaaactgctttatttattatgggcctcttggttctgacttataaaattatgtgtgtgtgttaacttgataaaaactagagttaatagaaatagtatctgctagctttgcaagttgtgaaagtggggtgttttctgtcatagtctgtattgaggcaaacagcttttttctcccttgaggcttcccctccggagtacagctccataagtgaaagtatgtaaataggccagaatctgtttcacctcgtgctaatatgttcgcaaaggccaagagcatagaggggaagataccaaggtagatatgggggaggtcagtagatgcagacaaccagtctacaatgtgtagatatagacaggaaagaaaaaagaattcagagaccataaggctaaggaaacaagttgggtgtgaaaaaggaaaaaagaattaaggattgcagaaggaaaaagaaagaaaaaagatgggaacaaaaatatgatagcgtataaagagaagaagaaaagaatcacttctaattctctgccccactcttacctctaaattgtcccatcactactgtctactagaaccagagtctattattgattggcccacatcttaagtttgtgcccgcccaggaaaatcaagcacctttccttactttagtcttcaatcttagctgaactgtgtcacgtacaaatatcttgcataggatagtttaattatcatcctccttcaccacctgagatacacagttagaagtaatggctctatcccccatgacacttatctttttctcttatacttttcttttccttgccattttgcactgtattctgagagaatctctgagctcaactttccagatcaaaactaaatcttcagctatgtccatcctgcccttcagtccatctattgagatcatttcatcatagctataattttaagatttctaaacattctttttcttaggagtctattactttttatggatgcaatagactttttaatctgtatgatgatatttattgtaatttggggttcactcattttctatactaactcttttttcttcaacattactttcttcattaaagttgctttctttctcctgttgacttttcttgaatgtttggtaaattttgactgtctctccatatatattgaaaaagatctagaattttaaaatactggtagctagtgtatttctttagctaaagtgagaagcccttttcccctggcagtgaatgtagattctgattatagaagccctacttctcagttgttgtgaggaataggccttggaggtggggaaaccccttgtggcagccctagcaccccctttgggagattccctgggcagaactcccattttgagtcatatgctcacaattgtaatcccatggacaggtgccagagtcagctgcactcagagcaatggcctggcagcagctgttcagccatccataattatccagcaattgcccatggcctgttcctttatttgctcaaatgaccactgagcctggagttgttctggtgttctgggaaaattcctctctttggaaaatctctttctcctgttgcaagtgttttagtttagttgaagtttcacaatcagtttgtttccatttgtgttttgtctttcagaaattcttcgttgttttagtcttctgccatgaaaatttcttctgcctttccttcggctgtagatttgtgttccccttttttctttcttgagttatttcagtggtgtttttgaagagaaaataaaatataagtgatatatctgccacattgaaccacaagtctccttgggttcgtttacaaatgagaaaacaaaggtccagagaaaagggagacacataaacacacacagacaaaaacttccccaaagtagtatttgtagaataaaccaggatttaaatctcaatccacctggtttcaaaacatgttgtgtgtatgcacacacacacacccaagcagtgtggccaagtgatttaagtaattttgttagaaatgttctaccagagcacatccaggtaaatactgctttttcaatggagatagcttttatgagggtactgttgatcagaatgtgtacagcatgcctgtttgtcagtaccttcaaaacctttgctgtgtccttttgactatcttcaaatccctattgtttgagggtagatttcacttttgaaaatttccagtcatgtggaaccaaatacgttgatctaaaaagaataatgctgttttttttaaatcaaaaactaaaaagtgtacctatgaggaaacttattttcttgaaggacctgtggactggttgagatagttcctgaagaattccaaaaatatttaagcattgacatcactggaataagtgaatgaccgtgtgaggcagttgtttttgtgttctgtgaacataaacattctgggataatttttttttaatcttattaattcacagtaaatcaaaaatattgtataactataaaaatcactattttcgtatgcaacattttcagtacctaaaaagatccatttttcagcttgggcaacatggtgaaaaatgggcaacatgggcaaaaaatacaaaaattagccaggcatggtggtatgcacctgtagtcccagctacttggggagctgagacaggaggatcacttgaacccaaggaggtggaggttgcagtgagccgagatcatgccactacactccagcctgggcgacagtgagaccctgtctccaaaaaaaaaaaaaaaaaaaaatcctttgaagttacatttcatggtttttgtatatttgtttatttatttttagtgattaagatattcacggttcaacattcaaaaaagtttttaaaatatatagtgaaaaatatctttcctggcagtatcgttttttctgtaccttcaaaaattacgtacatagacttccctttttaaaatacaaatagtgtcatactatacacattagctgttctgtatcttagtcactttttcacttaatgttctatggatgtcattctgtatcagtgcataaagagcatctttattctttttttatagctgtacaacttcttacagttgtaccagaatttacttaaccagtagcctgataggcatcttttgctatcacaaagctgtaatgaataatcttatgtagagataatttaccacatgtgacggtatatctgagatacaagttctgaatagaattgctgggtcaaaagatagatattgccaaatagtcctttccagcagttgtttcagcttacaccctaactgataatgtttccatttctgcatatccttgccaatacattgaattatgtactttctcatttttgcccatctgatggttttattcttttaggtatctcaatgtcattttaatctatatttcttttattgtgaattagatcatattttaatgattttataatattcatttatgttcatattctctacctattgtcttactgggtttttatcctattgatttatagaattttttatatgttagaaaaatgagttctttgtctacatcatgttttgaaaaaaataaaacactgtaactgctgtgcagttactgccaaatgtaacacaaaactaaaccagaaacttccttaacaacagctgaagaaaattaactgtgaatatcaaaatcagtagatactaaatcaactgttagaagagtagaatgtgcaaaagccaccctcatggttaagaaaatgctttctacttggtgtacagaaatttttttctatatcctaatcttggaagtgacagaaatttttaaattatttcttaatataaggggggtttttttgtttgttttttgttttgttttgttttgttttgttttgtttgctgggttcagtgtcccttttagctatattttaaatggaggaagtatgatgttgagccctttgcaaagatgataacgaatgttaatagcttgatcgggggatccctagggcttgttttctgcccctacttcagctgcctgtttccagcagaaatgactgtattgtcctgtattacatgtatacttactcatgtttgtgtcacagaaatgaccaaaaatatttcatttattctctggacaaagagagagagcctgtgtatttcctagaagaaatacgtgaagcataccttcacattttttacagaaggcagtttctaaagaaagtcgcaaaaggttgaaatgactttcagaataaaaaccaacttcttttaagcatgcagtctatccaaacaaaacttttttttgacttaaaattttattagtatggggatttttttgtttgtttttgtttgcttagtcaccaaactcagcatatgaatcttattttgaaaatattttatccaacttattttcttaacatttttttcaagactagtaaaattagatactgtgtcctattactgagtcaaataaactatcttgcaaaacttagtattgctagtagacagtggacagccatgtaaattttcttagacttttaaattaattaattttggttataataattaagattagatttcttgaaataagattgaggaattaacatgtaggcagagccaatgggacagttttagataatctttgaccaactttctgatttaaataatgacagaaagtaagtgattatttccctttttttttgttgttttattttgttgtgtttttcagaatcctacagaatttgatttctatatcatttgtcatgatagagatgaggttaatcgaaagctgtaattatatacatttaaaagtaaatgtgtttatgtaacttttatttctcagttatactaaatattgaatatattcacttagaagtgagccttgcatgtattatgtagttaataatgttcagtaactagcattaagtacattttgggaagcatccttaaatctacttattcttcattcattcgaatgagaaattctacctcaataagctttcccttaaaactccaaggctgttttagtttttaaaaaaagattctatttgggctactataacaaaataccactgactaggtggcttaaacaacagaaatttattttctcacaattctggaagcctaaagtagttttggtttcttctgaggcttctttccttggcttggagatggccctcttctctctgggtcaggttatccctctgtctgtattttttttctcctgaactcctcttcttggaaagacactagtcatattggattagggcccactgtaaagacccattttgtcttagttacctttttaaaggccctgtctccaaatatagtcacattctgagataccaggggttaggacttcagcatattaatttggaggggggtacaattcagcccataacaatgatcaattaatatatattcattttagaaatttcaaataaccatcatagaaagaaaagcagcctttaatctcactacctaaagtggacctaaagtgtgcgtgtgtgtgtgtgtgtgtgtgtgtgtgtgtgtgtgtgagatcccagaatttttttatattaatatatatgaaatagtttataaaaacagagtcatcctgaaaataatgttttggaatatgttttcttttttcatttaacagcacattgtcaatatctatgccataattcattaatcagtccctaagtttctggaatttaggttatttataaatttttttctagtataaatagtacagagatgatcataaagctttccaaaaaagcgttacagaaaaacgttctaaaatgcatatactattttcttcaattacaaaacataattcaacttcttttttcatttgggccatcattataagtctcagttcttatactgttattgtacagctatattctaagattagcaactgtagagctgtgttcatttgctgcatggcctcagattctagtttctgttcctgcctctgatagaatgtattttatcttttgctcaccactcttatttcgtggtgatgacactgtgttacttatagcatattctgatatgtgactgaaaagcagataaccaaaattgttaaatttatctttaagataaataatttctgacaaagtcctgagtgattctggataacagtaacctatgtacaaactttaatatcagattttccttgattcagaaatcttttttcactttctcatttacttttttattatgtggtcacactagatagtttaaattgctgaataagtgacctttgtatcattgaagtaatattttaaaggagaaatctcactctccaatatattatttttgaaaataccatcattttatcctccactgagataatgacttcttaccttttcttcttaaatcaggattacctgagctggaattggaagcaattgataaccaatttggacaaccaggaacaggcgatcagattccatggacaaataatacagtgacagctataaatcagagtaaatcagaagagtaagtaatacattttgtattttataaggtatcagataccaacttctaaacagagaactattttttccaaactacatttcagtctacagtggtattttgtgagatattaatagatgtaaatacttactaaaaaaaaaaaaaaaaagtgggcccggtgcagtggctctggcctgtaatcccagcactttgggaggcggaggcaggtggatcacctgaggtcaggagtttgagatcagcctggccaacatggtgaaaccccatctctactaaaaatacaaaaaatttgccaggcgtggtggtgcgcagctgtaatcccagctactcaggaggctgaggcaggagaattgcttgaacccaggaggtggaggttgcagtgagccaagattgcgccattgcactccagcctgggcaacaagagtgaaactctgtctcaaaaaaaaaaaaaaaaaaaaaaaagggtggcggggacaagggaaagacactgaattaaacagatttattgactgcatgaccacaaggctagtatacgttgtaatcaccaagagattgatataatatgtagctattgttttatatttcatgtattactttaattgattaccataatgtatctgggacctatggatgaattggcctcagtacaataattatattgctcttgaacttttagttatattattattttgtccagcatttctcttcgtttggtgcaagaagttataagaaaggaaagtatactttttacatctactcagtgtcacatcttgattagaattgaatttcttactccccgcaggcagccatattccataacgcaggctgcgtctcatacctgccaaccacaggaagactagatagtattgattgtggtttagcgccttaactatgaactgtattcccatttaccttctcaaaggaagaatgcttataattgtattattagtgttattaggattagtattattttgtatatatttctgttttatgtatcagttggtatctatttggattagactgtatatttcctacatgtaatcagtgaataatttgttgcttaatacctagcatatttcatttttccagtttgatttcttttgtaaatggtaatcatgtcatgttaacaatcaaaatgatttgatcatctttaaaagttaatataatatgtactgttttgattgtggttcagttattaacaattaatggcattcataaaaggtaaataaatagaataagtagaataaatctgaatataggctaaatgattttttctcagtttttggctgattttgtttttacttttattaaaagttatttcccctttcttaactgtttggttaattttccaggctatttctggaacataaagaatatgggaacaaagttcaatgactgacaaaagaatgaaaactatattcaagctacataccaaatactcatttaatttctacacattaaacatagaacattccatggcattagaattgccaagcatctcaacagtgaattttctaagaccaaatttgcatctatatatgtatataaagattgaataaattatttgctatgtcagtctgaaactttcttgttttttaatcctgcagccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggtatttattaaagtcaacattatttaactgatggagccctaagaagctagaaaattattttaagcaagattttaaagtattgtacccactatgctttagctgttttataatttacctcttgtgaaacttatcaaaatatatgagttttttttttaagaaaaagtattacagtaattagaattagaaataagtcttagcttttcactatggaacagaatcttacaagctccagccagaatagaatccagatttatagcatcacttctcattttagagcttaatttatccttcattcacgcttgtcttctgccagtatattccatggtattgcaacttccaggttagccttttttacacgatagggtgataaaatcactttagtgcatcttgaccagcatttttaaatggagtagaatagtgtagaatacaaagtatgagaatgcatagcccataaaaagaagtcatgttttgtgaaactcctttcagctgcatacaaacacacacacacacaagcacacgcgcacgcgcgcaattaggtcacaatttatatttcttacagtgggtaatagtgaaaacatttggaaaccataacgctacagctttctgttacatgagctgtggatttttttttcaaataaaagcatgaattttatatctgagatagaaaaatgcctgcttgatccctcctttaagaatctacttcctatagtaagctattaaatgtaaagtttattgattcttaggctttgcaatgaagttttttcccaaaccttttagttttatttcattgatttggagcctttattttaactatattgccatctctttactgagattttaaatatctcagctaatccgttactccatttcaaaagcagcttttataaatgatttctttaggtagtaaacttctggagagcatgaattcagaatgaatatatgatggtgctttctagaaatacggaagcatgttacttattggcagaaatttatttgtaaaatattctggcttcttttctaacaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcaggtaagtgctcttgtttagcagttgatactttttttttttttgagacgaagtctcacctgtcaccaggctagtgtggctagtgtgcagtagtgctatctcagcccactgcaaccgccgcctcccaggttcaagcaattctcctgcctcagactcccgagtagctgggattacaggtgtgtgccaccactcccaggtaatttttatatttttagtaaagacagggtttcaccatattggccaggatggtctcgatctgttgaccttgtgatttgcccacctcggcctcccaaagtgctgggattacaggcgtgagccaccgcaccctgccagcagttgatactttttaaaggtatataccaaatctctctgcaaggcagcccagttgctacaataaaagtgtcaagtccactcccagaactttcatgaaagacttgaagagccatccttcctctcctaggaaagggataagggaccttttcattcaattaaagacctttcattcaattaaatcaattcattcaattaggctcctaataaagcacttagagacctataacttaaagaacaatttaatttttattttttgagatacaaactatttaaggggaacatcatacaattattaaattaagagaaacagcttaatttacaaagtagagcatcaagagatactgtttatgattattggaaaagaaaataaagtttatttatattgattgaggttggagagattgatgcccagtgatgttactatattaggagaatgaaggagaataggggcctgggagttgtgagtgagttaaatcttctctctcatgacaggaaatgagtaggcgtagtggcataaatatttaagattgtataagcaacagatatggagataatcattaaggaccacaagagcaaacagttaaaaatgtctgctgtgggccgggcgtggtggctcacgcctctaatcccagcactttgggagaccaaggcgggtggatcacttgaggttaggagttcgagaccagcgtggccaacatgatgaaaccccatttctactaaaagtacaaaaaaaaaaaaaaaaaaaaaacgggcatggtggcacgtgcctataatcccagctactctggaggttgaggcaggagaatcacttgaacccgggaggtggaggttgcagcaagccgagattgtgccattacactccagcctgggtgacagagcaagactctgtctcaaaaaaaaaaaaaaaaaagccagctgtgggaagggggacctgagctgtagattgttgctgcttgttatgaatcttgtagtttctaaaaccatatttgtatattgccttgaatttttataaaagtatttaaagaggttccctggagacttactaattcaggaaggaagagaaagaaggagataaattatactggaaaggcagtatgatgtaatggttttaagagttctagtttcaagtcccagttccaaacttaagtgggttgccttaatcaaatgatttaccttttaaaacctctaattcctcatctataaaaagagtctaataaagaactcctttccctcactggtggttgtatggaataaatgagacaaaacatgtaaagcttgtagcataatgcctggcatattgtagcagttgataaatattagctattactataaagttgcattcaataaacataatatgtaatataaaatgtgcttccattctgtttaaaaaaaggaagatgacgaaagagaagagaaaaggagaactaagaaagggaaattttttaaatgatagaataacaataaaaggaataattttttaaatgctagggtagaataaaggattcaaagaagaattaaaggaagagagaggaaaagagaaagagaaggaatcataaatgttctgagatattaattgaagataaactacttcttgtagctttccattcatctttagatagagggcaccagaataagaaatgcttaacagtttccccgtgtttaatttttcacagaacatatttaaggggactacactaggtactataaggaatacaaggaataaaagaaacaggcaactgcttggctttttgactacaagacctgaaaaccattttgactacatacctgaaaagttaagtgacgctgcaagcagtatgtgattaagggctaaaccaaaaaagtaaaggaaagtgtaggtgtgctagtttctcattttacaatgtaaagttctgtaaatactgcctaatattaaagggtcaatgagcaaggccagaccaagggtctaggtcaggttcatgaatgaatggaatgatgattcatgcttgattcagaaaaaaaaagttgttttggcttccatttgctcctaaaacagctgataagcagagaagccctgcaaaggtatgagaataagatgcaaataagtgaaagttgctgctctttgcttcccttaaatctcatggatgcctatccagagatggcatggtaacctaacagagtaaagtatccaccaagttgaagaaacacagaatttggggctcaccatgttataagccccatgtatgtctatacgcaaaaacaacttctactgcaaactaagacagtaactctgctacctaacgagccacatatcggggcctgttccttctcttttaagccataagttcttactgtttcagcactaggtcgctcagcttcacttgcactgcaagtactaggagttttacatgtgtccacttaagggctttctgtgagcaggtctggccaaggttctcagtcagtgtcttggttaagatgctttcagccacaaggaaagaaaaaaagatcaactcagcatagtaaaacaataaagaaaatattttgacccaattgacaatccaaaatgaaagcagaccaaggtgtggttacttcagagattcagggatgttatcaaggacccaggttctttctctttttgctctgcaatccttggcatgccatgattacaaataccgtaggcaaacaaaactataactagcagaagaaaagggactgtttctttcctatgtacctctttccaaaagccaggaaactttttccagaaggtcttcccaccccatcccccgccaaaaaaagaaaaaaaggaacaaaaaaaaaaagtaaaaagggggaaaaaatacttcacatgtctgactagtcagaactgagtcacatgtacacccttaaccaatggttcgcaaagactgactgagaatactcctggattacccctggagttgtgtgatttgggatggtcagctgaacaaaatctgttctgtcttcaagaaagaaggggagagtaaatggctgcgggttggcaataacagtgcctgattaaatcaagaaattgaggtttaaatatattgtttaaagttatatagttaaattcacagttgggataaaatagtgaactgaggtagtattaatatatctcccctttctcctgccttaaatcctattaaataacaggttgtattttttgtgtctgtgactaagttcatgtcagtgtagacaaaaaaaagaacaccattagcgcactaaaaattaagtcattttgaaatacaaaaaaagcaaacatgagaaagaaacaaaattatatgcaaataatacaactatttatatagaaaatccaaaagaatctggccgggcacagtggctcacgcctgtaatcctagcactttgggaggccgaggcgggtgggttgcctgagctccggagttcaagaccaccctgcgcaacatggtgaaacctcatctctactaaaaatacaaaagttagctgggcatggtggtgcatgcctgtaatcccagttactggggaggctgaggcaggagaattgcttgaaactgggaggtggaggttgccatgagccaagattgtgccactgcactccaccctgagtgacagaacaagactccatctcaaaaacaaaacaaaacaaaacaaaaaacagaaaatccaaaagaatctatagggaacttagaacaaatagagtagttcagcaaggattttagataaaagaacaagaaacaaaaattaatggcaattctttttactagaaaattaattaaaaatacattcaggccaggcacggtggctcacgcctgtaaccccagcactttgggaggccgaggtgggcggatcacctgaggtcaagagttcgagaccagcctggccaacatggtgaagccccgtctctactaaaaatacaaaaattagctgggtgtggtggcgtgttcccagctactcaggaggctgagacaggagaatcgcttgaatccaggaggtggaggttgcagtgagccaagattgtgccattgcactccagccttggtgacaagagcgaaactccatctcaaaaaaaaaaaaaaagaagaaaaaagaaattcacactgttcaaaacttagaagatgtggaagtcataattgaaaggcaaaaagaacatccaaaaaaaaatactcatgaaagaaattatgtctcctaattggttgtcgcttgtaaaaagatgacagttgttccaaattcaatcagtaaattcagtggaattccaataaaatctcaacatggaatttgacaaatagatgctaaatttgttttagaagcatcaatacaatcttgaagtattaataaaatgagggtatacttgctctaccgatatcaagatttaaaacaaagctttaaaaattaaaccaggctggatgtgatggcttacacctataacccccccattttgagaggcgtaggcaggaagattgcttgaggttaggagtttgagactagcctgggcaacatagcaagactctgtctctaccaaaaataaaaaaaaccaaaaaacaaaaagccaggtgtggtgatgtgcacctgtagtcccaactacttaggagcctaagttgggaggatctcttgagccagagttcaaggctgcagtgagctatgattgtgctactcactccagcctgggtggcagagcaagaccttgtctctaaaaaaaaaaattaaaacagtgtggaactagcatgaggataaatagttctaccataatagagttctacataatagacggttctgcataatagctctacataatagaaagcccagaaacacacccagacatattgagagacttaataagagacagaggtgacaatggggaaagaatggcgtgcatcataaatgctggtacatttggctgttcatgaggaggaaaaaattaaatttgatcctcatcttatacaagacacaaaaataaactctaagtgttttagtgacctaaatgtgaatatgaaaatatctctgtagcctctttaaaatgacataaaggaaaaagtaaatgtttacattaaaatttacgacctagaagacaaaagacaccataagcaaggttaaaaggcaagacaaagactcaaagaagatgtttccaaccccatatgactggcaaaggactagtgtccagaatacacccagtttgtaatctgctattcataatatatttacctcattggattgatacccacccatctgttcgcttattggtcatatcctctccttccctcttcccaaatacaggagactgtaagcatctcatagcaagaatttagcaccatgcctagtgatttgagaaaagaaaacgggtgtactcagatatacattatagtttccttctttttggtgaattttaaggtcagtttaaaaacagatgttgaaaaaatatatatatataaatagatatcatttattggccatgagtatatctcactggctggtatatactttttactccttgtgtaaaggagtaaaaagattgtaacattttaaattcaattacacagtaatgaataaatccccagttgggaggagagagatgaaaaacatcctaggaaactagtgtatctgtattggttgagatttttaaaaagagcaacaagaaggaaggagctgatgattaaaaagcaatacgaagttacaagcctttaggtgtaatacccgcttactcctcaaataagcaaagacccaagaaatatatccgtaatatcagtaaaggacttctaaaattctattttgggaaaaagaacaacagcaaaaatgggtagacctgctgcttttagaaaatggtatcataggctgggcacagtggctcatgcctgtaatcccagcactttgggaggccaaggcaggtggatcacctgaggtcgggagtttgagaccagcctgaccaacatggagaaaccctgtctctactaaaaatataaaattagccaggcatggtggcacatgcctgtaatcccagccacttgggaggctgagacaagagaatcgcttgaacccaggaggtggaggttgcagtgagctgagatgtcactgttgcactccagcctgggcagcaagagtgaaactccgtctcaaaaaaaaaaaaaaaagaaaaagaaaaagaaaatggtatcattagctgacaaaagatacgatttttccactccagttttgttttcttccccagcaaggatcatgatcttcataactatcaagaggagaataatataaagagaaagtgacagtgagacacataaacaaatatggtatacttagcaatcttaaaacaagtcaagtccagatacgtatgtgttagggtactgaacaaatgtacgtatctgacattataagaaccactattgatcatcttttatatattatagagaatagaagtgatcagaaaacagaattaggattaaaggacagaaaaaaagagagaaacattttaccttcaggtttctggcaatgaaaaatgcccaataggacaataagtttctttaaagaatacttttgtctttgcaagaatttgtgcagtagctagctcagggtttctcaaccttggcattttaacatttggggctgggtaattcttgttatgggggagatgttgtgtgcattaaggatgtttagcagcattcctggcctctgcccacgagacgtcagcagtacctcctctcttagttgtgtcagcgaaaatgtcttcagatattgccagatgtcccttgtttggcagaatcacccctagttgagaacctctaggctagataatcatcttttaggtttcctataggaggacttcttggtaaagcactgggaagaaaatccattccggcagacaaagtgacagccagcctgaactgtgtgtgtttattttatacttaggaatgggtttgccctcttccgctggccacaagccccacatttccttttcttctacaacaagccttttaacctgtgtttgtgtctaaggactaacaactaatctcctcccactccccacctctctgaaagttaagatttccaaggagctgaggaatgtagcgatccttttgggaaggctatgttggaagaagtggaacttgacctacttgttgaaaaacaaagcattttaataattggagagaagaggcaggtcaaaataagacaggtgtacacagcactagtcaggttgcacacacagatagtcaaggggaggaaaaaatgaacaagggttaattcaagggcagaaatagaccaggtttcctataacagaaagtacttgtagatttatgctatttagaataattccttctacttctaaaaaagagcctattactacttgtcaggcatctttcctccatccctacccatttcatttgtacattatctcacaattcaaagaatatataaagctatatgtttggaatgtatttttacctggcctcattgcctcctctcctgtttttttacttgctgttccctctgcctcaagttaactctgccctcctccttgccaccttgcattctcatccttcaagatgaatgcaagctgagctcactcatgcttcttggtccctgtcttcatccctagactgaatgagttgctccctctgtgctgccgtagatgtgtccgtctatgcagacaaagcacctgtgcattttactgttgtgcgttggcttctgccactcaatagggaacggaactcctagaaggacaggaatttgctcacctttgtaacctccaaactttatacagtatcttgaatgtactgagtttttaagtaaatctttataaaattaacttggtttatctaaatttatgttcctggtctttcaagtttaagaagtatatcagttttggtatttaagagtctttttgacttttaaaactataaagttggtatctttctttttgaagtgactcagaacttcaaaaagttttaacttattccacaatgccttagatttgtcattttaacatttatattataatgagcttttccccaaaattggtttgttttctgatctaatgggagtgagaaaatgactgaagttagaattaagagttgagctatttgatgacaagagatttaatcactgttcatagctctttggattcttataaaactttcgtaggctttctagtttatgtataatatattgaaatatatttatgatatataagtatatataatttgtgttttacaaagtatataaacataaaatagtattaatattattgttactgttatcttccggaatagtttattcatatgaaattattgaagaagaaatgttttaagctatacattgttttcaagaaaatctcatttccaagaatacttcttttgttaccagatactgttaaggcatgcctggcatgcctatgacctggaaccctaatcctggtctagactgatcttccaaaccagtattcacagaaaattgttctgagagatagatattaatggttagatgttagaaaaaaaggttcatgataaataaattgcatagtatatcccttcttggcgatccacaatgtgcttttggccaattaaaggcttataaaatttctgcagtaaataaatctgttttaccttgtgtaacccatcatttccagtacttaatacagcacagcatgctgttttcccagcacatctattaatatcctgcagaacaatgttctttagcattgttctttagcataccaatttgggaaatgctggtctaaagtaattactttttctagttaaataaataatccattttttcagaccatttgtttcttacataatactgtctagctaatgaaatcatactggattttccccaaatatgtatccaccagacatagtacctccaagtgagaataccatccagcttgctcaactttcccttcatcttccagacctttgtaaaatgtgcccttactgtatacctgcttttacatttataatattttaagacctagggctggtacttcttcttccccattgcagcacttatctaaaataactattaacatgtttttttgttgttttgtttgtttgtttgtttttgagacagtctcgctctgtcacccaggctggagtgcagtgtgtttgtatcctacttttaaatactttgccatagtgttttggaggcaataagtgttttataaacattgggaactactagccttttggaaaataaacataggaaataatctaaccaaacctgcaacactaaaactttttagtaatcaatagaaagtttgtgttactttataaggcccgtgttatgcttgtgtgtagaaatatatcttattgtttccatttttctctagttgatacaccaaaatcggcaagctatcttaaaccagtttgcagcaactgctcctgttggcatcaatatgagatcaggcatgcaacagcaaattacacctcaggtaatgtgagaaaaccagacgtcattagtacttctttaacccacatagtgtttcttaaagtgttgacttgagtgtctttgaaatggtctgtgagctgatcttttaatgatgtttgtagtgtagttttctttgagaatgaattaataatctacttttgatacctcttactgatatttgatctaaagcaaatggtgctttgttttgttttattgttattattgtcattgttattggataccagatgactaagtagaaaaaactcttatttctgtagcgaatagcaccagtaacaggaagcctctgatacgaaactgtgtgaacggtacccgaaacctgatcaaaacccagtcacattgctaagctgtcttaactatcttgtgtactatgttcaatttgaacatcagcattttctagcttgtatttattttttaaatccctttttttttttaataaacccagagccattagaactttaaacataaaaagaactaggtggacttctaaatgttacctagtactcactctctactttaccccatacatacctaaaaattttttgtttcaactacttacttttatttcataacaaagttgatgtaaaaatcttggagataaggaattttagagaggatttaaacaatactcttttcctctccacaatatggaactagatggattaggagcaaataaagccagcacctgtattattaaagagataaatacagccatgcatgacttaaagacagggatatgttctgaaaaatgtgttattaggcaacttcataattgtgcaaaggtcatagagtgtatttacacaaacctacatggtatagcctacttagcatcctggctatgtgtatagcctattgctcctaggctataaacctgtactgcatgttactctactgaatactgtagacaattgttatggtatttgtatatcaaaacatacctaaacgtggaagaggtacagtaaaatactgtagtattataatcttatgggaccaccgaatttggtccattgtgtgcaactgaaatgtcttattactaaaatgtcttattgctgaaatgtctttatgcatcacatgactgtattgactgaagttgttggtaagcagcagatattgacatcttcatggatccagatttcagtttctctgtcttacaaattataaatcttagtgctagctaattcaggagtaattaggttgtaaggaaacaagaccccacttttggattcacataaagataattcctatcagaaagtcttatttcatagtttcttctagattagactatatgtagttggcaagagctgtatgctttaaccagattctcaatctgaattgacattttctgaagaaggctttattgatatgccatgttacattgaaaaaatgattttaagctaatttgaccacttctttcctcatccataatattataactgaaaccacttacactaatgcctggaataatctgaaactccaataataatacaaaatagctgtttccatttatttctttttactattttatttctacttattttctttttaagtgataatttcttaggcattggatcctagatttcagaatcttccttttttaatggtatttgtaggttttttctaattgtaaaggtagtacatgttcatcgtaataatttggtaaatatagaaaagtataatgaaaattaaaatcacctataatcacatgttattcatttaaataaactgggataatgttctcagtgagaaaagtggaaaaactaagtttctctttaccagaaacacagtaaattttttggaattgaaaaagtcttctaatgatctaatgaaggataggacagaagtcatcaagcacattttctttcacttccttatggtcttcatgtttctcttaacaatgttcatggccaatattataatactaatcaatacatactttctttgaatttttcagttctgtgtgacttttcattgagaatttgcgttctcatttataatggtcagatattgtttagcatttcttgactacttttaatctgtaaaatatacttaattcattttttctcctgtgattgttacttaagaggtttttgttccttttctgttttagtttcccttgtacagtgataattgctatgtactttattgccccaagcaagtaggccttaatccaatgaactttccaggatagatagtgattataataattttagtaagtgagttttttcctgcttttcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggtaggaaggtcacaactttatgttgttctaagtaatccatacaggcttaggtctctctccatctttatgtctgtgcttggacattaaaatagtgtgtggaagaggaaagacactgacgtgggagtctggagacccaggattcagactcagcttttgacactaaatggttgactggtttgaggcttatctcccttttttagctgagatgattgaattagaggatctgtaaggaccttttgagcattttgtatgcaaagtacgttcccccttttttttttcttttttgttagatgcagtctcgctctgttgtccaggctgggagtgcaatggtgcaatctcagctcactgcatcctccacctcctgggcttaagcgattctcctgcctcagcctcccgagtagctaggattacaggcatgtgccaccgtgcccagctaatttttgtttttttttttttgtagagacagggtttcaccatgttgctcacactggtcttgaactcctgacctcaggtgagccaccatacccggcccattctcttattttttaatttttctcattgatctctatgagaattcaatgaaagtcttccccacacaatggattttagtacattaattcaaaattcgcatgtagttttttcattgtgtgggagattttgtttttgccagtttgcataagaataatttatctccacagagtatctcagactactcattggtgtcatcactctcagctgctgctgttgcagcttcctctccaatgtcagtcaactttctggcttccaaaagcttttttcttttttagtctttctttggcactgtcttccattctctttgtcctgggtgataatatcttttcttatttcttttctgtcactttcaggttctgataggtagtggcagtgatgaacatctgattagtctactctgtttaatcaaacttttatgcaaaattaattgtcaattcctgaaaaataattgaaataaatcccttgattatataaatgaaagaaaagaggtaaattttaaggctgcttaaaaatgaatttcaatgagaaagctgctgtttgacttgaataaaatgtcaaagttatacagagatttttgacatggcagtatgcttatcagttttgacagccaaatcaatttagagtttccattctgatggtagcaaatactaaaatcctttgactatcaaattaagtatctaaagacttgtgccagagagcaccagaactctaaagagattttaatcaaaattatgccacatcagtttctttgtcctcaagacaatgaagtcatctttggctggtttatatcagtgacactatctgtgtgggcgagaaaaggattataaatccatattttaattatatggttgcctgaacaagagtatggccttcaaaagagttttatttccatgtgtcttacaatttctgtatgcagagaatttgacaaagctttttcactttagcctgtggaagtacttcctccaacattagaagacttgtgtagtcatctgcatccccattcctcctccaaaatgacaacctgactaaaacagcaaatgggtttttagcagcattcataatattaattgcagagccctaaatcaaaagatttatctcatgcattaggggaaaaagctaactagaagtaagccaaacattaataaattcctcatgaaattattctaaggattttttctattaaaaaatagaaatagtatttctgtccattttcaggcatgtacttttaagtttcctctggaaagtcaagaaaggagaactttatattctgctttcattccttgacaaagccacctggaaaggcggtccttcagtgccccggttctcatgaaattgacaagtttctttcacagttctgggtctagccttttgatctgagttgtgtcagcatagaacaaagtgagctgaaataatggagtgggtggagcttcctctttccccgtaccataatgggaaagatgtgttgccacctatcatgagtatctggtgcctgggtttttcttccagaccaacttctgattgacaaaaatattttcacaaaataagaatttgctttttataaagtcagcattcatactacaaacaaaacccaaatgctgagtgcattgaagagaacagtggtttcatccagttgcaaactgaaatgaaatggcagggctgtcagttcttccatggactgcttcaaaataatactggaaaaatgtttaacttttctggacagagtaagaatgtttaaagatgcaatgtttttaatttctgtcaccactcttaattataaacttgctccaaattgatcagcagtctggtagaggaccaggttttgtgttggcacaaaatgaagttctggaaaagttccagccttttcaaaacaaaaacagtttattgtggcttaaggaaatccagataaaaaggctctttggcctttgttggttttatgcttctattcctaagaaatcggccatacaaaagtaccaaaatatatgtgttccaacatgtttccaggtttgacaaattaaggtccataatccagcccagttgttttggtaaataaagttttaatggaacacagccatacttactgctttatgtattatctatggctggtttcatatagaagagttgagtagttaaagaaactttatggcctacaaaactgaaaacatgtattatctggccctttgcagaagaagcttgctgatttctgtgttaagtgatgacagtaaaaccaacggataactgcattagctttgctttatatcctttgccttagcctctttccacttaatgtaggcccaaagtaaatgaaggaacatgaaagtcatagtaatggcagagtaagttttctggtatttctgaaaacaagaaacttttctagactaccatgctatgataatgagtgtaaaagaacagaatcagactttagaaattgttttcttttttcttttttttttttttttttctttgagacagagtctcgctctgtcgcccaggctggagtgcagtggcgtgatctcggctcactgcaacctccacctcccgggttcacgccattctcctgcctcagcctcccgagtagctgggactacaggcgcccactaccacgcccggctaatttttttgtatttttagtagagatggagtttcaccatgttagccaggatggtctcaatctcctgacctcgtgatccacccacctcggcctcccaaagtgctgggattacaggcgtgagccaccgtgcctggccagaaattgttttctattaaggcagtattcaaagtaaatatgagaaattggtttctttagtgtatctgcccacttcatgggttccttcaagcccatttagagacttcttttctgtgaactacaataaaatcctcttccacctattcctcctcagtgatctcttctccttttggggtttcagggacctttacatgctagtgactttattctctatctctaaacagtatctctcagctcatatgtacagctgcctactggaaacatatacttgcattttccaccaacaccccaaacttaacttgtacaaacctagactcatcaactccatgttcccttttatagttctgtgttccagctacagtaaactctgagttccgagaaacagcacagaccttgttctcttttacttccaggggctttgaacattgtctatactctatctaaagtattcttcctttacttctcattcctattcttccctcctctcagatatatctcctctgcagagtcttcctggacactcccaatcataaagtagtcaacaccctgtcttaaaaccacttgttaacctagctgcctttctttttaaatagcaagttccttacgtgagcagagtgtgacctttttaaccattgtttctccagtgcttagcacagtggtctcacagtgaatagatgcttaatgaatctttgaagaaataaatgaatgaaagtatgaattctaattctagttgccactgtcacatgtctgcaatgctagttatggttggtctagcagggaaacttaacatagtctagcccagctgggcacggtggctcacgcctgtaatgccagcactttgggaggcctaggcaggtggattacctgaggtcaggagtttgagaccagcctggccgacatggcgaaactccatctctactaaaaatacaaaaatcagctgggtgtggtggtgggcgcctgtagtccagctactcgggaggctgaggcaggagaattgcttgaacccaggaggcggaggttgcagcgagccaagatcacgctactgcactctagtctgggcaatagagcaagcctctgtctaaaaaaacaaaaacaaacatagtctaggcaaagatagaactgtaaaatttttcatctagaagaactagattatctgattgatgcaagttatccaaggtccagtgtgtagcagaactgggaccagaactctaagtattcctctaattcattacccacaggctagttctttctgctaaaactgggtcatttcacagacgatttttagagaaatgaaaccactctctatgatactataatggtgggtacatatcattatacatttgtccaaatccatagattgtacaataccaagagtgaaccgtaatgtaacctatagactctggggtagttgataatgaggacagttatacatgtgagtgaatggaggaggggtatgtagcttcatttacataattttaccaaaaataaaccctatctagtgaaagaaaaaactgtaaagtctaaagttaggaaatctcagtaccatccacttagttttgctttgaacctaaagcttctctaaaaaattgtcttttttaaaataataaatttaaaagaccaacactaaaaacaacagcaacaacaacaacaacaacaaaacaaaccacaaaaaagtcatcttctaagggaaactgttcattccaatatgaacagttagaatgtgagatgaagccagaaagaaatatcagaaagcttgctcttgtacttggagtctcttatttattgtttactgttgaccccacaaagtaatatccagaatatgataagcatcttttcccgctcacatatttttatttttatttttctctttttttttttttttttttttaatcttttgagatagggtcttgctctgttgcccaggagtggcgtgatcatggctcactgcagtgtccaactcctggtctcaagtgatcctcccacctcagcctcctgagtagctagaactacaggcatgtaccactgtgcccggctaactattctattttttatagaaacgggtctcactacattgtccaggctggtctcaaactcctggccttaagccatcctcccaccttagcctcccaaagcactggggttacaggcatgagccaccacaccaaggctatatttcttctaaaagaaattaatttcatcataaatgaggttaaaaacacattaatacaagagtttttcttttaaggatcacaaccaaaatagtttaaaatggagagttaatgcaaagacattagaagtgaagatggtggcaaaacaaaaacaaaaaacccaccctctagagtcataaatgaaaaaaaaaatggatgctgggcacagtggttcatgcctgtaatcccagcactttgggaggccaaggcaagtggatcacctgaggtcggaagttcgagaccagcctgaccaacatggagaaaccctgtctctactaaaaatacaaaagtagctgggcgtggtggcgcatgcctgtaatcccagctactcaggaggctgaggcaagagaattgcttgaacccaggaggcggaggttgtggtgagctgagatcacaccattgcactccagcctgggcaacaagaacaaaactccgcctcaaaaaaaagaaaaaagaaaaaaaaatggagacccatatattctaaatcaaaattacttaccttacatatagaggaagcgacaaggagaaaatatgtagcttcatttatataatctttaccaaaaataaataaaccctatctagtgaaagaaaaaactgtgaagtctaaagttaggtcaacttccacagaaaatttaaaacggttttaaaattctagcctataaggccgggcgtggtggctcacgcctgtaatcccagcactttgggaggccgaggcaggcggatcacaaggtcaggagatcaagaccagcctcaccaatatgatgaaatcccatttctactaaaaatacaaaaattagttgggtgtggtggtatgagcctataatgccagctactcgggaggctgagacaggagaattgcttgaacccagatgcttgaagcagaggttgcagtgagcagagatcacgccattgtactccagcctgggcaacaagagtgaaactcggtctcaaaaaaaaaaaaaaaaaaatgtaacctataataaaaaaaacgagtaaattaactacatctctggcaaatataatgattttctctttttatttaaccaaataaaccaagtaaaaagagaaaaaaatcattatattaaaaataaccaaaaaaattacattaatagtgacagaacacagtagatattacacaggcatatatgcatgtgttcacaaagtgacatcaaggacatagaaacatgtttgtgatgtaatgttgagggaaacaagcaggtcacagaatgttacaggattttataaagatgtaaaggaattttactaaattatgggcaatcatactatggcatccttttttctgcacctttataactttctcttccttaaaagtatttaactgtgagatgtattttgtcaggaaaaaaagaaagaaagaacacagtgctagcattaaacattaaacattttttaaaaaacatttttacacttttaaattctaatggatatctactttgggccagtagagtaagagggaccagagttactttcccatctgaaacaaataaacaaaaaacagacaaagtacattcaacagtagttcttgagattgtccagactgtgctgcggggagggagaatccaacaggagccaggccatttccctgagctgaggaggtggagctggcagtctgggaaagccaagacacctagaggtagcagggcacaataccagagaggatagcactacacagagaattgtaggatatgcagagggtcccattcaagtcttcagctgagagctgatgcgcgcacgcgggcatgcgtgtttgtgtgtacaaatcaaggccagagaaaaccacctgaaaagataagagggaaccatcttcaaagttcatacagggccagttcctcttcctaccagccagagtagaaaacctcataattcagggggtatcaagtagaacactcagagatggtttgcctcggtagtggggcaaaataagccctaaactctgctcttgtctcattaggcacaagacctaaaagaattaacctgtttccatgtagcctaaccacagcccagacaaaggtcaaaaatatttaaaagaagagaaaaaaaatccaacacctaataaggtaaaattcacaaggtctggaatctgatttttaaaactaccaggtatgcaaagaagtaggaaaatactacctgtaatgaggagaaaaatcagccaatcaaaaattcagaaattacacaggtgatagaattagtagacagagacattaaagcaattataaattataaattctgtttgttcaagaagcaagaggaagcttgaatatgttaagtagagcctagagccatggaagatataaataaaacccaagtcaaacttctggagatgaaaactacagtgtctgagatttaaaaaacaaaacaaaacaaaaaaaaccctagatgagataaacagcagattagaaattacagaagaaaaaaatagtgaacttaaagatataacaatggaaactatccaaaatgaaatcagagaaaaaagactgaaaaaaacctggtaatttactcaaaattgatcttataattcaatgcagaatttcagcatgctttttggagaaattaacaaacttatcctaaaatgtatatgaaaatgcaaaggacctagagtagccaaaataatttttaaaaggaagaacaaagttggatatctacctaatttcaaaaattaccataaagtcgcaacaatcaagacaatgtggtgctggtacaacatagagatcactggaacagaataaaaagttcagaagtaaacccttacttttatggtcagttgagttttgacaggtcagatggctgctaataagcatcatcctaaataaaaaggaatagcctactgataagtgctccaaagtggctgaacctcaaaaacattatgctaagtgaatgcaagccagacacagaagaccatgtatggctacatttacatgaaatttccccccaaaaagcaaatcttttagagacagaaagtagatcagaggttacctgggactagggatgggagcaaggattgactacaaacaggtacaaggaagggaatttggggaatgattaggtgtctaaactggatcgtggtaatggcggcacaactctataagggaatttggggaatgattagatgtccaaactggattgtggtaatggcggcacaactctataaatttactaaaaatcattgcattatgcagttacagtgtgtcaatttcatgttgtatagattaagtctgaataaagcttaaaagggggaaggagggggggaagagtggctaacaaaactttctcattattttttattttcatacatggctttttctttttcttttttttttttgacagagccttgctctgtcacccagggtggtgtgcagtggtgcgatctcgtctcactgcaacctctgcctcccaggttcaagccattttcgtgcctcagccttccaagtagctgagataacaggcgtttttgtatttttagtagagatggggtttctcatgttggccaggctagtctcgaactcctgacctcaggtgatccacccacctcggcctcccaaagtgctgggattacaggcgtgagccacagcacccggccacacgtggctttttcttaactattatttaatttacagccgggcgcggtggctcacacctgtaatcccagcattttgggaggccaaggcgggtggatcacctgaggtcaggagttcgagaccaccctggccaacatggtgaaaccccgtctcctctaaaaatacaaaaattagccaggcccagtggcaggcgcctgtaatcccagctacctgagaggctgaggcaggagaattgcttgaacccagaaggtggaggttgcagtgagccaagatcgcaccactgcactccagcctgggtgacagagcaagactccatctcgggggaaaaaaaaaaaaagtttaatttactacacaagtaattcatcatgtatgttcatacatatttttacacttaaaaattcacataagcaaaaaagaacagaaatagatcatatacaatcctgctgcacaaataacgtcttagtgaatggaaagcattattccgagcttacatttatttcattggtttatgctgagatttcttgccctagtttaagatactaaattttttccatgctctgttgaatgcgatatttgtaaatatattgcctgacacaagacaaggcaaataagaaagttatttgtaaatatattgtgacagatccttttgggttttttcatttatggggttaataaatttatagtgtatcaacataaattaatttgtgtcaatttacaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaagtaagggggcagtttttatatatgagcatccttgatactgtgataaatccttgatactgataaatgctacagtggttgaacctcaggaacattatgtaaagtgaaagaaggccggacacaaaaggccacatatggctacatttatatgacgtttccccgttcccccgtttatgtgtggagacagaaagcagcacataagaacagccatgctttcatgggctgattgtattcacaggctaagtagaagattattggctacttccatttgcataatggaaagaactaaattttatattatcagcaaagaaaaatgatttttaaatcttataagtatcaagtcacttctaaggcaaatttgtgtgctgacagtacagaaaagtgatctaggtccccaacctttccatcctaacctgagcacacctgcagaatatgatgagctcacatcagtaacagagcttccctgggacagacatagaaatgggtacttttttaaaagtttttctttataagaacactttaaaatcttataaatctaaaaccaagaatggcaaatgtcagaattcaatagagctgagtagtgggcacacaagtttcacttttctcgatgtatttaaagactttataacaataacaaaagtttttaaggcttaccccttttagaatctctagatttttagtgaccttgactcacccatcttgcttagaattatctcactaaagcctttttttttttttctccaaatcctggctgctgaacttttcacacatcactttgagttttataaggattttaatttggttgtgtcttagttataatgacagggaagctgtctgatctgacaacataataagtaaggcagttaaagttgaaaacacaagactatattcttctaaagttcattgaaaggtgagagaaaatcttcatgttagagaactgtgtaggtctcagtgaggaccatgtataaattaggtagaaatggaaccatatctgtaatacaagaggaatttagtctcctaatgtattctaatcccaacttcctaaactcactctggattttgtggcccatcattataatcactaccttacaggtactctgactcccttgcctatctctccctctgttgcacttatgcctggcaaaattctccctaatgaaatccaactaaactcttactttatacctccacctaagtattgaaatatggcttggggaaaaaaaaaaacagtcatgctgacatgtctcaataacctatttctctgctcccctttacagttaaattccttaaaagattatactctatccacttcccctactcctactccttgttgaactaatcaggctttcattcccatcattccacagaaagtgtccctgtcaagatagttaaatgtccttttcagtgccaaaagcaatgctcatcagtagcatttgacatatttgagcatttattctttcttgaagctcttcatttggtttctagaacaactctctgtcttgagaaaagtgactctcctcctatcacttagtctccttgaggatctttctcatctccatgacctccatttgagggccccagaggtgattctaggacctcttcgccatacccactccctcctttggttgcatcacccatcttactattgtcaatgcctactgctatgcttgactcccaaatttaaacctccagtgcagatggctttcctgaacaccatactctatattcagctgcctaaccaatatctccacttataagtctaataggcatctcaaacttaacatgatgaaaactaaagtgatattttcaccagacctgctcctctgggttactttttcccatttcagtaaatgacaattccattttccacttgtccagaagaaaagtctttctctttctcacatcccacatccaacacatcagcaaatcatgtcagcttcttagcacctctctcttcttacctattccacatgtgcaccttaatgcaagccacaatcatcttttccctgggccattccagtagcttcctctcctgcttccacccttgctgcaccatcatttaatctccacatgggtagccagagccatgcttttaacacatgaggcagagtatgtccgtcctttacgcacaactcatccagtagctccccatcttactcaaaatacagaatagggcccgtaaaaccccacatcatcttgttcctggatacctctctgatcccatctgttattctcaccgctcactctgccacaatggcttccttttatccttctgctcctcagatgtgcgaagtacactgcaaactcaggatgtttgcattttttaatctctctgctggaatgttcttccctcagtggccacatggcttgtctctcacagttcaagtctttccttaaatgtcactttattagacacagacattaaatgtgaccttattacacttccctgaccaccatttctgaaataatagcattttctacccctggcgcctcctttccattctttacttttttcatagtgattaacacttgacatactgtgtgatagtctatttatttgtgatttttcttctccatctagaatatgagcatcataagagcaaggactttattttgtattacttctgtttctccatactctggaacagggaggcccttcatatacatctatcaaacaaatgagtacaaatactccctaagtcaacatcttggattcagattcaaatatgggtataggttttcgttgtattttagtagtttttgcaaactttgactttccaaatcatttgggaaagaaaacagttaccaccaactctttaaacactcacacttgctcatttggttcatgtgcaaaagcttattagtcatcataagccttgtgtattagcgtatatcacctggagacagtgaccactcactgtctctgtcacacaacacaagataccatgaggaacactgaaaaacaacccctgctgccaaataacgaagagtctagttggtgagggggcaggtcagagagaattaaaacatgaaacagtcagagaaccattaagtagaatgatgtaatagagttcagaggtagtgtaacatgattctttttcattatctctctggtggcaagagaaagaaatggttaaacaaacctgtgggtcctggaactgggtagtgcttctgtgtaaggctggttgatgggagaatcccattgcttattagcattttaaaggataagaagtcctgttgtttaaccttttgtttctcagacttatttgaccagggactcccctgcttgttaatacctgtaatatctgtggaacccactctgggccagagtattcatccttctctttttcccatcatttagtgactaccaaatacctagtgctaccctgagaaaactgtgatagctgctacaaagcaggcaggaaagcagagtgaggaagagggcctgtgaatgttggactttaggtgtcagtggacccagacgtctttctaggacctaggacagtgattgcagctgcagaagagcttggtctccttcccttaatgggagatgctaaaatggaactattggcaggagcagtttgaaagaacttaaactaatatacagtcccaaatattaatttgaaaggaaattaagctctaaatttttttcaataagtatgacatcattgcagtccttgaagtttccacatgcattaacttacatagccttgctcctccgcagtggtgacttatgtatcaattgacaaatgagtactgtcttaggcagaaatgttctcattagaaaataggcatagaggctgggtgcaatggctgatgcctgtaatcccagcactttgggaggccgaggcaggttgatcatctgaggtcaggaggttgagaccagcctgaccaacatggcaaaaccccatctctactaaaaaaaaaaaaaaaaaaaaaaagaatacaaaattagctgggcgtgatggcacacgcctgtaatcctagctactcgggaggctgaggcaggagaatcacttgaacccaggaggcagaggttacggtgagctgagtttgcgccattgcactccagcctgggcaacaagagtaaaactcccatctccaaaaacaaaagaaaatagacatagattagtaggcttttttctcacctttagttgtaggatcactgccccataagcatacacactgtgcagacattaatggtccacaggtgtattactgactatttcctaggcatataattttctgtgggcatttttgttttataattacttgggggaaaattctgtacttttcttcagacatgataaataggctgtttattggcctgtcaattcagtatgattaccttagtctactggaaactgtaaatgtcagtatatccttcttaacactaagagctagcgaggaatagataaactattgatggggaaaattatttctaaaatcaaattctatagaattaatattaaaataggtggaattttaccagcagtttattgttaacaattaatatatagtcataaaatatttgatgtttatagaacttaggaaagacagaattaatatcattatcctttagatgtgcatatctgtatcaatgaaaattttcagggttcaaatacaaagtgtcaagttgaattcccatggagtttattgcttactattctacttcctaatagagactgattttacatttgagatctttggtgtaacaacagtccagaacttggccatgaagaaggaagtcagtaaaacaggctctctgaaaaacataactgcttatgtattttgcttcctagaaaagacatgaagctatgttgaggcctgataagaccttggaagtctttaaaaggattaaatttgccacctaaaaacatttggttgtatacatctggcttcctcttaatttgtagcatattgaaagcgaccagaagataaaaccttgagaagtgacaacaagctataggatattgaataaagggtctcaaattttagtatgcatgaatagttaaagatggacctttctatacccacccctggaaaatgtgattcaccagggcttgagtaaaacctgggagtctcaattgccagtgagtcccagggtattctcttgtagatggtctctgcactacacttcaaaaaatgtatgccacttcactggcacagatacagtaaaccatttaatagaaaacaatctgaactgcaccatttgacagcaccgaataataatccatgccataattcatttattcatcaggtatttactgagtgcctgctatatgtcacatattaatagagatgagaaataagtggaacaagataccatcactcccctgaagtattaagtctaagaggctctacaagcaaacacaatataaggatgctgtctttgaatcattcattcgtgtgttaattcattcagtgaacatttattgaagatatatatatatatgtatatatatgccagacactttgctcaaataggacattctctgtttagataggtaaatgtcagttacctagaagatttacttacatggaaaacttcctttcttaattatttagatgattgtagcctagcatctctgatattgtgccagataattgttatttaaaatgagctcttttcagttatttaatcccttatgtagacttcagaatgtatctgaattatattaatttttatatattttaagaagttacagtcatacatgcaatttaaggatgtaacatattttatttggaaacagaatctagtcatatatccccttgttcatgatcagtggatgtaatctggattgtttttgagtttacagtgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcaggtaagtggcacactcgccacacacatgccacaccacatcacagttaattctgaggaaaatcaggtatgttgacagttactcatcagaaatagccacacttctttattctttcccactaacttttaataattactggctcttaagatatacaatgaaaaattttgacagacttttttttttttttttttttttgagatggagtctcactttgtcacccaagctggagtacagtggtgcaattacagctcactgcagccttgactgcccaggctcaagggatcctcccacctcagactcctaagtagctgggactgcaagcacatgtcaccctgcccagctaatttttttactatttgcagaaacaaggtctcactatgttgcccaggctgggcttgaactcctgggctcaagcaatcctcctatcccagcctcccaaagtgctgggattacaggtgtgagccactactcctggccttgacagactttataaataagatttcagtttcatgagattttagtgttttagatttataaaacagtacatggctgggtgtggtggcttatgcctataatccgagcactttgggaggccaaggcagatggatcacaaggtcaggagttcgagaccagcctggccaacatggtgaaaccctgtctctactaaaaaaaaaacaaacaaaaattagctgtgcgtggtggcatgcacctgtaatcccagctccttgggaggctgaggcatgagaattgcttgaacccaggagttggaggttgcagtgagctggtaattgcgccactgcactccagcctgggcaacagagcaagactccatctcaaaaaaacaaacaaacaaaaaaacagtacatgtaatatattgtcttggaatattccattatattttgaaacattttcttcatctctaccttttaattcaataagcatttattcagtacttactgtgtacaaagatagccttgtgggacatgcatatgtacaagttgggaaagacacaacatgaacaaaggatcattttaatcataggacaaaactggtatgtaagagataggccatatgtgtttctgtcagatgaggagtgtatgcacagttgactactgagggcttaaaagaaaaaaggcctggtcaaaaaaaggcattatgaaaaagttgcctaaacagaatagaaaaagaacattcaagattggttatcacagcatgacctaggcaggataggagttgaaagcctaattaatgttaaggggatatttatattttatttagagaagaagtaatgtggtaagcttttttgatatgttgcatgccatctaagtgtgtggaatttatcctggagcctcttacatatttttagaagagaatgaataaattcaaaacaatatttaagattattgcaataactctctatagttgctattctcattattcgtatcagcaaccacaaagtatgctatagtaactaggctattaccatgcagccatcatttataggcaatcataaaaatatataaacaccaattaccttttttatcttcaaatgatactatatcacctcatgtatagaggtgtatattatatcacctctatatcacatgaggtgatatatgtatgtatagaggtataatataatgtatagaggtatatataatgtatagaacctcattacaatttatttctattttgtccctcctgtgctactgttgtcatacatgttatatttatatatgttctgttccctgcaatttattattttttctttagtcaattataaattataaatttataaattctacttacaaatttataaattaattataaactataattgactatttaaagaaaatttaaataaaagcttttttatatttacccacatagtcaccactttaaattttctgcattctttttgtagttctaaatttccatttggtattattttccttctgcctgagggtcttgctttaactttttttttttcttttttttttttttgagatggagtctcgccctttagcccaggctggagtgtggtggcacaacctcagctcactgcaacctccacctcccaggttcaaccgattctcctgcttcagactcccaagtagctgggactacaggcacccgccaccatgcccggctaattttttttttttttttttttttttgtatttttggtagagatggggtttcactgtgttagccaggatggtctcaatctcctgacatcatgttctgcccgcctcggcctcccaaagtgctgggattacaggcgtgagccaccgcgcccggccttggctttaacatttttatagtgcaggcctgcggctaatgagcttttctatgtctgaaaaagtctttcaccttcatctttgaatgttctttcccctaaactctagcttggcagttttagctttcagtactttaaagatgttgctccactacagtgttgctgatgagacatctgctgtcattttatctttgttcttccatgtatgattgatgtttttcccctctggctgattttgatttttctctccaccactggttctaagtaatttgattatgatatgcttcagtgtattttcttcatatttcttattcttggggttcattgagcttcttgattcattaccatataattttcattaaattttggaaaaaattttttgttgtcgttttttgtttttttgtggtttttttgagacagagtctcactctgtcacccaggctggagtgtaatggcgcagtctccactcactgtaacctccacctcctgggttcaagcaattctcctgcctcagccttctgagtagctgggagtacaggggtgcgccaccacacccagctaatttttatgtttttagtagagacgggattttgccatgttggccagactggtctcaaacccctgacctcaggtgatctgcccacctcggcctcccaaagtgctgggattataggcgtgagccaccacacccggccaaattttggaaaatattgatcattatttcttcaaataatttttgtcaccatccttattcctctccttcagagacttcagttgcatgtatagtgcacttgaaattgtctcacattcaccgattctctaggtttgggggctttcgagcactgggatgaggttcagttatttttttctttgattttagaacatttatattactgtagcctcaggttcactaattctttattttgcaatatctaatctgtttatacagtgtatttttcatctcagacatagcagttttcatatctagcagtcatatttggatcctttttatatcttccatatctccaacatttttttcatatctgttcagcctttcctcttatttcttaaacaaatggaatatggttattataattgtcctgatatttctcacctatcagttctattatcagcatcatttttgaattgatttcagttgacttcccttttcattatgcatcatatttttctgcctctttgcatgcctggtaattttttattggatgccagacatgaattttaccttgtttatattcctacaaatattcttgagctttgttctaggaaatggttacttggaagtttgatccttgcttttttgtttactgcgaccaaagcagtattttttctagggctaattctaaccttaccaccaaggtaaaacctttaatatgctacatgatactacatgaattacgatgttttccactctggggggtgaaatcagggcttattcccagccctgtggggactttgggaattgttccatgtcatctattcaggtgattgtttcccctgcatctataagctgattagtactgagcttcagacttgagggccactgcagatctattccagagctctctctgatattctgctctgaggattctagctgcatccccttaactcagggagcctgccaggcgctgcctggattccctttgtccatgatacagccggaaatacactccaggcagtaggctgggcggttgccacagtagggactgctgaactgttagggatcactgtccttcgttgcctttgtctaatgtcttcagtgcctttttttcacatattttgtcaatttttttagctgattgaggcaggaggataagtctgatccctgttactaaatcttgaccaaagtgtgagtctaccactaattaacatatgtatgtgtgaattaactttttattaaagtatcatatataagaatatagagaaaagtgtacaactcaatagattttcacaaagtgaacacacctgagtaccactcagatcaagaaacagaatgtcatcagtaccccagaggttctccttgtgtcccttacacactcactaccccacaaggggaatgactatcctgacttgtaacaacacagttaattgctaagcttttcatttttgctgtgctcctattacttttctgtcagtgagattgtttttcattggagaatttggttttcagtttaaacaactagcttgtaatttgatcttgtatttatctttaatagataaatgatcccgcactgagacacacaggcctctactgcaaccagctctcatccactgaccttctcaaaacagaagcagatggaacccaggtcagtaaggaaattctaagcccagagctgtcaaatgtactctagatgcacagaggtcattgtgtagcatcattaagagcctgaccttgggagtcagacctgggtgtgagtcctggctctgctcttcttagctgtgtcgtcctgggcatgttatggagctttcctgagctgctgtataaccacagaactaacatgacacctgcttataggattgttgagaggattcaatgagatcagttcagatggcttaactcagtgcttagataggataaagtgatcacaaatggtggccactaattgttattttgtaaataagcacagtgctaaaaactcatctgtaatcaaaatacctcagaagatctcagtaattcagacaaaacagagtacctgctgtatacttcacctcctaagaagtatgtttcaaaacagcacaaacagcaaggtggccactttcctatattaacctaatttagaaattgtgggccgggcgcggtggctcatgcctgtaatcccagcactttgggaggccgaggcgggcggatcacaaggtcaggagattaagaccatcctggctaacatggtgaaaccctgtctctactaaaaatccaaaaaattagccgggtgaggtggcgggtgcctgtagtcccagctacttgggaggctgaggcaggagaatggcatgaaccccggggggcggagcctgcagtgagccgagatcacgccactgcattccagcctgggcgacagcgagactccatctcaaaaaaaaaaaaaaaaaaaattttggaggaagggcttaattcactttcgtaactttggttgaactttggtctctctctcttttttttttttttttttttttgagttggaatttcgctcttttgcccaggctggagtgaagtggcgtgatcttggctcactgcaacctgcgccccctgggttcaagcgattctcctgcctcagcctcccaagtagctgggattataggcgcccgccaccatgcccggctaatttttcgtcttttcagtagagacaggttttcgccattttgaccaggccggtctcgaactcctgacctaaggtgatccacccgcctcggcctcccaaagtgctaggattacaagcatgagccaccacgccaggccagactttagtctcttaatgaacatttttaacccagggattatgccacagatggcagtaggaagacacataagatatgttccatcagcatctggtgaactgtggggagaagtgaggaaaggaaacttcatttgtgaaatgcttgtggtttgccaggcactgtgctatgcactgtatgcattatctcatttaagcctcactataaccctatgaacgaggtagtattccttttcttcacagatgaagaaactgaacatgaggaggtttaactacatgtaccattcacagtgctagaaagaggaagagctgaggttcaaacccaggtctttctaccgccagagtccacactgttcctgccataccagttagggactgctgaaagataaaacacatcaatatatgcacctaaactgtcataaaaccaaagaaggcaaattattaaatttatgttacaattaatgaaccataagcattcaaagaaaggagaatttgctgagatggtcacaagagcatttttgcaagagatagagctgagctgagccttgaaggacagttaccaaggcaaagggaaggaaaagggtatggtagttgttggaggctggtgcagaggtagatttagaagtagaaggaactggaaggccacagaaacagggaaatagtaatatctcaacatagtcctgggaaaccaaatcaactgaaggtaaagggtttataataagtattcataggaattaaaattggtaaagtggcttggggcaaatttccagaggccttgaatgctaaactgagggatttggattcaaccctatggacagaagagtcatccctgaaagggaacatcgatagaagtgctagtttagacttcatcttgggaagaaggtgaaggaagatatattggccagttgagaaggacaaagattagaagactgggttcacagtctaagcattaggaaataggacctgagtcctctcaaggtaaagagaaggcattttggcttacacctgtaatcccagcactttggaagcctgaggcaggcaaatcatttgaggtcaggagtttgagaccagcctggccaacatggagaaaccctgcctaaaaatacaaaaattagccaggcatggtggcgggcacctgcagtcccagctattcaggaagttgagacaggagaatcgcttgaacccaggaggtggaggttgcagcgagccgagatcacaccactgcactctatcttgggcgacagagggatacttcgactcaaaaaaaaaaaagagagagagagagaaggcattttaagactggggagccgggtgcggtggctcacgcctgtaatcccaatacttcaggaggctgaggcgggcagatcactaggtcaggagatcaagaccatcctggctaacacggtgaaaccgtgttaaaatacaaaaaaaaattagccaggcatggtggcgggcgcctgtagtctcagctactcgggaggctgaggcaggagaatggcgtgaacctgggaggcggagctggcagtgagccgagatcgtgccactgcactccagcctgggcgacagagcaagactctgtctcaaaaaaaaaaaaaagatcgaggaaatgaagagtcttcattcaccagatgtttttgaaagtctcaaacccacagagacattactgggcagcttgacaaattagttacacccaaacaaccatgttttaaagttccagagccctgccctgaaacagtatttgaactgaagcaaaaattatgccagaaaatcttcagaggttgggactcagctctcacaccagtcttctcacctggaagatctgaagcttcttttgtgtcacactttgcctatctgagaagttgtgacaatataagaagtcctttgtggactggtctgagacacccccttttaagtaatagtttgaaatgggttttagagtttgttcagtcttttcagttttctgtaatttcaataatacactttttttttttttttttttgagacggagtcttgctttgtcgttgcccacgctggaatgcagtggtgcaatctcagctcactgcaacctcctcctcctgggttcaagtgattctccagcctcagcctcccaaatagctagaatgacaggcgtgtgccaccacacccagctaatttttttattttttgtagagatgggtctcactatgttgcccaggctggtctcaaacttctagcatcaagtgatcctcctgcctcagcctcccaaagtgctagaattagaggcatgagcctccatgcctatcctagactatcttttaaaaagttttatttttaaagaagcagaactttctagtttgttttatcatgcctttatcaagaactttttaagaatttagggacaaaaacatcttatgctctgccccaatatttcatatgtagaaacataaacatcaaattttatatgttgacctttttttaaatcactgcctaaaaaagaactatattttgtggtcatgtgaagtttcagtggtagaattttctttctgttgtggccaatcatgaatcttgctccagtgtttttgtatttaccagacggcagctggggagtgagttagacagaaatataaagacagatatacagaaagggagaagaaaaagatgaggagaagaggactaggggagtagtagggaactgggatgggatggggaggaggtaagacaggagagaacaggaagagaacagaggagtgggaagagggatggcaggaggaggtaagacaggagagaacaagaagagaagagaggagcgggaagagggctggcaggaggatcgttgacctaggaagagaggaaggcctggtgaagctctagaaggaaagagtcagaatgagacgttacagaccacaaaggcggggcaagggcacagaggcagctggagagcagactgggcgcgttggtgtgttatagacacaagagaaagagcccagaggaggcagtaacaaatgggagcatataggagctagaagccacatttgggaaactagggaaaggggaagagaaggagagaaaagcagtgcaaatctaactagagatttgattccttaggcactaggaaagctcagcttgggggctgtctgcctcatctgagaggaaggaaagtggagatataaacggattaagaggataggagaccaggggacagactggtgtccaaatttgatgcataccacatttgacatttggctaatgaaggttgatggaaaacaacttttactcgattaggatagaaaagttttttaaaaagctgagtgtaattgacatgaattagtgataaatgaccaaaaaaaatacaccactaatctaaaatactttatgacctatcaaacaggagacacaagtttgtcaaaaagtttgagacacttagatgcacttagatgccttagaaggcatctccattcctggtctggaacattcacaagtgtggtattggccctaatcagttctacgaacaactttttaataaggctggttggtaaagactaacttctggctttgttttcccaatagaatatgctagaactgtgcaactttagacatttttaaggaataagtgtattattactcatagtagtgaagggaaaattcacactgttctcaaggctaatagacgtactgttaattttagctcatgtgtttaaatggattgtctatcaggggaaaaaagtcaaatatgaaattgttctaatgataatttgctgtaattctaaagccaatatgtgaaagagctgtgtaataatatatttaaatactaaaaaatcttttggacattaaccttagatgctgatgtcctcttattgagttgtggttttgttttgctaatactggttgaaagccctttaatttttcagtgacatcataaagattttttatcctactgaaatcatccatagaatggttttaaaccagttttctaaatatcatgtattttttaaaacctaccactggatacccagactctgaaactgggcttctcccaatcttggcaacattagcaatgatactcactttcagtattgatggcaaccctataggaggcgtgaccattccaattttgattttatttttaaagtgtgaactttccagaaccctgagcaaaatgagtgcagcgattttctttttgtaggacaagaagacagaagagttcttctctgtggtgactacagactagaggaatgctctagtgagtttccacttcaagtagtacccactcataagccgggggggcagacccttctgtctaaacacatcttttatttgtgttccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagc

SEQ ID NO: 37396 - DNA, 20245 bp, Homo sapiens; identical to SEQ ID NO: 36094

SEQ ID NO: 37397 - DNA, 21122 bp, Homo sapiens
agatcttagctgaagatgactgacagtgttatttattccatgttagagttgcctacggcaacccaagcccagaatgactatggaccacagcaaaaatgtgagttaaccaaggtagcatggaagacgatgcatagcaacagtaggctatggatgaatggggagtagaataagtttaaagcagagggtgcagaagaattgaggataatttgaggaaatacttttggttcagtttaaagtccagagttggaatatgaaaagttggtgtatggtacaggatctgatcttaggtctcaggtaaactcttttctaactgttcacttctttgatcgcatcttagaaacccaacttagggcattgccgttattccttcttgctcttagctaaagcgggaactttgttgggagaattttatctctttagttatattcggagtaaccttggaccagctgtttaaattctaggtatggctgtttttctgactatggaatgaggaggacaccaatagttttgctggtggatacgagtaagatttttgtcaggaaagaaactgatttacatatctagttttgttttttttttttaacttcacagtgttgcactagaatggtgacagggaagaaaaagtatcaagaaactacagataatagtctctgtgactgaggatttgaaggcaaaagagccatttttacatagagccctgagagaatattatctgagacagacaggtaatagtgtaaatgccaaaattaatccttgattttgtatcgtaggcagtgaactcccacaaggtgtattctttagggtagttccctaagctttctctctttttactacatagttttactattataatttttaatgtcttttgagagtgttgccttaatttgctaaatcattctagtatacttgggatatttagacctatttctattaccataaattatatagcattggatatctttatttgtgtaaccttttcctatttttgaattgtatctatgttaatttctaaggaatagaaatattacgttagaagtaatgcatatctcaaagtatatgttcaaggtcacacacacaactggtgataaattggaacctagttggaactatttagaggctttcaatatatacttaaagtaaattttaaaaatttactttacttcttgaattggcttgtggttacacaaattcaattatggtttgatacctttttaaaatttagcataacataaaaatgaacatttgtgtatttcattaaatgttctcctgtgatgcaaatgtatttttaaaagtttttctagaaatcttaatgcttttggattcatcagtccaaatatttattatgcagaattctctatttatgaaggcatctctcattatgaatttttttctttaagaagttcagaatactccatagatacacacatatatagaataatttatctaaaatttaatcagaaaattgaagcccaaataggcaagtttaatttcctaattaaatgttattaagcaaaggaatcaaaattagaagttaaatatcatcttacttcacagagttttgctcgttacacgtaatttctacactattgcactatgagatacctttgattttaaaataaagatttgctgaaaatacttccatttttcaaatttaaaatttagatttcggttgtatgcaacacagctaacatgaagtagtgtcctattcttaaacttggcatcaacttaaacttactgctcttttaataacgacagtttacaaagcacttctgaaatgtagattatttttatttaaattttatgtatttcaatttcgagtagataatatgtttacatggttcaaaattcaaaaggtacaaaagaaaatagggtaaaaagtctttttcctattttgtctccagtgactgttttttccattccagaggcaaacaatgttatcagattcttgagtgtgcttgcagagatatttgtatatcctgttctgcagaatgtttctttgtcttgactatatatcttacaaaatattccatatcagttaaaaaaaaagccagtttttattagaagctatatattcactttatggatatatcaaaaatgtatttgactggccttttactgatagaatgtagattgtattcagtcttctcctcctacaaatattgctgccacgaataaatatgacattttgcacccgcgagtatctgtaggaaaaatttcttaaggagaaatttctaggtcaaagggtacatgcctttgccgttttggtagatattgcccaattgtcctccaaagaggtaccaatttgtattctcaccacctaagtatgagacagtgtaagtcacagtttcaaaggaaaaaagcattctttatcttgataaatatagtaagttctttgatacaggtgttggtggttaccttagactttagagcaagttcctgacacatctagaaaaggaatctttatggcctggatctcagttcccactaggccaaattgctttaagatgcgatatccttccctgactttctcttttctttcaacctgtcatctgactcaggattgtgctttgactctgttgttgcagcttcctcttccaggccttcttgttcttgccttgtggcaatagctttggggcttctgactgcagttcttctgagtgtgctgctataccagtggatcctgtgccagggtaagtgcaaacttaaaccaaaattaatctttcattttatattataaaagcaatataacatagcagaagctttgaaaaatcaaaaaataattcaaacaaaataactctccatctgtatacagctatttcctgggtatagcctttgaccatgtgcacttgtgtaagcttgtattttcttttttctttttgttttttgagacagggtctccctcaatcagccaggctgtaggtgatagatttgtgtgctgctataccagcggatcctgtgccactgtacagtcacagctcactgcagccttgacctccttaggctcaagtgatccacctcagcctctcgagtagctgggaccacaggcacataccaccatgcctggctaatttttgtattattattattatttttttttttttgtaaagacatttcaccatgttgcccaggctgatctcaaactcctgggctcaagccatttgcccttcttggcctcccaaagtgctgggattataggtgtgagccactgcacctgaccatattttcttaatagaactgcagtcaagtcctcttaaaatttctcccacctttctttcttttaatgcaaggctgagaatagttcttatcgtagtatgctcataattttgtatattgctttttaattttatgttgccagaaacatttccttactgccatatttattgggatgattgaattataatattaatgatgtttaacttttcacataatagatatatcataatgtaatgaaacattctgaattttttttttttttttttttgccattcaggtgctttcacattttctaaaactaatttttaagtttagttcttctaggaccttaaatctggtgatctagaggactctcagtttgttgttttacagtctagagtcctagcttaggtttatatttttaggggatgatagtgaccgattacacagaagtgatttattagggttcttttttaaatttttttaaaaattttgagacagaatctcgcaatgttgtttgggctggagtgcaatggcgtgatctcggctcactgcaacctctgcctcccaggttcaagcgattctcatgcctcagcctcccgagtagctgggattacaggcacctgccaccacgcccagctaattttttgtatttttattagagacggggtttcactatgttggccaggctggtctcgaactcctgaccttgtgatctgcccgccttggcctccccaagtgctgggattacaggtgtgagccattgcgctctgccgatttattaggattctaagagttcagctccagggcttctacctcagagccaagtccgacctttgacaaaaaggaactcctagggaagttgggaatttctaatccaggctgagtaatgtcacagttgtatggaaaaagcaaaatctataaggtgccaatttaacagcttgatctccagaacttatattggttgtatgccagtacttcctagagaacaattatctaatatttatatgaaaaatactactttccccactttgtaactcccaaatctagagtagatatatactctattctgcaattatatatctacacatgtgctcatggagtataatggctcatacttgctcactgtagaattgtgcttatggcgagtttatgcacatatgtttaagtattgaaactgaagtagaaaaatcaatagaattttggaatcttggttggaattaccttgaaagcatattcagttccctttcatctttgattgtttgtttttgagacagtgtcttgctctgtcgcccaggcaggagtgcagtggtgtgatcttggctcactgcaacctctgcctcctgggttcaagtgattctcatgcctcagctcctaagtagctgggattacaggcgggtgccaccatgcccagctgatttttttgtatttttagtagagatgaggtttcaccatgttggctagactgatcttgaactcctggcctcatgtgagccacctgcctcggcctcccaaagtgctgggattacaagagtgagccaccatgcctggtcagttccctttcatcttgacagaactatgaaccaaccattttaaaggaatgtggatcttccgtatttaaaagagctcggttagggcattctatcacttttcactttagcacctgttatgcttctctgccagaaaacccttttgaaaaatatcaaagtaagttctttttgctgaggtataagggtttttttccagttttcaatggtgagggacagttacatctgtgataataaaaaagcaaaacctttcattctagttaagtttgcttttcctaatttctttttggcattttcagttgggcattctgaatgattctgcctgatttaagcaatatacattatgcaattatgcaatatatacacagagcaaagacagtacacagatgcatatcatatgaattcacagttatctggtgtgtgtatattacatgtgcacagagatctctagcacaagtcaagtacttgctccagagttttcaggcagattgttgtatgctttcttctttgttccttcagttatagtcatattcttgtgtagtggaatatatacttagtagatgatggagttggacattatgaggacattatgaggtattcaaattgacaccacgcattgttacacatttctctaacccttaatctgaaaagtggtggagcagggaagacccagggctgccatattccattttatctcccatttcatttccaagactgagtggtccataaagatgtgaaccaggtcctcttctctcctaggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatggtaaatgcaaacatttagaaaatgtagggtttttgttttgtttttgtttttgtttttaaactgctatttaaatgtatcatgtatcctcttttaaggaacagaaggaatctgtgatttgggggggatactatattcttccccttccctcttcttctctttcctcttctacttctgccttcttccctctccctccccactctttacccttatgctgtctgacccaacaaacctcagttacagcaacccagatgcttgtatagcatgtaagtgtgtatgtggggcaaggaggcagaaggatggtgagtgttttggagaggaatgagacctgaaatacaggtctagttaaaagaagtcttaggtccggaaacctacaggtccaacaacaaggcagcagattcttttttttttttttttgacagagtctccctctgtcatccaggctggagcacagtggtgtgatcttggctcactccaacctccgcctcccaggttcaagcgcttctcctgcctcagcctcccaagtagctggaactacaggcgtgtgccaccatgcctggctaattttttgtatttttagtagagatgggatttcaccatgttagccaggatggccttgatctcctgaccttgtgatctgcccgcctcggcctcccaaagtgctgggattacaggcatgagccaccgtgccagtccttatatagtggaacttgggagggagggaaagatagagatcacggggacagagtgattgtggcaagggcttaaatgccttcttttaaaaagttttcccttaattcactggaatccaataagttccagactgcaatgttgagaaagttgggatataaggaagaaaacacgcgtgcacgtgcatgtgtgtgtgtgtgtggtggcctccacttccttcaggcccctcagatccttcctatccacccagcaatctcttggaaaagagcttgctattggtcctagaccatctcaaggcaatacaaggaactgacatcctgaggttgcctagtataaaaatcaatcaaattctaatttgtcaacataaataacatctataaggaaaacaagaaatcttagttttgtgttagtgctaatttgatactgatttttgtgttttgctattgttttctgttttcttttattgggtaggatctagtcacagagaacaatttattgagaattaaactatattaacttaccttgggaaaaatccagaggttactctaaagcagtgggggagaacatatagttcctaaattttatagctacctatataactacctatataaagcatacagattcttgttttctgccaaaggaacacttactcctttggaattccacatagaatctaaactctaaatcattccacatttgtgactaacttttttttttaaagccttctctaagtgaggtggcagaatgcattgagttgtattaattaaacatgagttcttagttttatggcctccagcaatatagccttgctttctggaccttgttgtagcaactcctattctcattctgatatagtgactctcaggatttgagctgactaaagtcagtagcagaagtgagccatgaacttgaaacattgagggcaaaactgataaacaggagtcgtgagtcatagcacaagacactgccacagaaaattgtggtgtagcagctgctataaatttcacagtgtgatcatgagaggtgaggagggaaaggatgaagggcacagaatatctgggaaaatggcaatatttctgtttctctgaggaacccagaggaagggcaggatcattagagggattttgtccttcctctgcttcctgacatgcccccattccttagactattgttgagtaaaaccagcagagttacattcactgcatttccaaattgagtttattttctcctaaggctccttggggccaagtcagtgctggagagggcggaatgtccctgctagatgtcataagttttacttttaacattcctgtggaatcttacttgattctctggtttaattctttttcttgctccggcttttgtcagattctgtagaaccaaattgattttacgtgccctgctgcgtctgttgttctagtgttattattcttttgttctcagggcaagatttacatactattttgaggtatgtacaatgtttctagtatcatactggggtctgagccactaccaaaaaagcaagaagtaaaaataaaaaagagagctctatggatctattaaaactgaagtttttcaaactgacattccattggtggagagtgctgctagagaattttgttgctatatgtagaatctacaggcctatggaaaatatccctcttatgctgttaaacggtcatctttcagtgagatgcttacgtagagttcacctcctatcttagatcacttacggcaaagtgtacaataataacagaggctaccatggattgagcacttgctttttgccagatgttttatgtatagtattctttttttttttctttttgagatggagttttgctcttgttgcccaggctgaagtgcagtggcacaatctcggctcactgcaacctctgcctccagggttccagcaattctcctgccttagcctcccaagtaactggggttacaggcgcctgcctccacgcccgacctttatgtatagtattcttaatcgtcacagcaattctaaaaagtagagttcaacatccccattttgttggtgaatgaataaaattcagaggaattggctgggcatagtggctcctgcctgtaatcccagcacttttgagaggctgaggtgggtggatcacttgaggtcaggcgttcgagaccagcctggctaacatggtgaaaccccatctctgctaaaaatacaaaaattagctaggcgtgctgttatgcacctgtaatcccagcttcttgggaggctaaggcacctgaatcgtttgaacccaggaggtggaggctgcagtgagctgagactgcaccactgcactctagcttaggcagcagagtgagacactgtctcaaaaaaaaaaattcggagaattaatgagtgtaagtctaaggctacaaatctggcagagccaaattttaaattctactccagtgggcatggtggctcacacctgtaatcctagcactttgcgaggccatggcaggtggattgcttgaacccagaattcaagaccagcctgggcaacatggcaagaccctgcctctacaaaaaaatacagaaattagctgggtgtggtggcgcacacctgtggtcccagctactcgggaggctgaggtgagagaatcccctgaacccaggaagtagaggctgcagttagccgtgatcacaccactgcactccagcctgggcaacagagcgagactctgtctcaaaaaaaaaaaaaaaaatccacatcaactcaccttcaaagtcacttatagaaatatcgtatttgacagcttccagaatccattttgcatatgttcaacaagacaactttttctactaattgtcttctggtttcttttctatacatatttaaaaatttttttgaattgacatacagaatgtacattgtatgaccgtggatatttaaatttatttattgtgatgaggtctcactatgttgcccaggctggtcttgaactcctgggctcaagtgatcctctcgccttggtctcccaaagtgctgggattataggcttaaatatatttaaaatagtgagatgctttcttattatctcttttttttttctatctgggacttcaagattattcttgatagagaaaataaaatggaaattaaatttctctgttattttctcatttttgtgttaacattatggcatcagcccttgcttcttcttgccctatgagtatatctttagatgtttggatatattcaaattcttgatttttcttgccatttttcccccaccaagctcagttcatcctggatgttgttagcctggttccttatagttattggtatgttattttaaagtatgcattcgttagtgagttcccagtgaaactgctttgatttctttaaatctattctgatgctccttgccctataatatctctcttcctcattatcataatttggaattatatgatccaactttactcttgcaacaacctctcattcaactttacctatcttcctgaccttgggattccccgagcttttgatgtcggcttctcacatatttaggatttacatctaataatatccaaagtttccttctttgggtgcagcaatgcaaacactatggtaacatggtcacttttctgtatatttttaatcaggtaatgaaaacagcttggtttctttcagacagtcatgagtgtgcttttactatatttcttactagctatgcgaacttcaacaactttcttaacctttttgactctcagtttcctcatgtacaaagtgaagataaaactttctagactgtccgggcgtggtggctcacgcctgtaatcccagcactttgggaggccgagatgggtgaatgatttgaggtcagaagttcaagacctggccaacatagtgaaaccccatctatactaaaaatacaaaaattagctgggtgtggtggcacgtttctgtaatcccagctactcaggaggctgaggcaggagaatcacttgagccccggaggcagaggtctcagtgagccgagatcaggccactgcactccagcctgagagacagagtgatactctgtctcaaaaacacaaaaaactcaaaaaacaatataaagcccagagccaaaaataacttttactttgctcttctgtgtcccaagacatacaatttcagtaaaatatgcatcacagagtaaattatgacttgttgaattgagtatattgtttatgaggaaatctgagatgacatgtcagaagattcaaagaaatggctggaaacacagcatagatggtaggggaattgctttactctggaggtcttcacagtctggtaatgtgcatcttttgtcacgcttctttataatcagattaagcagctagtgtcaactgcataacaagggatgggcatgataagctaggatatttccactattttttaacttaaaaaattgtgggaaaatatgcatagcataaaatgtactattttaaccattttcaagtgtacaattgagtggcattaagtacattcacattgttgtacaaccatcactaccatcatctccagaactttttcatcatccccagttgaagctctgtacctcttaaacaataactcccctccctctagcccctggtaatcactattctacttaccatatctatgtatttgcctattctgtcctttagtgtctcacttattcacttagaacactgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaatttggatatccatctattgacagacactgtttccacaagcttttaaaaagtggagcaaatgatggtttacggagcagggcttactgacttttagcattgtgtacttacacaaaattatagggaaaattcttattgatattaagctctagtaatttgtaacctgtcagattttcctttgaaatttcttaacgttatttgcatgtttttagatgatggtaattaatgtgttcatattataggatatctgaaaagtctggaaacaggctaaacttatttttaaacagtatgttggttacattttcaagtaatatgctctatatttttactcaatcttgagacatgttttcaagtgaaacatctctaaatttaaagcaatagatataattatttttagaccttatgagtactctgtattgtaaatttttttcaaattagtaattacatcctttgctttaaatacttcacctgaaaaagtgtctgaagaaaaacatattaatgatattattttaaaatatgagactgtagggttccccagtgcctggctttctttctgtgtattggctgaaaatcgcagagggccttgaccgctctgtgacccgcccagctacaggtttttcccctgcaggctctacccaaaccccagccttgaacatttccagtcactgataaaggtatctaggttgctgctcaaaacactgaaataaactagccccagccctaagtcagattccttaaaccctcataaaatctccatctctgaccccctggccgtggacatatgtaggtcaaatgctccttttctctggctgtccatcgtgagtgttgctgcagccctctgtaacttcccctaatagatgctttgcacagatcaccttgacatttagtgctttattctatggtatcccaaccaaccccatctcatgatgatttggggtcctcccttgtgggaattcccctgtcgctgcttttgggatgatttcagccatgggtttggtgggacaaaacagagatatactgcctaaaaatacatttatcctatgtttttaggtgttttggaacccattattttgtattctgcttttatcaaatagcattatttcattcttggtttttgctaagcattaaattattccaggtaataaaaagttgcaaccagattttattttattttttatttagttttaaatattatttttatacgtcttgcatcattccactattgcttaaatcttttcatattcttagataaaattctccttgttttcaattgtcatgagctgtgagcatatttatagaaatcattttgcttgcagttatttatttacattatattccctaaaattaagttggctaatcaaaagataagattttatagttttgatgtattattagtttttcttaatatgggttgaaataacttacatacattctgtaaaccattttaatttggaagtttaaggggtatgctttgtgccttaatgatattttaatttcaattaaaaatactacatacagaagtgtatgtggaaggtataaatgttgaactaaaaaagcaaaaaaggaaaagaaaagaaaaagtgcccttgattttatttgtttgggttttatcttcactttgcttttagggtttgcattttttctaaaatataagcaaacattacaaactctaagtgacataacacctaagtgttctagctcacaccctctctgggtgacaagagttctcagttaccacctttacctatacttttgttgttgttgttgttgttgttgtttgagactctcacccaggctggagtgcaatggcacaatctcatctcactgcaacctccacctcctaggctcaaatgaccctcctgtctcagcctcctaagtagctgggactacaggcatgtgccaccatgcccagctaattttcatattttttgtattaatggagttttgccatgttgcccaggctggtctcgaactcctgggctcaagagattttcctgccttggcctctcaaagtgctggaagtacagatgtgagccactgcaccagaccgatttgtactttcatgctgcttctatattctctctctttctaatacacacacacacacacacacacacacacacacacattatccatgagtacatagaatataaggttattgtactatggttttgaaggcctcttccaagtgggaagattttcgagtgaaagtgccataataaacattttcaatatccagcctcaccaatgagaagttgtaagaggactgactgatcaagtgatttagaattatatgggtcttgagggtagtaaatgagcacaggattggggtttgtacgtgggcattacctaatcctagctctgcagattctaactgaaatttctgagcaaatctttatcaatttctgtgcttcattagctgccgttcctcctcttgaaatgaaagaaaaagaaatggactgtttttctcattatcagtggagaaatggggaatcactctttttttccttttgttaattttatttattttttcaaatatttagcttacaatttttgatttgaatatactcaaattttatatactttgaatgcagtaacatttatttttgaatcttttagatcatggctatcattcacaccaattttgtgaaaatattaaaaaaaatccattctttttttcctaatttaaataattctttaaacaagttggttaagaaatgcaaaaattttaagctatcttgaaaattacagtgtcatttcatctgtcgtatacttcattcactctccggtctaccttcttacccccagcatgcacagttaagtgctccacagagagaaagtaaaaaatacagagtttgtgttcagagggttttttttttctttttcttttttattattattatactttaagttttagggtacatgttcacaatgtgcaggttagttacatatgtatacatgtgccatgctggcgtgctgcacccattaactcgttatttagcattaggtatatctcctaatgctatccctccccccttcccccaccccacaactgtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttatagtcctttgggaatatacccagtaatgggatggcagggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccatgtgttcagagagttttaacttcttgcagcataatacctaattgtgtgttctttatttctatagatacttattaaacataattttttaaaaaagagatgggatcttgctctgttacccaggctggagagcaatggcatgatcacagctcactttagcctcaaactcctgggctcaagtgatcctcctccctgcctctgcctcccaagtacatgtcaccaagtacaagcacatgccaccatgcctggttggctacattttttacttttcgtaaagatagagtgttactatgttgtccaggctggtcctgaactcctggcctcaagtaatcctctcaccttggcctcccaaattgctggtattacaggcaggagccactgtgcctggtctgcatttattgagtataattttatatatttttctaggtgctagggatatggtagtcaagagttgttgctattataatgtttacattttatttattatttttaaggaaaatgatattttaaatttagttttgttattaacatttttttaaattggcacataataattatatatatagggtatttatccgaaggaaataaaatcagtatgttgaagagatatgttcactctcatatgtattgtagcaatattgacaatagccaagatatgaaatcaaccaaaatgttcaacaacaaataaatggataaatgaaactaacacaagaacagaaaaccaaacaccgcatgttctcacttataagtaggagttgaacaatgagaacacatggacacagggaggggaacatcacacaccgggcctgtcggggggtggggggcaaggggagggatagcactaagagaaatacctaatgtaggtgactagttgatgggtgcagtaatccaccatggcacgtgtatacctatgtaacaaaactgcacattctgcacatgtgccccagaacttaaagtataataataaaaaatgaaataaagaaaatgtgtatgtatacaccatagaatactaatcagccatggaaaataaagaaatcctgtcattcatagcagaatggatggaactagaggacactgtgttaagtgaaataaaccaggaacagaaagttaaacactgcatgttctcgcttatgtgaaaactaaaaaaaatgttgacctcagaacagacgatacaagaagctgagaatggctggggatggggaggttagggagagttatgttaaaggatacaaaattacagctagataggcagaataagttctaatgttctatagcaatggtctccaagatgtttagcaccaggcaccagtttcgtggaagacaatttttccatggaccgttgctgggggctggtttcaggatgaaactgttccacctcagatcatcaggcattagttagattttcttaaggagcaggcaacctagatccctcacatgtgcagttcacgatagtgtttgtactcctatgagaatccaatgccaccgctgatctgctgatctgacagggggcagaactcaggcggtaatgctggcccgcctagccgctcacctcctgctgtgcagcccagttcctaataggccacagaccagcaccttgcatggcctgagggttggggacccttgttctatagcactgcagggtaatctatagttaacaaccatttattgtatattttcaaatagctagaagagaggattttgaatgttcccaacacaaagaaatagtaaatgtttgaagtgataggctaattatcctgctctgatcattacacattgcatacatgttacgtgtgctttcattttcttcggaagagacagactaaataaatgaatatggtgatatgtgctttaaagaaaatgaaacagtatgatataatagtaaatgtgaatactattttagattggttagttaaggaaggcctctttggggagggaacatttgagttgatatctagacctgattgacagccatgtagaaatctcgggtaagatattccaggcagagggaaaagctatgcaaagaccttaaagcaagaatgaccttggcatgttaaaggaaaagaaagaaggctcatgtggctggaacctaggaagtgagtaaatggttagtaggggctagattgtgtaggactgtgcgtacatagtaaggattttagattttattctatgtgaaaagtgagactactggagaacattaatcaggggcacagagtgattaaaagtttagcactgggagagaaaagttggatgattatttgaaaaggagacttggatgaattctttcacccacatgaccttgtcttctcatctctaaaggtgaggataataatagttgcctaccttccaagattgtcaagaatttcataactggaaagaatcctagaaaatatctaacctaaatcctcataaagaagttgacgctcagccagattaaaccacctgcttatcttcagataggaggacagagctaggaggctccagaattttgtttctgctttgttttcctaaatgccatactgtatattcagtatttcaaatgatactgggaatgaacgcaaagggattttgcaaaccttagagtacaatacaaatgtaagagataattgttttcaggatactgggctctgagagaacaaagttatcataaggaatagattatttgggaagaaaagcactgataaacaagttgtactgatttttcaaatgctttgtctaggagccaccacagtcatgtcctgaatggaaacaggactgaaacccagtgaagagaaaatagaggttattctgaccatgagaaatagcacaaaagactccttttctctcctgtagtgtctccactagaagtgcaaagaggctttttgcctctctttattttattttgtttttttgagacagagcctcactccgtcacccaggctggagtgcagtgatgccatctcggctcactgcaatctctgcctcctgggttcaagcgattctcatgcctcagtctcccaagtagctgggattacaggtgcccgccaccatgcctaattttttatttttatttttgtttttagtagagacaggctttttgtaccacattcaccaggctggtctcaaacttctgacctcaagtgatccactagcctcggcctccctaagtgctgggatcacaggtgtgagccactgtgcctggccctcccttaactttagaagagcaactctttatttgtgctgatgcagggtccaagtaggcaaagagacagttaagagcagagcccataaatgtttactcttcagcaaccatctttcaggagtggaataaaaacaacatcaaaatgggacatctggtggtatcataatcaccataggcagttgaaattgtattgctttcttagtagtttctagataaaaaagaatattttattccaaaggtatttaaccaattaagctgtcattagaaaatattgaaagtgtaattgttaattacaccaacactaaatcctacaacaaaattaccttggattatctttctaaccttttattttaatctattttaatctttaacattttattttatttcatttatagaggcaattctctttggatataaacttcttcatttgaatgtcagactttgcagatcaaagtcttttatctctgttctgttgggtaacgtggcacacataagtggtgtagccaatttacctttaccttaaacttgttcccttaagaactgtttttttcttgccacatacaagattgatgaggatgcggaaaatgagacctcagtggggaaaaaaacaagaatattgctataggcttaatcgtaatttatatatttaaggatgatgggaaagatgaccacttctgcagcaaatgtttagcttctttcttttgaaataatctgaatacctatcaggtgctccctttaattaaggagaaaattgcaatggaaggtagagatgtaatattatcttatttgctacattataagaatccagttattgacagaaaggtcaattctaggatgctgctcctctctacagctaacacatctttagaattagatgttaaatgagaaattagttatttagagtgaataattgtcttagcttgggctgctctaacaaaataccatagactggatcgcttgaacaacagatgtttctctctctcagttctgaaggctggaaaatccaacatcaaggttctctggctcctggtgaggacctacttctggcttgcacatggctgcctttttgttgtatcctcacttggcaaagagagtgctttgatctcttcctcctcttataaggacactaattgcatcatggaggccccaccctcatggcctcatctacacctaattacttgctaaaggcttcaccagcagatttcatcacattaggggttaggggttcaacatattgattttaggacgcattcagtccttaagagtggtgatgatggaggctgtaaggaatgctagtttgtcttttaattaattacttaacttagtattaggaatccaatgtggaaaggaataattgtttgactgtgacactaggtcccttttttggttttcaacctctcccttagagcctgctccaagttttcctcagtgaggccttttgctggattggtctgaggaacaattctggctggaggtgggaagatggatcacctctaaacttctcaaggtaaggggcttcaaaggaatgcaaaaaaagagagagaggaaaaaggaaagccaaattatgatacttggggaatagataaagaagagcagatggagaggagaggaaagaatgaaaaggagaggaaatagggaacaaggaagggaatgaacaatgggtaagggcaaaaaaaaaaaaaaaaaggataacattttaaagagaggctgatgaacaattttaattcttctgctgtttgggggaattaggggcctgaatagggagacagaatttgcttcatttttatcccttcatgcctttcaactccttttctgtgcatgcggccttaagtgattgacttttctgatttcttacaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatctaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaatt

SEQ ID NO: 37398 - DNA, 8100 bp, Homo sapiens
ccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtaaggagggtcctctcccatcatcctggggatttctttttcttttctttttttttttttttctttttttgagacggaatcttgctctttcgcccaggcccgagtgcagtggcgctatctcggctcactgcaagctccgcctcccgggttcacgccattctcctgcctcagcctcccgagtagctgggactacaggcgcccgccaccgcgcccggctaattttttgtatttttagtagagacagggtttcaccgtgttagccaggatggtctcgatctcctgacctcgtgatccgcccgcctcggcctcccaaagtgctgggactacaggtgtgagccaccgtgcccggccgatttctttttcatctgggtaatgtttggtatctggatctctccctatttaagtctcagaagtggactggatggcttcagaagttgcttccagcctctatctgggaacctatcctgagttattaacaggtttttagaaaatccaactactgatacccagtgaggcaacagaggaccaaggttcttaccattcctttatgcaccttgtgtcaccagaagtaattgtaaggttcttaaatcccttctgtcagctcttcccccacccaacttagttttcctactagcagaattcttagcagatagggtcaccctgttgggtagcagttggactttggggaacttcatttcattggaagttctagcttattgtctttccagtgtttagcttatagtctttttttttttttttttttttttttttttttttttttgagatggagtcttgctgtgtttcccaagctggagtgcagtggtgccatttcagcccactgcaacctctgcaccccaggttcaagcgattctcaggtctcagcctcctgagtagctgggtttacaggtgcctgccaccacgcccagctaatttttgtactttttagtagagagggggtttcactatgttggccaggctagtctcgaactcctgacctcaagtgatcctcccgccttggcctctcaaagtgctgggattacaggcgtgagccaccacacctggcctagctttttgtctttgatttttttttttttttttgagactgggtctcactgtgttgctgaggctggagggcagtggcacgatctcagctcgctgcaacctccatgtccagctcaagtgttcctcacacctcagcctctcaagtagctgggactgcaggtacatgccaccatgcgtggctaatttttgtacttttgtagagacagggtttctccacattgcccaggctggtcttgaactcttcttgggcccaggcgatccgcccgtcttgacctcccaaagtgctgggattacaggagtgagccacacaatgcctgactagcttattgtctttggatcaggaagttacagttcaactggccagcgttgccattgcttgccactccccgccccgaagtcagaccccagtcaggacctaggcaagaagcaaacggcaggtacttcggaaaatagaacttgttagggaatgaaggtggggtggtcctcttagacccctactactactgggatctccttaccaggaaagcctttggcagaacaatgtattaggtaagaaggacttttaacagcccctcaccatactgcttcctgttcctacagggcctatttccagcagaagtaggtggggggtggtgtgtagagtaggcatctgatggcccagtgttgtgactgaccctgatatttgtgccagcaactaccctgatgactttgactctggcccttgagaaaggcccaagctttaggggaagccactcggctgatttgtagcatcctcattcctgtcattcttcacgttctcccctttacttcctttgagggtttcagtggtttctatgaaagttgacctctagatggttatcagcaattcccaaggtaaacgggtcattatacaacagtgagagatcaagcttccctcagtcctgatggatggaattaatggatggggcttgttcctaggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatcttatatctttgtcctcctctgtgatgttgcttgtactttagatcctcaaatctatttccctttctctggtgtgatacttgtgtaactgctggccttgttctacacagtcctgtgatctctaagcctgaatgacagtgacattttggccaagcctggtgatgtgaatacaagatacagtgagcacgttagggaggagggttacaagacgacaaaaatcctcagtttcttaatatttgctacatccaatgaggtacttcgtgttttagtctgttcaggctgctaatataaaatgctagagactaggtagtttataaacaacaggagtttatttctcacagttctagaggctaggaagtctgagttcaaggtgccagcatggttgggttccagtgaggcccctcttccaggtcacagactgcctacttctcagtcctcatgtggcagaaggggaagacaggctcccgtggggctctttcatgaaggcactaatcccattccagtgagggcagcaccctcatgacctaatcacctcccaaaggccccatgtcctaacactattaccttgggagttagaatttcatatgaatttggaggaacataaacatttagcccctggcaaccacagtctactttttgtctctagaattgcttattctgaacattttatacaaatggaatcacacaggccgggcacagtggctcacgcctgtaatcccagcactttgggaggccaaggcaggcggatcacttaggctcaggagttcgagaccagcctgggcaacatggcgaaatcctgtctctacaaaaaatgcaaaaattagcggggcatggtgctgcacacctgtaatcccagctgcttgggggagctgaggcaggaggatcacttcaacctgggaggtcgaggctgcagtgaactgagatcgtgccactgcactctagcctatgtgacaaagtaagaccctgtctcaaaaataaataaataaataaattgaatcacacaatatgtggtcttttgtgtgtggcttctttcactgagcatgttttcaagttttatccatgctgtagcatcaatcagtgcttcattccttttctgtggctgaataataggcattgtacggatatattacatgttggttttctgttcatgttggttcatctgttcatagatttttgggttgtttctactttttggttattatgaagaatgctgctataaatgtgtgtttttgtgtagacatgttttcatttctcttgagtatatacctaggagtggaattaccatatgctaggtcatgtggtaattccatgtttaacttatgaggaactaccagactgttttccaaagcagctacaccattttacatccccaccaatactgtgtgaggattccgatttctccacattcttgctagcacttgttattgtcttatacccatcctattcggtgagaaattttgatttgaggttttgatttacatttccctagtgactaatggtgttgaacatcttttcatgtgcttattatccagttacatatcttgtgtggaaaaatatctgttcagatcctttggtcatttttaaattaggttatttgtctttattttttataagagtcctttatgtattctagatactagacccttatgtgtaatttgcaaatcttttctctcattttgtgggttgtctcactttcttgacagtgtcctttgacgcacacgtttttcattttgctgcagtctaatttatctatttttttctttctttatgctttggtgtcatatgtaaaatagcactgcctaatccaagggcacaaatatgtacagctatggtttcttcaaggagacatagatttagctcttactttcagctatttggtccattttaagtttattttttccccatacataaacaagtcaatttttatataggttttgaggtaggggtctgtcaatctgatcaggggtctgtcttaatctgatcaggctcttacaacaaattgccttagactaggtaatttataaacaacagaaatttgttgctcatagttcctggatactgggaagttcaagatcaaggtgccagcagatttggtgtctggcgagggcccattcctcataaatggtgcctgctatgagtccccacatggtagtctcttgggtttcttttataaggacactaatcccatttatgaggaccccaccctcataacctaatcacctcccagatgccccacctcccaagaccactgcactggggactgtcaatatatgtgtgtcaggggacaggggggataaacattcagaccatagcagggtccaacttcattctcttgtatgtggaaatccagtagtcctagaatcctttatgaaaaagactattcttttcccattgaattgtcttgtcaaaaagcaattgaccctgattgtataggctgattatttacatttgaatttaaatgaattaaaattaaaaaaaaatttaaaattaagttccttagtcacagtagtcacatttcaagtacccagtagccacatagtcacatgtggctagtggctgccatattgaacaacgtgcatgtgcctgtgcatgcacgtgtgcacacacacattttccacatcacaagggatccttctccagatcctgtgatttcccataggccgttccagctcatctccatccagactgtcaatccttctgtaattaggatacatggctaagccctgattccagtttctgaactcatatactgtcaaatttgtaatgaaagaaaacatcacagtctctgaacttaccatcttttgaagagaaggtggttgtcaattagtgtttactaagtgaggggtatttgttgaaatagctcaggcattggactacagcagtaaaatttgcaatgttgagatttcacctctcttccttcttcattagatacccaattctgatgggtttgcttttccctgttcttcatttcctaaacctttccctaaagggagaaaggaagaaggaggatggagaacttggttcctaaatttaatataaatcacagtcaccccaggagcctgctaactgtgcagattatcaggcccaaccccccgagattctgacccagcagctctgggggaagggtgaagagcctgcttgtttaacaagtgctccagatgagtctaatgcaagttgccagcggagggccaccctttgagaaacctctcagagtatttcataactcttgctgaagttatttcttccaagtgcagaaaatgaagcattttctttctaattatagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccag

SEQ ID NO: 37399 - DNA, 13038 bp, Homo sapiens; identical to SEQ ID NO: 36918

SEQ ID NO: 37400 - DNA, 63829 bp, Homo sapiens; identical to SEQ ID NO: 35906

SEQ ID NO: 37401 - DNA, 63829 bp, Homo sapiens; identical to SEQ ID NO: 35906

SEQ ID NO: 37402 - DNA, 7143 bp, Homo sapiens
ggtaaacaggctctgtatccgtggcagcggccgtggcaggctggctgggtaccggctgtcgctgacccaggagaagctgcctgtctacatcagcctgggctgcagcgcgctgccgccgcggggccggcaggtaggctgacctcgggtcgggggacgcgggcggaccaggggcgagaggagcctgacaggcccgcgtcctgaggaaaggcagtaccgggcggggagagacgtgggaattccgccccactctcaggggggcgctttcacacccagcttaggcctggagtttgatgcgttgatgcttgccacgatcttacgaggaaactgcggctcggataagttcggggagtttacatagtaaagagtcggctcgcagtgcctcgcatgcatctgggagagccggggcgcagaaagtatgccaccgcctcatgctcagggagcttagtcccagctcttgggccaggtgttgctcagatgctcagacacgcgtgtgatgggagttggtagataatctgtgaactctttccctgcacctcttcttccatcttacctatctctttaagccagcccttccaatcagataggtgggccaagccagattcatgggagtcatgcctgacttgtttttctcttatccccaaacccccacattcagtcagtccattgctaagccccatcacctcgacttacaaaacatctcaactcggaacacttgtgttcggctgccagccttggttactgcaatagtctcctgtttccacggtcattcattccacaaacatttactgagtgccagttatgtgtgggcaccatgctaggtgctagggttagagtgatgaacaagaaggtacttggggctttgccctctcttgttccctccaatcggttctctcaggctgagcaagagtgatctttctaagtctgattttgttggtctgctgagaacccgctggctgtcccattacccttctgataaaatccaagctcatgactgcgtctttcagagccttcggtgatccagctgttgtctccctgtctagcctcattctgttcccttctcttgctcagtctctgttctcggaatgcatcaaatttcctgttgcctcaggatcttcacatacgtgtttccttctgcctgcaatgccttgcttcccctttcacttgacatacttttggacagtctttaggtctgtttaagtgtcatttttttcagaaggcctctgttggccctcccctccaagtccgccccccatgaactgtgtcctcctgcagcacttcacacagcaccatgtacttttccttatagtaatatcacgatttgtgattatttctttaccatctgtccagaggcattgttttcactagtctgtccccagagcagggactgagtggatgtttctgaataaatgcatgctctcagggaagggggtggaagttgaagcagatatttgctccctcatgttacttcaatctttctggagcagctggtcagattaatgacctgtagctgcgaaagacagattttttggttttttttttgagacagggtctcactctgttgcccaggctggagtgcagtggtgtgaacacggctcactgcagcctccacctcctgggcttaagcgatcctcccagcttaccctcccaagtagctgggactacaggcacctgtcaccaggtctggctatcttagaaatcttttgtagagacggtattttgccacattgcccaggctggtttcagactcctgtgcccaagtgatcctcccacctcagtctcccaaagtgctgggattacaggcatgagctactgcactggccagatctttttaaaaagccctattttaaggaagctacagatgaacaaaatgcttcaaaaggatgatgctagctcacttacatcagtggattccagtgaggccaaaggccagagtcgtctacagacagctcatagacatgtattagttggcccatgcagtgttggatgtgggttttcccccttacttaaaatttttggattacataccaacattgaggtactggatttctggtcatcttaaaaaccagaagttctggaaacagtgagacttgattattttccagccattgctcctccttggcacacctgccctggacagccaaccccagaatcaccccattcagaacaggacttctctaaggaagccagaagggaaacagctgaggctgggggcagtgggggcagagggaaggggctggtgcaagtccaggtgatggtagactttggagcacctgggttttagaattggcatagcagccaattgctagatgtaagtagcattgcctccctttttaaacaggtcataaagatgtctatgtttaattgtgtgtgtgtgtgtgtgtgtgtgtgtgtgtgtgttttgagccagaacaagagtgagttttcagtatttccttcctagaattgaggcatcctttggaacaggaatgcaaggtggcttggtaagggagaagatatctctgttagttctctgttgcctacagaaaaaatccaaactccttagcttggcatgcagggtcttcctggtctggctccagctcacctttccagctccattctttttcctctcgtccttaggtgagataggtcctttcagtgacttcaggcctttgtccatgctgttttctctgcttggaatacctatccctgttctcctgccttgatatgttcttgctgatacttcattcctttttgtgttttctgctaggaagagaatgacccaactttgattcccaattcaggcaagcatacgttttgagtaatattcttactcctgactttttattttttaaccataatttttaatttactcggatttcctttatttggtttttgtgttgttccagtatatgtatttgagaagccttttcatgtgcttttcagtacataactggtgatatataaagtaaatacactgatggcttacaacttagttcacatgtcactccttcattaatggctctgtcctcctctggctctttactgatgtttctaaacaagcatttaacgcagtgtggtttttcagtttccgtgtctgtcttcttccagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacaggtgaggctcagagaggtggtggcagagggaacggggatcctttggaacacctgggtttttggcattggtgtccaagggcaggagtggggctggcttggcagcaggcatttccttgggtggctgggaagtgatgaggaattgggcctgtttctttacagccatggccaaggacatcctgggtgaagcagggctacactttgatgaactgaacaagctgagggtgttggacccagaggttacccagcagaccatagagctgaaggaagagtgcaaagactttgtggacagtgagtattggggagatacagtgccactcagctttgagctgccatttcaactgtaccccaggctcatcttggccctgccacagtggagctgctggctccctggaggttgaatctggcgtctgtgagttcccacgtgccacccttttctgtctgccctcttgtgctctcatgtgtccccaacagggcaccagtcaaaccaaacaccgggatggggaggggagggtgtctttagatatgccatctttcatttcttgctcttagaaaccttaaactttctgggaacacaaccatggcttgggtgtgggaaatagaattatgtactcatgatttgatttcttcagagaaagtcttctcaggggcaggttctctgttatttggagttagaagtgataggtgaagtttctagaagcagctcaacagacttactgaagtcatcttttggctggaaatcttcaggaagcctcctgtcccagcagccaagcaagcccaatgcccgtacagagccagatctagctagaacaagggacttctgagctttctggggggtttcctaggttgtggagagagcttggttagtgaaaggtagcttgggttctgtcactaacctgtgattgctgtgccatgcacacacctctctgggccttagtttcccctcagtaaattgtcacatccaggacattggagaaagtgagtgggagattaggcacttaatgctgtgagcttgcttttttgtggttacaagtgggaagcccccatccccactgttaattgaaatctggtgtcatacctgtagctagtccagaggcagcgcttgtgtcctgaggctgcccttttgtgaacaacagtgcttcctgtcactcctggggaagcagggttggggtctgtctggagaatgagcccagcaagggcctagtgctttcatagccggaggtcatagcggctggctggctcagtggggatgcaaggtccgagtatgccctggtccagctggccacccttctctaggttcagaccaagggtaggagacaggccaacaggcaccaaagtgtttaagcgacagggtcttgctatgttccccaggctggaatgcagtggcagttcacaggcatgatcacacatcctctaactcctgggttcaagtgatcctcccacctcagccccctgagtagctgggactacagttgctctccaccacgcctggcccacaccgaactattttaacacaaattagaaggggcagtccgctctgccctctcactgccttagcactctaccgaaggggagtgatgatactaaggaaatattttattttttgttcttttcctaaaagaaattggccagtttcagaaaatagttggtggtttaattgagcttgttgatcaacttgcaaaagaagcagaaaatgaaaagatgaaggtaagatcagcatgtcttccgcctacatcttggcctgggaccctagttcactaccctctcatccctcttccctcttgatttatttagaggggtagagggctgggtgggtgaatttttatttaagattttaataacttctggtccacttaacctactgaacttttgccaatctttatttcctttaatctttattttttttttttttttgagacagagtcttgctgtgtcacccaggctggagtgcactggtgcaatctcggctcactgcaagctctgcctctcagattcaagcgattctcccacctcaccctcccgagtaggtgggactacaggtgtgtgccaccacacccagctgaggtttttgtatttttttttttttttttgagacggagttttctctcgttgcccaggctggagtgcaatggtgcgatcttggctcactgcaacctccgcctcctgggttcaagcgattctcctgcctcagcctcccgagtagctgggattacaggcatgtgccaccatgcctggctaattttgtatttttagtagagacagggtttctccatgttggtcaggctggtctcaaactcccaaccttaggtgatccgcccgcctcagcctcccaaagtgctgggattaaggcgtgagtgactgcgcccggccatttttttgtatttttagtaaagatggggtttcaccatgttggccaggctggttgcaaactcctggcctcaagtgaactgcctaccttggcctcccaaagtgctgggattgcaggtgtgagccaccacacctggcctcgtttcatcttcatatcagcactgatgtagatggtcttatcctcattttataaatgaagaaatgaaggcttacatagtatgattggtgaaaggcacaaggctgaatggcaccaccaaatgtgctattgtgcctgtgtccctggctctaggaatactcctagacctgcctcaaagctgccgtctagttcttgaggcactttgtgatcagtaggttaatccttctgacttaacccaaaagctttggggctccactttcttttcctctctgaagactgacacagctcccagataacccctccccactttgaggacttgatgctgtagatggttttaatgaagccatggccttctctggcaatactgtaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctagaagaattaggtctgtggtttacttcatctttttttcagggcctctaacaattttgtttttcaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatg

SEQ ID NO: 37403 - DNA, 55680 bp, Homo sapiens
cggattgaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacggtgagttgggggggcaacggggggctggaattctcggaccctctgccgccgcccacagaggccgggaacaggagacaaaatggcggcatcgtctgcgagcctggcccgggggcttgggttcgggaagcaggaaatggcctgggagctcccggggcgatgggaggctctatgccctggaatgtgaccccttcgccgtccttaactgcaaacaactcgcgggccgggaggccggggcgacggggtggaggagttggttgtaaaatggcggctggggggagggcgagtcccggggcgggggagggggaggagatggcgggtgctgtctccgaacgagccaccctcatgggagcttctgggacggccttgggatgtggagaacaattgggtggggtgacgggggaagcagcacccgccacatgggagagagcgaagaccgggagctgtagcgcgggcgcctttcagggaaatatggcgggtgggggcggtggcttttccccggaggccccgtgtggggcggcggccgtggagtctcacaaaggaggacctttgagagcgatgggcttcctcaggcctgaggtgggggacagtcgtggatgatggtggggggagaggggtgagtgggaatcactgcagttcgtcttcgggcggtggcaggctcccatgctgcgatcgggtttctttcccgtaggccggcacctcgtagtgaggggtttcggggcttttcctcctcgtcgtcttctggggaggcccagaaaatcctcactccctccctttcctcagacttaaaacaggagatctcgaagttcctgtaacctttctctggctccatcacccgtgggttctgatggatagaaccaggaggccacgactctgagagttcgagcctttgtagagcccgagcctccgtccccccgtttgtaaaaacgatgactttacagtttgtgcgcaccgtgatgacaaatgggaagacctgttgaaataaagttatttccaatagtgttcagtaactgtattttggttgactctgcaggctcggaatgctggtctgtacttcgtgggggatcttaacctattccaggcgctcggctgaggctgggttttttgagttatgaaggttgaagatcctgttgctttctttttttccgttttaaataaatgggtttatgtagaaatattagtaggtcctctttgttcgttgttcttttgcccctaatgggttctccagtcctttttcagaacttcatcgaatgtccattgtgtctgtccagtcattgtcaggaagtttattcttaatcctctctcccagtccaccttttggaccaccttttgaaatacccacacatttataattgtgcgatactgtagtattaaacgaaaggtcatgtctgtgggtcctgtggttttaatgcttttgcgtggtagggtggggtgagacatggttggaatcaagtatctttgattcttagatttttttcctaattaaaatacctatatttcaaaatgttagggcccttgctttcctcgaaatgcggatttagtcatgtgaataacctcagggttagtcccccttatcatcagaaataagattcagggatttgaaaataagacaaggcctctagaactcatatttaggaaatatagtgaactaaatttcgtcttgtaaattcttaaattgctatttgtattcaacaaggttcctgttggggggggggataagatggggaagtacagctcaaggtctgctttgtctttatttcagtgtttaaaaatcaaagagatatgaatgtgcttgtattggaagtctcctcctccgccccctcatctccagatgttcccctcttaatctgttagtgttcttgggaggaaacaaattgtacttgaatgctttctattttgtgggtattggggctttttaagtaaacttgctgtgataactagaaaggatgtgaggaaaggtctttttctttttgaaagctcctttaaaaaactgatttgaaagcttgtgattgtagtttccaaataaagtacaggttagtgataattatatttttgatgtgagtggtgaggatttctgaccagagcccttattggttattgaacatgggactctgatacagccacattattacagttgttaatgttaggtgtccccttcaggatctaaaggggtaaggaaataggatctacaaggtgaggagctattgctgtgacttggggcataaggtagggactcagtggaaaggagaggaggaggaggagacagaaaccaggaatttctacctgtgtcctctacctgtgtccattcctttattgagtgcggtatttttttgtttctggtggcaaagttttcccggagttctggtcaccaaacagaacttagcaggtgtcgggggtggaagaaggtaagacagtgtattggcaggatttctttgttgggtacttgtacccaaatgctgggtttccagctgcccttttatctctctgttactgcagcaggcttattttattttgcttgctgtgttgaattagtgcctaaacttctttgtatcctcatttaattctatcctggggcgttggaatcaatttatatggattatttaacagtacgggaggaagagctaacctgtgttcaggaaaatgacaattttgggtcacaggaaatatttaagtttggggctgggagttgaagattaaatctagcatctcatcactttaacaagccagtagtctattcgaatcgtttttacctcctttgaaaccatattaagcaagtccattatttcttagcatttctcaaacagctcttactgtcccgtatatgaaatagtacaagaaagtggggaagaaaggccgggcggggtggctcacgcctgtaatcccagcaccttgggaggtcgaggcgggtggatcacctgaggtcgggagttcaagaccagcctggccaacatggtgaaaccctgtctctacaaaaataaaaaaattatccgggcatagctactgaggaggttgaggtggaagaatcacttgaacccgggaggtgaaggttgtagtgaaccaggattatggcattacactacagcctgggcaacagagcgagactcttgtctccaaaaaaaaaaaaaagaggccaggtgcggtggctcatgcctgtaatcccagtactttgggaggccaaggcgggtggatcacctgaagtcagaagttcgagaccagcctgaccaacatggagaaaccccgtctgtagtaaaaatacaaaattagccgggggtggtgggtgcctgtaatcccagctacttgggaggcggaggcaggagaatcacttgaacccgggaggccgaggttgcggtgagccgagattgcgccattgcactccatcctgggcaacagcaacaataaaaaacggggaatatagaggggaaaagtttacccgtttttggggagcagaggggtaacataaactacatttgggcttgtggggctgttgttggttttgtcctttcctagtctcttccctatcaagattggcttcatggaaggtaggatgaagttttgatggtcatgttggattccctaggaatgcatctgttgagtcatttacttgagagctgtcttttttttcttttgagacggagtctcgctctgtctcccaggctttattgaagtggcacaatctcggcccactgcaacctccgcctccagggttcaagcgattctcctgcctcaccctcccgagtagctgggactacaggcatgtgccaccatgccatgctaattttgtatttcttttttagtagagacacggtttctccatgttggtcaggctggtctcgaactcccgacctcaggtgatccgcccacctcagtctcccaaagtgctgacattaaggacctgagccaccgcgcctggtcaagagctgtcttttttttgagacggagtcttgctcttgtcgcccaggctgtagtgcaatagcgcgatctcggctcactgcaacctccatcccctgggttcaagcgattctcctgcctcagcctccaagagtagctgggattacaggcatccgccactatgccaggctaattttgtatttttagtagagatggggtttcgccatgttggccaggctgatctcgaactcctgacctcaggtgatccgcccgcctcggcctcccagagtgctggggttacaggcgtgagccactgagcccgctgagagctgtccttttaaaacaccagatcctcatctctagctagcttattctgctagttagtgaagaacagggaagggagcatgtgtggaatgaactttttactacggtcttgttaggaaaaaaataggtagtagtaaattaacgttgttaataagtttagaagtatttagattaactaccagttctttgactgtaggccagtaattttccattgccgtttcagttaatggactaactttctggagtaaagtttatttttctccttcttaaatgcatagacagaactgagtaacgtagtgttaaaaatcccttctacgactgggctctgtcccccaggctggagtgcaatggcgtggtcttggctcactgcaacctccgcctcccaggttcaagcggttctcctggctcagcctcccaagtagctgggactacaggcgcgtgccaccacactcggctaattttttgtatttttagtagagacgaggtttcaccatgttggccaggatggtctttatctcctgatctcaggtgatctgcccacctcagcctcccaaactgctgggattacaggtgtgagccaccgcacccagccaatttttgtgtttttggtagagacagggttttaccatgtttgccaggctggtcttgaactcctgacctcaggtgatctgcctgcctcggcctcccaaagtgttggaattacaggcgtgagccaccacacccggcctgattgtttttttttttcatggatgactgtaagggtgactgatactgcaggcatattttttctttatatttcaagaacactgtgtacacaaacagtaatgacaagcatggagtaaaggctgcagttttatttttatttatttttttgagacagtcttgctctgtcacctagggtggagtgtagtggtaggatctcggctcactgcagcctctgccccctgggttcaagcgattctcctgcctctgcttcccgagtagctgggactacaggcgcccgccatcgcacctggctaatttttgtatttttagtagagatggggtttcaccatgtttgccaggctgatctctgactcctgacctcaggtgatcctcccgcctcagcctcccaaagggctagcattacaggtatgagccactgtacctggcctaaatttttaattttttaatgggcacatattaggtgtatgtatttatgggaaggctaaattaaaaaaaaatttttttttgaaacagggtcttgctttgtgacccaggctgaagtgcagtgtcgccattatagcttactgcaggctcgacctcctgagttccagtgaccctcctgcctcagcttccctagtagctgggactgttgcaccggcctaatttttgtgtttttttttttttttttttttttttgtggatttgaggtctctatgttgcccaggctggtcttgaattcctggactcccaccttggcctcccaaagtgctgggattacaggtgtgagtcactgcttctggcctaaactttacatatgtgtatatgacattatgcagtacctcagttcacagcccacgttgacaaaagtttttaatttatgtaacaagattgaagcaggtagagcgttactcccattttctggttcaagaaagtgagtttgagagagagatttttttatgatcatgtggctaatcagttattaaatggtaaagccagaacttagtgtctgctgacctttagatcggtacacttactctcagccactcaaaagacctctgtgaagtaaggtggtgcctttcaggggagtagggggtgagtagcgtatgcttgatgcttgttctttaacaattctaatagcatctacttcacatcttgatgtttgtgatgactgatatccatggtgaattgtagacaaaatcttttcactttcctaaagaaacctgatggtttttttcagagataaaatcccatctcaaggcacagcgaaattaaaatgaggtgaagtttaggtactctcagaatgtttattcgcatacagattcttaaaaaacatgatttattgtaggcagatgtcacctctttaagcaaaagaaaaaaacaaccaaaaaaagaaaagccccagccgggttccgcggctcaaacacctgcaatcccagcactgtgggaggccgaggtgggcggatcacctgaggtcaggagtttgagaccatcctgaccaacatggtgaaaaccagtctctactaaaaatacaaaaattagctggcctgtgatggcttgtgcctttagtcccagctactgaggaggctgaggtgggaaatcgcttgaccctgggaggtggagattgcagtgagcccacatcgcaccattgcactccagtctgggccacagagggagagcctgtctcaagaaaagaaaagccccgtagtttatcataatgtctgtactgggatatggctgatgctatgcatttctgtaaagtagctttaaaatattttctcctctcacttttatctttttcctttttttttttttgagacagggtctcacttggtcacccaggctgtagtgcagtggtgcgatcttggctcactgcagcctctaccttccagtctcaggtgatccccccacctcagcctcttaagtagctgttttttttgtttgtttgtatgtttttaaattttatttatttatttatttatttatttatttatttattttttggagagatggagtcttgctctgtcacccaggctggagtgctggagtacagtggcgcgatccaccactcccagctaatttcttttgtgttttagtagagatggggtttcaccatgttgcccaggctggtcttggaattcctggactcaagcaatctgtcagacttggcctcccaaagtgctgggattataggcgtgagccaccacccccggccacctttgtcttagtgaatgctattaagttgttaggttagtgatgtagtcatacaacttttttttttttttgagatggattttccctcttgtcattcaggctggagtgcagtggcgtgatcttggctcactgcagcctccgcctcctgggctcaagtgattctcctgcctcagcctcccgagtagctgagactacagacttgggccatcatgcttggctaatttttgtatttttagtagagacagagtttcaccatattagccaggctggtcttcaactcctgacctcaggtagtccgcctgcctcagcctcccaaaatgctgggattataggtgtgagccaccgcacccggccagatatagacatacaacttctaggagggacaaaggttggcatatgattcaccagtgttgttccgggtggttggctagatagctgtctaatggaatccattaaggagtaggaaagagcagcaagaaaaatggctattttcactatttttgaaatggtcagttaacagtttgagatagatacatatacttttttgagacaaggtcttgctttgttggccaggcttggattgcattgatgcagtaacgattcactgcatcctcaacctcccaggcccaaatgatcatcccatctcagcctcccacttagctgggcccacagctgtgcaccacaatacctggataatttaaaagaacttttttttctttttctttttcttttttcccgagacaagatctcagtatattactcaggctgggatgcagtgtcacatttatggctcactgcagctttgaccccctgggcacctcagcatgccaagtagctggggctacagaagtataccaccacttctggctaatttttgtagagacaggattttaccatgttgcccaggtcttgaactcgagctcaagattcacctgcctcggcctcccaaagttttgcgattacaggcgtgagccaccatggctggcaaaaaaatttttttggtagaggcctggtcccagcggattgcccaggctgatgttgaactcctgagctcatgtgatcttcccaccaggtagctggtaccgccatgaccagctaattaaaactttttttttgtggagacgggatcccactgtgttgtccaggtaactcctgggttcaagcgatcctcccactgtggcctccccaaagtgcagggattataggcatgaaccactgcgcccggccagcttgatatatttaggtattgatatatccaaattgacgaattggttgccaacagaacctcatggttctctgactaaatgttaatgctagtcatggccctaagaacaatttcagatgttcatttaaatttattaaattgtagcaaataataatgaaagtcaccataatttaacatccacatgagtatatcttgaaaagacagactaattcatcagctacaacagcaggcataaactgggattgtcctgggcaacaaacttgccttgtggtcaccctacttaatggccatttgttactagattttgtcatttagactcatacaacagtttcctaaacgttgtccagctttttatcacagagatagcttagatctacgtctctaggaggttgaatttttttttttcaaatgaagttagcctttggcagaatataagtcaaaggaaaagtgaaaatttcctcctcctagctccctcccccacaaatgggaacgtgctagttaaggatgtggtagttgctgaaaatagagcttgctggcattccaaatcctctgatggtgtcaacacctagtgtgttggttttcttatggctaccttgagccagttctgtgtttaaaaatataatagacctaggtgttggtagcagtgtcctaagctcagagctttccctacatacattttatttttttatttttacaagtgtctttcataccaaatacccacataaaaatttaaaggctcacccatatcttgttacaactgttatgtttagaatgccaaactgtgtagttcagaccatatgaccatgatcctggcttatctcttctgaaatttttatcttgaatttattgcccttccaacaatctaccatagtagctggacggatctgttgttggtgggcttgatttgtgatcagatcaggattttatcgagctaaagcaatatgaaatgtgtttaactcttcattcatatctaaagtttgaaggagatgcattactgtaagagttatgacagtatttcatcatttggcagatgtggtaaatctgccatcacagaatgcacaggaatcactgggttccttatctttcaaatggggattagtgatgtctctcttgcctactaatttgcagggtggttatgaaattttgggcttttgtaaactgtaaagtgtaatacttgtcggtactatttgttgtgaaacattcttatctaatgtgaaaggtcagataattgtttttgttactgctgtgctaggatcatattagatgataacctacctttttgagttattcttagcaagtgtagtcttctgggcttagtccttatgtaagatatgcacaaagaaatattctcaaaatccttaatcttacatctgtaaatttgcatatccaaagtaaaggtcgtccagattattcccaaataataattttgtcatgttgagctggtatatagttgttttgatattaattttagattaataagagactttctccttagcaaacgtaacaccttttgtctgaatttgggatgaaagctgctgtaatatgaaaatgtaggctgggtgcagtggctcacacctgtaatcccagcactttgggaggccaagttgggcggatcacctgaggtcgggagttcaagaccagcctgaccaacatggagaaatcccatctatactaaaaaatacaaaattagcttgaagtggtggcaggcgcttgtaatcccagctcctcgggaggctgaggcaggaggtttgcttgaacctgggaggcggaggttgcagtgagccgagattgtaccattgcactccagcctgggcgacaagagcaaaactctgtctcaaaaaaagaaagaaagaaaatgtaaataattggccaggtacggtggctcacggctgtaatcccaggactttgggaggccgaggcgggcggactacgaggtcagcagattgagaccatcctggctaacacagtgaaaccctgtctctactaaaaatacaaaaaattagctgggcgtggtagcgggcgcctgtagtcccagctgctcaggaggctgaggcaggagaatggcatgaacccgggaggcggagcttgcagtgagccaggatcgcgccactgcactccagcctgggcaacagagcgagactccatctcaaaaaaaaaaaaaaagaaagaaaacgtaaatcattgttaaatgttcgcattttagccatctcagattacttaagaaaaatggtgttagctatgaccaattttgtgaaatgtgattctaaaggcataatataagccttggacagtgaatgggttttgattaataaaaagctactaaatactacttaatccctgggttagtcagctgaagactttgtaggaccttggagtggttgttgtgaacacctttatgttgaaatttaagtgtttaaatgttagtaggggccacgtgcagtggctaataatccctgtaattccaatactttggaaggcagaggcgggaagatcccttaagcccaaaagtttgagaccagcctgggcaacatagtgagaccctgtttctacaaaaagaaacagaattagcttgacctagtggcatgtgtctgtagtctcagctacttgggaggccaaggtggtaagatttcttgagcccgggaggtcgaggctgcagtgagccatgataagaccactgcactcccacctgggtgacatagtgagaccctgtctcaaaaaggaaaggagaaagatttagtgggattaatgacttgtatttgattgtaataggtttacttgtaaaatagttaagatttatgataggattaccgtgaaattttcaagaacgttatttgaccagaaaatattgtcactgttgtatgacagttatgacagtttttgtagatttttagaaacacattcatgagtatgaaatacttaatgcagaatatactacttaggaaacattaaaatattaaagtgttgaaattttgatgggggtttcttagctcatcaaagaattgacatacctgtaatctcattgcttttggaggccaaggtgggaggtcatttgaggccaggagtttgagaccagcctgggcaacattgcaagactccgtttctattaaaaaaaaaaaaaaaaaggctgggcatggtttgctcatgcctgtaatcctagcactttttttttttttgagacagagtcttgctctgttgcccaggctggagtgcagtggcgctccacttgcatcttggctcactgcaagctccacctcctgggttcactccattctcctgcctcagcctccggagtagctggtactacaggcgcctgccaccacgcccggctcattttttgtatttttagtagagacggggtttcaccgtgttagccaggatggtcttgatctcctgatctcacgatccgcccaactcagcctcccaaagtgctgggattacaggcgtgagccacagcgcctggccaatcctagcactttgggaggccgaggagggcagatcacgaggtcaggagttcgagacaagcctgaccaacagggtgaaacctcgtctctactaaaaaaaaaaaaaaaaaaaaaaaaccaaccaaaaaaaaaaacaaaaattacccaggcgtggtggtggcacgtgcctgtaatcccagctactcaggaggttaaggcaggagaatcacttgaacccgggaggcaaaggttgcagtgagccgagatagtgcccctgggctccagcctgaacgacagagtgagactccgtcaaaaaaaaaaaaaaaaaaaaagccaggtgcagtggctcactcctgtaatcccagcactttgggaggccaagaagggtggatcacctgaggtcaggagttcaggatcaggctggtgaacatggtgagaccccccgtctctactaaatatacaaaaaattagacgggcgtggtggcgtgcgcttgtaatctcagctattcgggaggctgaggcagcagaatcgcttgaactcgggaggtagaaagctgcagaatgccgagattgtggcactgcactccagcctgggaaacagtaagactccatccccgcctactgcccccacccccgcaaagaaatgcttaacactctcaaccacttgagaaaacatgtcaaacttcttaaaaatctgaatgtaaagttaatccttctactaaaccgaattggacccaagggttatttgtggtcattttcttccttagtattccaaaacagaattttaaagtattttttgtttcagtgtcttttctaattccataaaaactgtaaaaagattcagactttgatctacctgtttttcctgtacttagtgttttaggtcattgatctccccagcctcttattttccacctcaggtttcactggagcttcacctgtttggttctactgcagccgaacgtgtttatgagggagtatcctcgtaaattgagaggagaaatctcccattctgatggagcaggggattactcccccacccccaatatttttatttttgttttttaatctttgtgtcattccaactttagtacatgtgctgccaaagtgagcacaaccctgccctaaatattgagaccaaagggaaaagtagcttttgcagtcaaaattgtagaatcttggtaaaagattgtcttgtttttgtttctttttaacctagcaaaagctgatttggaaaggagtcttaaagtttcatagaaggttacacaattcatgttttcctcttttttttttttttccttttgagacggagtctcactctgttgcccagactggagtgcaatggcgcgatcttggctcactgcagcctccacctccttggttcaagtgattctcctgcctcagcctcctgagtagctgggattacaggcacctgccaccatgcctggctaatttttgttttttcttcagtagagacgggtgtttcaccgtgttggccaggctggtctcaaacttctggcctcaggtgatccgcctgccttggcctcccagagagctgggattataggcgtgagccaccgtgcctggctcatgtagttacttttagagtgaggagaggtacctctgtataggctggtatatgaagagtaaaagttgtccttgagtgtcaagattattgtcttttgaaaagccttaatcaaagtattaaagtactaaaaaacaagttcccaaactcatttgacaaatacttactgaatgccgactatgtaccaggcactgttctagacactttagacacttgggattcatcagtgaacaaaatagacaaaagatcttttcaaggactttatattctagtgaatgtatgattgctttcggagttactctgttcctatgtgtaattaagagttagtttaaattaattagcaccaatggtgtctggtatatgcagggtactgtatcagttgctgggtgtcccatgttaaagactgtagaaagctcagtgtttcttcactgactactggtgtaaaatggtactaacaaattgaaaaacctctttaaagtgtttcattgtgatgaaaccctgtaataataatatcatctactgtttattggctatttctttcacttgttatccaaacagccatgcaaagtactacccattttacagataaggatccagtacttgaggaaaagtgacaacacatttgaaatgtcactggtattctgccaaggctggtgccctgcaaagctggtactccttccacttcggaaggagtttcttgtgtgtaaacgtcagtccagactgcttgaggctttcttttctttttttcccccttttttgtggagactgggggtctctgtgttgcccaggctggtctttcagctgggctcaagaagtcctcctgccttggcctcctaaagtgctgggattatagcagtcttttggctcagcttctctctgaatagtgttgtctttaatgtatgaagaagacagaatggaatgtaggctgagtatattttgcaggtaacaggtaatggaactagtattgggataggagccattaaattcaggagcaggccacctgcatcctccgtcttccttccttccctcctcccccaccctctgaaaaacctactttgtttttaactctttgatacatgcaggggtccccagtgcccaggccatgcacccatactggtctgtggaaaaattgtcttccacgaaactggtccctggtgccacaaaggttggggaccactgatatttgggactagagctttataaatggctggataagaagctctgggaacttagtaaattgcagtatggtgtactttttcgttgtgtaccttttcagtagatgacttttgaggcatgtagttgggaggcctgggggactgatcacaggggaccttggtgttttcctctagaccagttgctggtagattttcatcttctcaacaatgaataactgcacatcattaacatggtcttaatgcctttatcttattgctgcagattttttcttaacctttaacttttctggtttcagaatgctgccaacatttctgtattcattttatctttactttttttttttttttttttgagacagagtctttccctgtcacccagggtggagtgcagtagagggtgagcttcagccaaggagtgttatggtcatgcctgtgaatagccactgcaaggcagccagggcaacatagggagactcctctaaaaagaaaaaacaaacctgaaactgattttaaaaaaaatttctttgggaggccaaggcaggcagatcatctgtggttgggagttcaggaccagcctgaccaacatggagaaacccgtctctactaaaaatacaaaaaaaaattagccaggcttcgtggcgcatgcctctaatcccagctactcccaggaggcggaggcaggagaatctcttgaacccgggaggcggaggttgcagtgagccgagatagcgccattgcactccagcctgagcaacaagagaaaaactctgggctgggcgcagtggctcactcctttaatcccagcactttgggaggctgaagcggatggatcataatgtcaggagttcaagaccagcctggtgaaaccctcaaaatacaaaatacactccattatcctgcctcagcctcctgagtagctgggagtacaggtgcctgccaccatgcctggctaattttttttgtatttttagtagagacagggtttcaccgtgttagccaggatggtcttgatctcctgacgttgtgatctgcccgccttggcctcccaaagtgctgggattacaggcgtgagccaccgcgcccggtcgagcataaatctttttacatgtgtactcttaatgttttgagatgtggtctcactcttgcccaagctggtgtgcagtagcagacacacctcactgcagccctcacctcctgggctcaagcaatcctcccacctctgcgtcctgggtagctgggactacaggtgtgcccaccatgcctggctaatttattttttatttttatttttttgagacagggtcttgctctttctcccatgctggagagcagtggctggatcttggctcactgcagctttcgcctcctgggttcaagcagttctctgcctcatcttcccgagtggctgggattacaggcacctgcttaacgcgtggctaattgttttgtatttttagtagaaatggggtttcaccatgttggccaggttggtcttgaactcttgaccttgtgatccacgtgcctcggcctcccaaagtgcttgaattacaggcgtgagccactgtgcccagccctcttcggctaattttttaaatgtgtgaagagatggggtcttgccatattgcccaggccggtcttgaactcttgggctcaggaaatcttcccacctcagcctcccaaagtgcggagattgcgggaatactctattttctgaaaaggtttattaactgtttataatactagcaacttacgattgtgcagcacaaaatttaactaaaaacttgtgttttaaaaaattgtttaaacaagggccgggtgcagtggctcacacctgtaatcctagtactttgggaggccgaggcgggtggatcacctgaggtcaggagttcaagaccagcctggccaacatggcgaaacccatctctactaaaaatacaaaaacttgccgggcgtggtggcacgtgcctgtaatcccatcttctggtaggggctgagacaggagaattgcttgaacccgggaggtagaggttgccaggagctgaaattgtgccactgcactccagccggggcaacagaccaagactccgtctcaaaaaaaaaaaaaaaagttaaacagtatgtgaaatagtttttccatttctttttttaaacggagtttcgctcttgttgcccaggctggagtgcaatcgcgcgatctcagctcgcggaaacctcgtcctcccaggatcaagcaattctcctgcctcagcccccagagtagctgggattacaggcatgcgccaccatgcctgtctaattttgtatttttagtagagatggggtttctctatgttggtcaggctggtctcgaactctcgacctcaggtgatccatgtgcctcggcctcccaaagtgctgggattacaggcgtgagccaccacgaccagccagtttttccacttttgttttgccttttttttttttttctttcttgagacggaatcttgctttgtcacctgggctggagtgcagtggcatgaggtcagctcactgcaacctcagcctcccaggttcaagcaattctccttccccagcctcccaagtagctggaattacagtcatatgccaacacacctggataatttttgtattattagtagagatggggtttcgccaggttggccaggctggtctcgatctcctgacctcaagtgatccgctggcctcagcctctcaaattgctgggaatacaggtatgagccaccgcacctggcctgtttttcatttcttactgcaaaagatgaatttaaatgtaaagtcagcagtacagccatatcaagtaaataatgaaaactactggccaggcgtggtggctcacgcctgtaatcctagcactttgggaggccgaggcgggtggatcacagggtcaggagattgagatcatcctggctaacatagtgaaaccccgtctctactaaagatacaaaaaaaaaattagcctggcctggtggtgggcgcctgtagtcccagctacttgggaggctgaagcaggagaatggccagaacccgggaggcggagcttgccggtagagcttgcagtgagctgagattgcgctgctgcactgtagcctggtcaacagagtgagactccatctcaaaaaaaaaaaaaaggccgggcgcggtggctcaagcctgtaatcccagcactttgggaggccgaggcgggcagatcatgaggtcaggagatcgagaccatcctggctaacacggtgaaaccccatctctactaaaaatacaaaaaatttgccgggcatggtggtgggcgcctgaagtcccagttacatgggaggctgaggcaggagaatggcgtgaacccgggaggcggaggttgccgtgagccgagattgcgccactgcactccagcctgggtgacagagcgagactccatctcaaaacaaacaaacaaaaaaactactacttatgccgcaagtaacttgtcagtggtttgagtctcctttaataactttttctttgctccagtgcctatatatctgtgtttttttttccttttctgtctgcctgtctttttttttttttttttttttttgacatagtgtcgctctctcgtgcaggctggagtacagtgggccagtctgggctcactgcagccttgacctctcacgttccagtgatcctcccacctcagtcctatgcctgggactgcaggcatgcaccaccaggcctggccaatttttgtatttttttgtagagacagggtttcgccatgtctcctaggctggtcttgaactcctgagttgaagcgatccacccgcgttggcctcccaaagtgctgggattacaggcctgagcctttgcgctcggccttcctcagtgcatttatgttacgttttgattagttgatagtttgaaattcccctcccccctttacatgcattcttgagcctttcgtgttttatttacttatttttttgagtttattgatttatttggagatgagtcttgtcctgttgcccatgctggagtgcagtgacacaatctcagctcactgcaacctccacctcccgggttcaagggatgctcgtgcttcagcctcctgagtagctgggattacagccaccacgcctggctaattttttgtgtttttagtagagtcggggtttctccatgttggtcaggctggtctcgaactcctgacctcaggtgagtcacccgcctcagcctccaaaagtgctgggattacaggcgtaatcccaccacacccggactaatttttgtatttttagtggaggtggggtttcgccatgttggccaggccagtctgtaactcctgacctcaagtgattgttagcctcccgaagttctgggattacagacgtgagccactgcgcccagcctcttggaccatttaatcaatatgtatttctttagcatgtatggggaacaactttccccttgtgagtaataaaatcgttacttataatacctactatggaagagttacagtctaatcaggcaagctgtggctagaaaccagaatgatgatttctagcttgtataatacaggaattgtagagaaggggaacaagggattgtgtgctgcagttgtcggggaaaacttgaatagtaggtgagacattaattgggggataagatttggatgttgggagagtgaggttctttggatatgttaccaaaagcacagatatgggattaaatatatgagatgtaagaatggaaagtctgggttagaaaaaatggagctgtattctgcaaaaggctttattagacttagattctaaacgctgtgttctttatttagctctttcctacatcaggcacattaacacccccacccgtctggattccggttttgtttttttgttatttaatcttggaagtgaggcgaagaaaagaaattaaacatttaattgaattcatattatatgccagacaatttactctacaatctcattttaaactctcataactcagggctggatatcctccatgttatggatgaggaacaagctcctagagattatgtggcatacttgaggtcaaatagcatatgaataagcaggaatgaaaatctagtctgggctgggcgcggtggctcacgcactttggaaggctgaggcaggcagatcacctgaggtcacgagttcgagaccatcctggtcaacatcgtgaaacctcacctttactaaaaatacaaaatttagctgggcatggtagtgtgcgcctgtaatcccagctacttcggaggctgaggcaggagactcttgaacccgggaggcggaggttgcagtgagccgagatcgtgccagtgcactccagcctgggcgacagagtgaggctccgtctcaaaaaaaaaaaaaaaaaaaagtctagtcttctagtctgaaactctttgctgtaagtgtggtgtttgctgtgctgtggtgggactttcctgtgctgtttcccaaagtgtgtgtcatttttgtctaataaaagtgcacgtggtatgtgggtactacaataatagtcaaagttagtagactagaatagggcctcttcagaaaagcttctgagtacttccattattttctgtttacagcattctggttctttcaccgtactgaacacaaagtataatttacatgtcaaccaactaatcctgttcattttacacaattttaaatctttgcttaaattaaaacaagttccaggagtgtttcctaaatcttgtccaactgtttacctcaagtactccttccttcataactcatcgtaacacgctccagggtacatcccagccttttgctcatcttaattgagtagaactagtgatcactattcttgcattttgtttttctaagaaaatatgatttaagactcctcaagctacagatttgacattttgttacattcttagattctttccatgttatttactattagaattagtgtagttgatagtttttttcgtcattcgaattagaagttttgcatgtatgaaatcttcttttgaggcagagtcttgctttctttgcccaggctggagtgcagtggcgtgatcacagctcattgcagccttgacttcctgggctcagttgatccacccacctcagcctccagagtagctgggactataggtgtgtgccaccacgcccggctaattttttatattttagtagagatggagttttgccgtgctccccagactgggcttagactcctcagctcaagcagcctgcccgcttcatcctcccaaagtgttgggattacaggcgtgaggccatgtaaaatctgaagtgtgtcttaacatcccatagggctcttaggtgatttggaagtacactgacatgagtatagtcaaccttaaagtgatgacatcgcaaactttaagcaggcttcaagcagctgaattaattatgataaaattaaaattgccaaatttgggcagagatttaatgtttaaaaaccagtataattcaggttagccatctgagaatgttttgtaactttcttggggatcatactgaatttctttttttttttttttgagacagagttttgctcttgtcgccaggctggaatgcaatggcatgacctttgctcattgcaacttccttcgcctcccaggttcaagcgattctcctgcctcagcctcccgagtagctgggatcacaggtgtgtgccaccatgcccaactaatttttggtatttttagtagagacgggatttcaccatgttggccaaggccggtcctgaactcctaacctcaggtgatccacccgccttggcctctcaaagtgctgggattacaggcgtgagccgccgtgcctggcctgtactgaatttcttttatagtaaacgagtagtattgctcctgaaatggtctgagtcaggctttttagacatgctttttagtacagaactgatgcttcccagattatttgtcagtgtgatagagaaggtgcgtgataatcgttttagaaaaaattttgctccatctttatatttctgaatagtaacaagagagttgtcatgtgactagcaagatattgggaccttttagaaatcagtaaggcagaatgttgattgtcatgaattatctgtgaattgactatgtttagtgattgtcaagcttttgcctaattttattcattccttggaggttgtccaagctgaatcagattatttgaaagccacacaattcctgagcattctcatatgtcagccttctgcagaaatgtcctcagttatttcatggggtcagaagtatccaattgaagactgcttctcacatgtaaatctaggcatacattttctgtgatgactcctttttaagaaaatatccgcaaggtaaatttcttagtaagtagcaccttgtaagtttctctccaacaaacttgcatactatcccctccaaaccataaaaacaatttgagacttttattttgagacggagtctcacctctgttgcccaggctggagtgcagtgacgcgatcttggctcactgcaacctccgcctctcgggttcaagcaattctcctgcctcagcctcccgagtagctgggattacaggcacccgccaccatgcccagctaatttttgtatttttagtagagacggggtttcaccatgttggccaggctggtctcgaactcctgacctcaggtgatccacctgcctcggcctcccaaagtgctgggattacaggcatgagccactgcttccagccaggaagtctttacatagtaagacatttgagtttgatccagagggatgatgtttcctaggaaaaaggaaaggtcattggctaattgattagcctttatataaagcaagctcaggacctttccagaacctaagtgactgaactctttctttttgagagacagagtcttgctctgttgcccagggtggagtgcagtggcatgatcatagctcactgtggcctcggactcctgggctcaagcgatcttcctgtctcagcttctggagtagctgggactgactacaggtgtgagccacatttccggttctgacagaacctttttatgtcagtgcctgatgctgtgcccttttcttcccttggtgtgattgcttttactgttcttgggctaaggaatttgtttctgtgagcactctggttgcaaagtcattgaagtgtgatggctaaaagctcagactcttaagttagattgtctgggtttgagtttgggttttaccattgtgtgactttaggaacattactcttagcttcatttttctgcccttaaaatcaggattagggccgggtgtggtaacccctgcctgtaatcccaccacctagggaggccgaggcaggtggatcacctgaggtcaggagttcgaaaccagtctggccaacatggtgaaaccctgtctttactaaaaatataaaaattagccgtgcacgttggcgggcacctgtagtcctaactaccagggaggctggggcaagagcatcacttgaacatgggagatggaggttgcagtgagattgcacttcagcctgggcaacagagctagactctgtctcaaaaaaaaaaaaaaaagttagggttatgaccctgtgtgctttggtaagaggaacattaatcctgtcagccagtacagaacctgctcgtttttcccatggcagattctgaacagtttgcttttttcctgaccctgaatttcattaggagctgtaaattgtgccttgtgacttgtcagcctgatagttggagacctgctccttttatgattttgtactttgtgtttatcagaaactgttgaagctcagcagagacttgttttactacctggcaaggacagtcttgggaaaatcaggtttactgggatgttgatgtaaagatattagaggtatgaaactaagctttttgtattcaggaggctgaggtgggaggattgcttgagcccaggagttggagaccagcctgggcaacatacaaagactcccgtctctttaagagaaaagaataaagtaagctttttttgggagaggggtgaacctctaggtggaaaaagaaatgcgttttaagcaggagtgaacttctttccttcttttcttttctttctttctctctctttctttttctttctttctgtctgtctgtctgtctttcttgtctttctgtctgtctttctgtcttcgttctttctctcatggtggcagacgccaccatgcctgggtctcaaccacattttagtatgtgaaacttgtttctctggtagagtcactgaaaccagttatttcccctctattgtcacagaagcaaacaaaaggatcctcgtacagatgcattcaaataaatattcaaatctgaggcaatatgattaaatcaaagcacaactcaagtcagattccctgagttgtagtccactggctttgtgatctggaacaagtttaaccttcgtgttcttcagtatatggagatattctaaaatgggataatactggtacccacttcagaggtctgttgagaagattaagcacattaatacagcgaagcatttggaacagtgcctattttagcatggggggttttatttgtgaataagtctgttgaatgaacaacatagttgaaatggggtgttttatttatgaattagtctgttgaatgaacaacatagttgaaagaacacaaccacaaaccaaacctcagttaacaagtcaaggggaaaaacttgtgactctactggcagcagcagatgatgggtgtcccagacacaagctggttccatgtggtggatctgtgtctaggctattaccatacaatgaagggaaacttacttggaactaaagagacttaactatgtttaattaacttgtgaggagtatgtttttcagagtggcgattttaatcacccacccttgtccccaaaccatgaaaagtcccagaaattcgattttgttactcaaaattactgtagcaaaactgcccgtggatccaaaagaagtgatttcaaccatttcagttttttggttcttaaattgcgatcccacctgctgcaaacacatgacagccttcccccacccgtgaaatgcccacatcccactgataaaatacttgccgcaaaggtgatttcaggaaatgctagttgtgttgagggcctttatgtgaatataatggttggagttcatcctctactgagggagggctgaagggtgtagttagtctagagttttggataaatcagcttttcttatatagttttggggtacattatcattagtattatgtttctgttgctggtgttaaaaggataaagatgacagtgatattggaagagagtgtcattgtagtcgttatttgtacaaactggtacaaagcactggtcgtagaatgtttggagagattgagaagttgactttccatactcttgaaggagtgatgtgcttggtagtgtgcacctatagtcccagttacttgggaggctgaggtgggaggatcactcgaggccaggagtttaaggctacatagtgcgctgtgatcatgggcctgtgaatagccactgcacgacatacagtcagggcaacgtagtgagaccctgtctcttgaagcaatagaagtgtctcctgactcaatgctacttctgttccttaatctgctaccttaagggatgcagagggggttgggggaattaagaggagtcagtggggttttaaaaatgaacaactcctacataccaataatgaaaagacaaataattaaatatttggcaaagtgtttgaatagatatttctccagagaacatacgcaaaaggctcataagcacatgaaaaggtgttcaacactattagttatcaaggaaatgcaaatcaaaaccacaaagagatacagcttcacacccactaggatgactagtttaaagaataactaacaagtgttcctgaggacgtggccagattagaatcctgtgttgctggtgggagtgtaaaaacggtgccgctcctgtagaaaagtttgggatgtccttcctcaaaaagctagttaccatgtgatcctgaagttccttctaggtgtatactgaagtgaactgaaagcatttattcatacaaaaacttaaagaacgttcgtagcagcattgtttataatagtccaaaaatggaaacaacccaaatgttcattaactaacgaatggatttttttttttttttcctgagaccaagtctcgctctgttgccaggctggagttcagtggcacgatctcgggtcactgcaacctccgcctcccgtgttcaagcagttgtcctgcttcagcctcccgagtagctgggattacagacattcgcctagacatcatggcagcctaatttttgtatttttagtagagacggggttttgccatgttttggccaggctggtctgaactcctgacctcaggtaatccacctgcctcccagagtgctgggattgtaggcgtgagccaccgcacctggcctaatgaatggatttttaaagcatagtatatccatacagtaggtgaagtactgatgcatgctacactaggcatgaaacttgagaccatgctatgggaaagaagccagtcacagccgactccatacggtaggttgtgttgggaaagaagccagtcatgggaggctccatactgtatggctctgttcgtaggtacaccctgtttgattgtgcttcacagatactacatttttacagaacaaatggaaggtttctggaacccgctttgagcaagtctgttggtgccattttccaacagcaggtgctcacttcttgtctctgttcacattttggtaccttgtgcagtatttcaaacttttcttttttttttttgagatgaagtctcactctgtcacccaggctggagtgcagtgccacgatctctactcactacaagctccgcctcccgggttcacgcaattctcctgcctcagcctcccgagtagctgggactacaggcgcccgccaccatgcctggctaattttttattgtatatttagtagagacggggtttcaccgtgttagccaggatggtctccatctcctgaccttgtgatctacccttcttggcctcccaaagcgctgggattacaggcgtgagtccacctcgcccggcctcaaacttttcattacatgttaatggtggttatctgtgatcagtaatctttgacgttactattgtaattgttttggggatccgtgaactgagggaaattaattgatagatgtgtgtattcctttttttgcttgttttttgagactgagtttcgctcttgttgcttaggttggagtgtaagggcgccatcttggctcaccgcaagttccgcctcctgagttcaagcgattctcctgcctcagcgtcccgagtagctgggattacaggcacgcgcccccatgcctggctaatttttttgtatttttagtagagacagggtttctccatgttggtcaggtggtctcgaactcccgacctcatgtgatctgcccgccttggcctcccaaagtgctgggattactgcgtgagccaccatgcctggcctgtgttcttttactattaatttttggagacagggtctcactctgtcacccaggcaggaatgctcactgcagccttgacctcccaggctccagcaatcctcctgcctcggcctcctgagaagctgggacgacaggcacacatcaccatgcctggctagtttttgtattttttgtagagatagggtctcacctgttgcccaggctggtcttgaactcctaggctcacatgatcttcctgccttcggcctcccaaagtattgggattacaggcgtgagctcttgtttgtgttctgactccctgtctctctccctcccgttaggcttacctattacctgaaacataacaatatttaaattaggccgattaacaaccctgcaattgcttctaagtgtttaagagaaaggaagagtcccagtctctcactttaaataaaaaggtagaaatgatgaagctgagtcaggaaggctaccttaaaagccgagacacggtctgaaagctgggcctcttgcaccacagttgtgaatgcaaaggaaaagttcttcaaggagattaaaaagtgctagtccagtgaacacagcaatgatgagaaagcaaaacagccttcttgctgacagaaagttttggtggtctgaatagaagatcaaacctgccatactattcccttaagccaaagcctaattcagaccaaccctctaactctcttcaaatttaagaaagctgagagaggtgagaaagctacagatagaaagctggaacctagcagaggttggttagtaaggtttaaggaaagatgccatctccattacttaaaaagtacaaggtcggctgagcgcggtggctcacgcctgtaatcccagcgctttggggggccgaggcggacggatcacgaggtcaggagtttgagaccagcctggccaacatggtgaaaccctgcctgtactaaaaatacaaaaaattagctgggcgtggtggcagacgcctgtaatcccagctactcgggaagttgaggcaggagaatcgcttcagcccaggagacggaggttgcagtgagctgagacgttgtgacagcactccagcctgagcgacaaagtgaaattctgtctcaaaaaaaaaaaaaaaaagtacagggtcaagtagcatgtgctgatgtagatgctgcagcaaattatccagatttagctaacattattgatggtgaccacaccacttagattttcagcgtagacaaaacagccttgtgttagaagaaaatgctgtctaggacttcacttaactagagagaagtcagtgtgtctagctccataggacaggctgatgcagcttcttagggactaatgcagctggtgaatttaaattgaaaccagtgctcattgactgtttgaaaaatttgaggcctctttaagaatcatgctaaatttactctgcctggtttataaatggaacagcaaagcctgtaagacagcacttatgtttacagcatggttttctgaatatcttaagcccactgttgaagcttggtactcagaaaaaaaaaaaattcccttcaatgtattactgcacattgaaaatgcaccgaggttgggtgcagtggtgcacatttgtaatttcagcactttgggaggccgagatgggtgggtcacatgagcacaagagttcaagaccagcctgaggaacatggcaaaaccctgtctttacaaaaaaataataaaaattagctgggcgtaatggcgtacacctgtagtcccagctactcaggaggctgaggttggaggatcgcttgagctggggaggttgaggctgtagtgaactgagatggtgccactgtatcatcttgggtgacagagtgtgactctgtttcaaaacacacacacactaccacacactcacacacagtacttggtcaccctggagctctgatgtagttgtgtaaggagagcaatgttttttgattttttattttttgagaaggagtctcgctgtgtcgcccaggctggagtgcagtggcactatctcagctcactgcagctccgcctcccgggttcacaccattctcctgcctcagcctcctgagtagctgggactacaggcgcccgccaccatgcccggctgatttttttttgcacttttagtagagacgaggttttcaccttgttagccaggatggtctccatctcctgacctcgtgatctgcccacctcggcctcccaaagtgctgggattactaggcgtgagccaccgctcccagcctgcaatgttgtttttatgcctgttaacacagcaggtaggcagatcacctgaggtcaggagtttaagaccagcctcaccaacatgctgaaaccccgtctctactaaaaatagaaaagttagccgggcgtggtggcgcccacttgtagtctcagctacttgggaggctgaggcaggagaattgcttgaaccctggaggcagaggctgcagtgagccgagattgtgccactgcctgggctacagagcaagacactgtctcaaaaacaaaaaacaaaaagttgttctggccagtcgcggtggctcacgcctgtaatcccagcactttgggaggccaaggcgggcggatcacaaggtcaggagatcgagaccgtcctggctaacatggtgaaaccccgcctctactaaaaatacacacaaaaaaattcactgggcatggtgacgggcgcctgtggtcccagctactcgggaggctgaggcaggagaatggcgtgaacctgggaggcggagcttgcagtgagccgagatcacgcccaggcactccagcctggtgacagagcgagactccgtctcaaaaaaaaaaaaaaaaaaaaaaaaaagtttttctgtgggtaaatgctgtccaacagcgtcagatgctacagagaaatcatgcaggaaaggaaaagcccatcaacatggcagacttcattgtcttgccacggccactccagccttcagcagccatcaccctaagcagtcagtagccatcaacatcaaggcaaaaaccttccaacagcaaaatattatcacttgctgaaggctcagatgagcattagcatttattagcaataaggtgtttttaaattatgtacagtttagacataatgctgttgtacacttaatagattacagtgtagtttaaacataacttttctatgcactgggaaacacaaaaattcatgtgacttgctttattgcaatatttttttttgcagtgctctggaactgaacccgcagtatcttccaaggtatgcccgcacctgaaatgtgcataagagacaagtgtgtagaggcggaaaatagattggtggttgaccgggctggggttcgggtacatgggaattgatggttaatgggtttggggcttttctttttgaagtgatgaaaatctaaaattatgatgattgcagaattctgtgaatatactaaaaaccattgaatggtacagtttatttattttttggagacggagtctctctctgttacccaggctgtagtgcagtggagccatctcgggtcactgcaacctccgcctcccgggttcaagcaaatctcttgcttcagcctcctggttagctgggactacaggcgcctgccaccatgcccagctaatttttgtatttttagtagagacggggttttactatgttggccaggctgttcttgatctcctgacctcatgatccacccacctcggcctcccaaggtttacaggggtgagcccctgctcccggccgaatagtacactttaaatgggtgaattgttaggtaggggaattatatataaataaaggtattattaaagggataattgttgcttctataattttaccacacagtctgtgcattgttttgtgtatatgtaaaaatgaaagcatttatgcttgaatctggaacagtagagtatcactgagtgttacaaatatatttctctttgcattataaaaatactaagtcttcgttgttgaaaatttgtaaagcacagaaatttgaacaaaattaaatcataaggaatgatattcgagatatgtaacttaaatttttggtagtatttgatgtctgcatagtttttctgtatgtaatattgtaaagccttaaaagaattaatggcactgtttttgtgtagctgggttacttaagatttactttgcgatcagtttagaaagtttaattacaggcttacctctgagttatgtttgacttgctgatttttgagaattaaactagtatggaggtacgattacctattccactgcttctaaatttagactgtttcgtgactggtttagaaaacaaaattgggcatgttttagatgaatgctttcagactcctacaaatgaattaatgagtggtcttattaccatattgtaatacttttttttttttttttttgagacagagtctcactctgtcgcctaggctggagtgcaatggcgcgatctcagctcagtgcaacccctgtctccggggttcaagcgattcccctgcctcagcctcccgagtagctggcactatagatgcctgccaccatgcctggctaatttttgtatttttctttttctttttttttcctttttttgagatggagtttcgctcttgttgcccagactggagtacagtggcgcgatctccactcagtgcaacctccgcctcccgagttcaagcaattctctcgcctcagcctcgagtagctgggattacaggcatgtgccaccacgtctggcaaatttttttgtatttttagtttctccatgctggtcaggctggtctcgatctcccgacctcaggtgatctgcctgcctcggcctcccaaagtgttgggattacaggcgtgagtcaccgtgcctggcctaatttttatatttttagtagagacggggtgtcaccatgttggccaggctggtcttgaactcctgacctcaggtgatccacctgcctcagcctcccaaagtgctaagatgacaggtgtgagccacagcacccaacatgtcatccttctttaatggttcagaattgcatttaaaaaatcagcttgaggtgtacagttaaacgtgccacttttacatgtacaattctgtgacctgtcctttgcacaaaagcccctcagttcacctctgtaccttgataaccatttgctttctgtctttttagtttgtgttttttgcaatttgatataaatggaatgataaaatccttttaatctgactcttttcacttaatatgatgtttttcagattcttccatattgttgcttgtatcagttaattatttttctcccctcccgtctcctcttctctttctggacacagagtctctcgctttgtcatccaagctggagtacagcgttaggattatacaaagtaattgtggtttttgctggcaaaatgcgcaattacttttgtaccaacctaatagctcactgcaggcctgaattcctggggtcaagcagttctcttgccttaatctcctgagtagttgagaccgcaggcacacaccaccacacccagctaatttttgtagaggcagagtctcaccatgttgcccaggttggtctcaaactactgggctcaagtaatcctcctgtcttggcctccccaaatgctgggattacagatgtgagccactgtgcatggacagttaattctttatttttgagtggtatcccatcttacatatgtgaacatcagtgtgcttatacatttcccctctggatgcacatttgaggggtttccactttttggctattatgaatagagttgctgtgagtgagtgtgtaaaagtctttgtaaagattatttttcttctggatgatgcatagaattgggattgctgagtcatatggtacatgtttattaaaacattgccgaatatttttcgaagagactttacaaaatatggcttaattttttttatattcccgaaaggattaatttttgaaacatattttcctggatacattaggcacactccccttaatttaatagtgttttggtttttgttttgtgtttttttttgaaacggagtctcactctgtcacccaggctggaatgcagtggtgcaatctcagctcactgcaacctctgcctcccaggttcaagcagttctcctgcctcagccttcctggtagctgggattacaagcgtgcaccaccatgcccagctaatttttgtatttttagtagagacgggtttcaccatgttggccaggctggtctcgaactcctgacctcaggcgatccacccaccttggcctcccaaagtgctgagattacaggtgtgatccaccgtgcccgtccaatttagtagtgttttatgaagtcaccatctctttcatacctattagttaaggtatgcttatgcttagggtgttaatgaaagctaaggatgcttatttaaatgcagattctttcttttggttttttttgagatggagtctgctctgttgccccaggtggcatacagtggggcgatctcagttgcaatctctgcctcctgggttcaagcaattctgctgcctcagcttcccaagtagctgtaattacaggcgcgcaccaccaaacgcagctaatttttgtatttttagtagagaccgtttcaccacgttggccaggctggccttgaattcgtgacctcaaatgatctgcccaccttggcctcccacagttctgggattatatgcatgagccactacatccagcctatttttatttttatttttattttatttattctatttttttttttttgaggtggagtctctgttgctgggctggagtgcagcggcatgatcttggctcactgcaatctccaccttctgggttcaagcgattctcctgtctcagtctctagagtacctgggactacaggcgtgcatcaccacgcccagctaatttttgtatttttagtagagacagtgtttcaccatgttggccaggatagtctttatctcttgacctggtgatgtgccacctcggcctgccaaagtgctgggatttacaggcatgagccactgtgcccagcctctgtttttattttttagagacagggtctcgaactcctgagctcgagtgattctcctgcctcagctctcaaagtgctaggggtatgagccacttactcctggccctaaaatgcagattcttgagtctcatcaccaaagattgaaacgtgggtaatgttggagagccacatggtaatatggcatcaaaaataagtttttattaatgtatttattcagttactatttcttgtgctgtttgtggcgctttgcattcacacgccgttgtgtttccctatgcttgcggtagatgccaaggcttttctgggcccctttctttgctcgccacctagtggtaacaagtaggaatcatcagaagttttaccaatgaaggagcttcatacgaggaaggatagaaaacatccaaagtctgttggtggccaaccatatactccgtatatttttgctgtatgaacaaattccccttccttttgtatttttggaaatactatttatttgtgagacaatacattttagaacctgtaaattcttaatctttctcttaaactgacagctcatttttttttgctggaaaatagttaggtgtgcctaattaccttatttaatgagaggtgctttcagaccacactaaattatattagatagtatatgaagtctttctcactccacctaactaccttctggagtctttgtattggctcttagtttggtttcctttacatgtttttggctttttactcatattagttttgatgattatgaaattatttttgttaaaatgtttttttcgcagtagcttgacagaaaaaaactactttgaaaggaatatgttaagaaaacttcaaatttgtaaggtctgacttttccttttcccatacagaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggtgagattgttgtgccatcatccccccttatccacagtttgagttacctgtaggacggtacacttaagattttgagagaaaaggagactacattcatataacttgtattacagtatgttataatgtttctgatattgatctttgtgcctggtttataagttaaacttacccgtggctatgcatgaggacaaaacatagtctgtatcaggtttggtattttccatggtttcatcacatccactggcaggtctcaatggatccctcttggataagggggaactattgtattttcaagcaaaatgatgactgttttttaaaaaaatatggtgggttggccaggcgcggtggctcaggcctgtaatcccagcactttgggaggctgaggtgggcggatcacgaggtcaggagatcgagaccatcctggctaacatggtgaaaccccgtctctactaaaaatacaaaacattagctgggcgtggtggcgggagcctgtggtcccagctactcgggaggctgaggcaggagaatggtgtgaatccgggaggcggagcttgcggtgagccgagatcgcactgctgcactccagcctgggtgacagagcgcgagactccatctaaaaaaaaaaaaaagcacccaaaaaccaatatattgggttaatttgtctgattcctctttttttttccctgaggattatttaatgaagttattttacttactgtgggtgtatatacatatataaaatgtttcttattgtaggtcttgttaaaaaaaagttggacagccatcactgtaatgcagcagttttcaattagaggtgcttttgtacttcagagaacgtttaacaatgtctagaaatacttttgattgtcacaacttctggagggtgttcctagcatctagtggggtggggactggggtgctgctaaccattctactgggcacagcacgggccccacaacaaactgtcgggagtgctgctgttgagtaaccgattctagtagaagagacaggcacgtaaatacaggaaagaacagggaagagaattacagggcaggtggaaagtgaggttggttgggggagggaagggtgggggaaccacagttactgactcgccagctgtactgggcactgtcctgagtagagaaatatttttgttacatgtatttgtgcaaggtagtacatgaaatctttaaaatggcactggaagggggaggtattatcccaactatgaatgcacaaaccagggttttgggtgtttgacatacctgaggtcacatagaaagttgtgagctggggccttccgtggtggctcatgcctgtaatcccagcactttgggaggccaaggcgggcaggtacctgaggtgaggagttcgagagcagcctgaccgacatggtgaaaccccgtctccactaaaaatacaaaaattagccaggcatggtggcgggcacctgtaatcccagctactcgggaggctgagacaggagaatcgcttgaacccaggaggtggaggttgcaatgagccaacgtcgagccactgcactccatccagccttggcaacaagagggaaactctgaatcaaagaaagaaaaagtaaaaaataaagagtccagatgtcctgatgagtccctaaatagaaataataagagaagaggaactgaaaaaggaagccacgggccaagagtggagtgttgcaattcagacttctagtatggagcagcatggtcatgggtgtggacaagtgaaagtctaggagtagagagcaaagaactctgttgaatggaacatggctgcaccataccttggtgtgatctcaggtattgggtgggtttgctgtagatactcagtgaatctgggagaagggtgtagagatctattgatgacaaaaactgagaaatagaatgtagatcatcagcttgtgaggaggaagagtttggagtaatagagcagtcattgagtatgcaaggagctaggagaacttagaagtcttccttctcctagaccagtctctattggaaaagctgtcagggatgtcgtttattcagaaagtagttttgcttgggataaggatgtgattatagaagaaaaagagagaattttctgcagtgaaacggaggttccaggggcacggagaggaccctcatgaaaggttcagcagtagtgctgcatgagttaatagcaaacaggaagcaagctgaggatgtgcgttgagaggtggtgtgcgtgttcagcatgatcagtggatagagatgggtggcagtagctactttggtagataggttttcggtgttttaatagttacggatctctgccactaaaggaattgcctggtgaatgttgttaaggatgtgagtgctgaaggcaaactgcctgggtttaaattttgattctgtcccttgcagcctgcctgggttcaaatcctagctctgcttattaaattcttatttaattgttgatcttagagcaatgtctttacgttgctaccttgtgaaagaaggtaattcatgtaattgaccagcatttaccaagaagcatcagtgttcagttttagtcattggtaattctgtagctgtactgtggtactgtgaagggggtgtgggggctggcgtgtgtgcgtgcctgcatgtgtgtgtgtaacaataggcagcatgcagaagggaaaagatactttttataacctagaggcagcttttctctgcttttgtgtcaagaaggaagaagggagtttggagagggatacaaattctttttaatactaagctctctacctcaaaaccagagatagaatatgtaataatttgtagaatttctagacttaatctgatttaaaaaaaatttttttttttttaggttgagactgagctaaagttaatctgttgtgacattctggatgtactggacaaacacctcattccagcagctaacactggcgagtccaaggttttctattataaaatgtaggttctatactagaagggaaaatgtaagattgaaagttggtccttttagaaccataactttgttctatgtaggttttcaacttttatttaagaataattgttcaatgttagaaggatagttaatattgtaatgaaaaggtggttgggctattatgaaaatgtattagcttttgcttatttatattcttttgtttttgtgagacctatcccattcccctcccccaaacggcatacatttcacagtgcttagtgttatatatagacattttattttatgattaataaactgtcatgccattccttggaaccacttgcttgtttaattctggtctatcaggtgataattttattaatttttagaggctcctcagttaatttcctgggatttttgcttatatttagtaatatgaaatgtctaaggaaaaaaatgaaacgaagccagttattcctgagagtgtttaaaattattgaagtacacctaattgttacatatatttttgtcacattttatataatatagaacaattttagcttattttcctttaaaaatcgttcctagtttaaattttttttttttttttaattttggttttgttttaggaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggtaagttgtggggaagaacagcagcgctcagcgtgaaagttaaggggggcgctgtttgggttttccgtgttgtttcttgggcctgtctttgtagacttggctgcatagtaattcttttggctcttactgaaactactttggatagtattaaaacagacctgtctcaacccactagcatagcagtcagcataattattttgatgtgggatatttttgttgctggtagattgaaatctaacatgttaaaatgagtagaggaaggaaatgagaggaattagaattattttaatttttgttatattagttttcagtctttttttaaatttgagaccatgtctcactctgtctcccaggctagagtgcagtggcgccatctcagatcactgcagccttcacctcctgggttcaagtgattctcctgtctcagcctcctgagtaactggagttacaggggcctgccaccatgcccaactaattttttttgtatttttagtagagacggtgttttcaccattttggctaggctggtctggaactcctgacctcaagtgatccgcccgccttcgcctcccaaagtgctgagattacaagcatgagtcaccacacccagccagtgttctgtttctatgggcatgtttttaatagttactctcgtagcaaacataattttatattttctgttttagcataaacaagtttcagtcttactaatgtgtgttaaactgttcccccatttatacttcagcttgttcccagtttttgataatgtagataaatatgtaaggaatatttatacgtacataactttttacttttaaaaagttgtgatagcctgggtgcagtggctcacgcctgtaatcccagcactttgggaggctgaggtgggtgggtcacctgagatcaggagttcgataccaacctgaccaacatggtgaaactctgtctctattaaaaatacaaaattagccgggtgtggtggtgcatgcctgcaatcccagttactcgggaggctgagacaggagaattgtttgaacccaggaggcagaggttgcggtgagcctcgattgcaccagtacactgtagcctgggtgacacagtgagactttttttcaaatctctctctctctctctccccctctctccccccctccccctcctccccccctccccctccccgtctccctctctctccccgtctccctctccctctcgcctgggcgacaaagcgagacttttacacacacacacacacacacacacacacacacacacacacacaacaatttagtggcaccgaatacattgacagtgttgtgtaatcaccactatttgaaaactttctcttcaccccacacaaagcgaattatagccattaaacaatcaataacttcatttcccctctccctagctgctagtaacttttattttacgttgtcactatgaatttggcccattctagatacctcatgtaagtgggatcatataatatttgtccttttgtggctgtctttatttcatctagcgtaatgtttttatccatgtaaaagcatggatcagagcttcagtccttttagtgactgaatttacacaattcattttatgtattttgcacacattgtttagtcattaaacttttggtggtcagtgggtttccaccttttccctatggtgagtacaatgctgctatgaaaatgggtgcactaagtatttgcttgagtccttgtatttaacttcaccttgaggtggaattgggactgaaaattctgtgggtaacttttttttccggacaggatcttgttctgtctctgcagttgtgcactcatagctcactgcagccttggcttcctgggctcagccgattcgcctacctgagccttccaagtagctgtcactagaggtggatgccaccatacctggccttttcttttccttttttttttcttttttcttttttttgagggagagcctggcactgtcacccaggctggagtgcagtggcgtgatcttggcccactgcaacctctgccttccaggttcaagcgattctcctgcctcagcatccaaagtagctgggattataggcgcctgccaccatgcctggctaattttttgtatttttagtagggatggggtttcacagtgttggccaggctagtctcgaactcctgacctcgtgtgatctgcccgcctcggcctcccaaagttctgggattacaggtgtgagccactgtgcttggccagcccttttttttttttttttttaagatggagtctcgctctgctggccaggctggagtacagtggtgcgatcgcagctcactgcaacctccacctcccagattcaagcgattctggtgcttcagcctctcaagtagctgggattacaggcatgtgccaccatgcttggctaatttttgggggcatttttagtagagacgaggtttcactatcttggttaggctggtctcaaactcctgacctcagcctccctcccaaagtgctgggattacaggcatgagccactgcgcccggccaatttttaaattttttttgggctgcgtgcagtggctcacgcctgtaatcccagcactttgggaggccgaggagggcagatcacgaggtcaggagatcgagaccatcgtggctaacgtggtgaaaccccgtctctactaaaaatacaaaaaatcagccgggcgtggtggcgggcgcctgtagtcccagctactcgggaggctgaggcaggagaatggcgtgaacctgggaggcggaacttgcagtgagccaagatcacgccactgcactccagcctgggcgacagagcgagactccgtctcaaaaaaaaaatttttttttgttgttttgttttgtagaggcagggtctggctgtgttgccgaagctggtcttgaaatcctggcctcaagtaatcctcttgccttagcctcccaaaatgctgagaatacaggcctgagccactgcaccaggcccttttgcccatttttgaattcatgtttttttcgtttgttaagtgttgagagttcattattccagatagtaacctcttagcaagtaaatggtttgtgagtattttctcctcttctgtaggttggcattttgttgttgttgttgttttttgctattgtctttttctttttttttttcccccgagaggagagtctcgctgtgtttcccaggctggagtgcagtggtgcaatctcagctcactgcaacctctgcctcccggtttcaagcgattctcctgcttcagcctcccaggtagctgggattacagacgcccgccaccatacccagctaatttttgtatttttatgtagagatgggttttcacagtgttggccaggctggtcttggacacctcaccttaagtgatccagccacctcggcctcccaaagtgccgagattacaggcgtgagccactgcacccagcctattttaaatttttacagtaaatattgcagtagcaaaatggtttttttgctttttttttttattttgacggagtctcactctgctgctgtggctggagtacagtggcgtgatctcagctcactgaaagctcagcctcctgggttcaggcgattctctcgcctcagcctcccaagtagctggtactacaggcacccgccaccacgcccggttaattttttgtatttttttttttttttttttgagacggagtctcgctatgtcccccaggctggagtgcagtagcgcgatctcggctcactgcaagctctgcctcccgggttcacgccattctcctgcctcagcctcccgagtagctgggactacaggcgcccgccaccacgcccggctaatttttggtatttttagtagagatggggtttcaccgtgttagccaggatggtctcgatctcctgacctcgtgatccacccgcctcggcctcccaaagtgctgggattacaggtgtgagccaccgcgcccggcctattttttgtatttttaatagagatggggtttccctgtgttagccaggatggtctcgatctcctgacctcgtgatctgccctcctcggcctcccaaagtgctgggattacaggcgtgagccaccgcgcccggccccttttggtttttgtatgtgtttttttttggtttgtttgaggacaactgcttaagcaaagtagggtttttaagtgaaagcctttcaaagtttgaggaaaggggattaactgatacattggaactttaatgttgactattataggcatgcttcactgcgcttgactgaatttttttttttttttgcatttttagtagagacaggttttcaccatcttggtcaggctggtctcgaactcctgacctcaggtgatccacctgcctcagcctcccagagtgctgggattacaggcgtgagccactgcgcccagccaatgtaaaaacattctaaatggctagttgagtttgtccagatagggatcgtaactgaagaagctgtggctatttagctaatactggtggttgcacctttccttgtcagactccagtctagctgtcccacgtgtagctccagtttaaagtcactcgcatgcctttgctcatgcttctgcttaaacctgaagtgtgttttgttttctccttatccattgagattagttcaaatttgactttccctttaattgctcctccttctgggtccctgaaatactttatttggaatagcacttcattcttcttcttcttttgtttttgtgctctcttgcccaggctggagtgcattggcacagtttcacctcactgcaacctccgcctcccaggttcaagggattcttctgcctcagcctcctgagtagctgggattacaggcatacgccaccatgcccggctaattttgtgtgtgtgtgtgtgtgtgtgtgtgtgtgtgtgtgtgtgtgtgtttttagacggagtcttgctctgttgcccaggctggactgcagtggcgtgatctcggctcactgcaggctccgcctcctgggttcacaccattctcctgcctcatcctcccaagtagctgggactacaggcacctgccactgctcccggctaatttttttgtatttttagtagagacggggtttcactgtgttagccaggatggtctcgatctcctaaccacgtgatccgcccgcttctgcctcccaaagtgctgggattacaggcttgagccactgcacccggcctaattttttgtgtttttaataggttttgccatggtggcccggctggtcttgaactcctggcctcaagtgatctgcgcgcacgcatcagccacccaaagtgtgctgattacaggcatgagccaccacagccagcctcctccttgtaaaatagttatgtatttgtctaccctccatttctaaatttttaagttgatgtggacttagattatgtctcttttttttctattggtatatcgtatcgtttgttggacatagtacacagtactcagtaagtgtggattttcttttaaaactgtaaatggcttacataatcacatttccatggcgtctgtgttgccttttattttctttgcttccctgcctccattaacgtgaaattaaatttttttaaactttgaggtattgtccaagattttctttttgcattaatactttgttaaatatctcaaccttgtaatccagcactttgggaggctgaggcgggcacatcacgaggtcagaagatcaagaccatcctggctaacacggtgaaaccctgcctctgctaaaaatataaaaacaaatcagccgggtgtggtggcgggcgcctgtagtcccggctactcgggaggctgaggcaggataatggtgtgaacccaggaggcggagcttgcatttagcctacatcccgccactgcactccagcctgggtgatagagcgagaccccgtcccccaaaaaaaaaaaaaaaaaaaaaaaattttttttttttttttttttttttttttttttaaaaaatcttgggggtggtagtgtgtaccgtttgtcccagccactcaagaggctaaggttcggaagattgcttgaacgcaggagttcaagtccagcctgggcaacataacgaatcccttaaaaaaaaaaaaaaaaaaaaaaaaaaaaaaaaactaggctgggcgcggtggctcacgcctgtaatcccagcactttgggatgctgaggctggtggatcacgaggtcaggagatcgagaccatcctggctaacacggtgaaaccccatctctactaaaaatacaaaaaattagccgggtgtggtggcgggcgcctgtagtcccagccattcgggaggctgaggcaggagaatggcatgaacctgagaggcgaagcttgcagtgagccgagatcacgccactgcactccagcctgggcgacagagccagactccgtcttaaaaacaaacaaacaaaactttttgaaataagtgaactattgcctagaacttggaggtatattttttggtgatggtttaggatggaagttgttctatgtattttattagtcgatatgtatattatagcatatcagtagcaggcttaaagcatagtaagaagtagtgttccacatacctttaagttaatttttattgtatttgctttttctttgcattatcattgtgactattacaaactggaataactgaagaaaagattgctgtctagcatgtcatttctaattctgattttggacttaatttttataacacttctattgaaatacctttaggttggcaaaagcagcttttgatgatgcaattgcagaactggatacgctgagtgaagaaagctataaggactctacacttatcatgcagttgttacgtgataatctgacactatggacttcagacatgcagggtgacggtaagcaagcacggagtgaaacaggcacctctttcagttgcaggatttgtttgtactctctttagacattccttggcttgtcgttatatcaagctagaatttagattcaccgcctgccctctatgaaattgtaattgctgcctttataggaaatggtgctacagtacggagttccattttgggaacttagtttagctcttcctttacactgtttcaaaggttgaggacaggaggagtggagagcaagcagtttattttatcttcattcaattcaattttagggggctgaagttaagtgtatttaaatccagatggtatcagtaggtatttatgaagtttttctctttgttgaaatattttatctaaaagggaactggtttcccatttccctctgggattctgtagagaaattgaatgttggcccttgggtctcttttttttttttttgagacggagtcttgctgcgacacccaggctggagtgcggtggctcaatctcggcttactgcaaactctgcctcccgggttcaagcgattctcctgcctcagcttcccagggtagctggggttgcaggcacccgttatcacgactacctagtttttgtatttttagtagagacgggatttctccatgttggtcaggctggtcttgaactcctgacctcaggtgttctgcccgcctcagcctcccaaagtgcagggattacaggcgttagccactgcgccctgctgtttttattcttttcttttcttttcttttctttttttttttttgagatggagtctcgctctgttgaccgggctggagtgcagtggcgcgatcttggctcactgcaagctccgtctcctgggtttacaccattctcccacctcagtctcccgagtagctgggactacaggtgcctgccaccacgcctggctagttttttgtatttttagtaaagatggagtttcactgtgttagccaggttggcctcgatctcctaaccttgtgatccacccgcctcggcctcccaaagtgctgggattacaggcgcaagccaccgtgcccggcctgtttttattcttaagaggttttcattgcaaacgcttcagagtattttagtaaacttaattgtgatgttgagtgtgtgttaatgtttactttaaatacaggagcccaaatttgttatgtttgttgattttaaaggaaattttattctctgtctagagaatcattttgatccatggtagattgttgaacagggatggagaagaggacaaattagtgtgataggagtattacaggatagttttacatttggtggtggtggtgctggtaggaggttgtaaacaaagtctgatgtcagttttagctgcggttcctttaagaatgtttctaaggctgtgccgggcgcggtggctcatgcctataatcccagcactttgggacgccatggcgggtggatcacgcggtcaggagatcgagaccatcctggctaacacggggaaaccccgtccctactaagtatacaaaaaattggctgggcgtggtggcgggctcctgtagtcccagctactcaggaggctgaggccggagaattgcttaaacccaggaggcggaggttgcagtgagctgagagatacgccattgcactccaacctgggctacagaggaagactccatctaaaaaaaaaaaaaagagataacgtttcttaggctgaaacataaaacatatgtcgcgttgcttgaggctatctgtagtttcttttggggaaacggacctgctgtattgtctttggaagtgttatactttttgaaaatgcttctgaaagtgggcacgtatgtgtcttttctctggaaggatcaaatcagatttgtgacttttgggttatggtactaaagtgagaattaggtgactcagcttttaacatttactagctttatgatatgtttaggatttgactagatcaggattggcatgagatattcacatacgtaggacttacttacacacttgcaacagtgccagatggagccacagaacacttcccagcgcagcatttcaggcagctactcccagcccttgggactcagaaataatttaccaactgtgaacaagtggcttccagctggaaaatctgtcctatgccggttgcagtggcttgtgcctgtaatcccagcactttgggaggccaaggtgggaagatgcttgagcctaggagttcaagaccagcctgggcaacatagtaagaccctgtctttaaaaaaaaaaaaaatgccgggtgcagtggtatgtgcctgtaatctcagctacttgcaaggctgaggcaggagaattgcttgaacccaggaggtggaggttgcagtgagctgagatcacgccccactgcactctagcctgggtggcagagcgaggcttcatagagcaggactttgtctcaaaacaaaaaacaaaaacaacagccaggtgtgacaacgcatgcttctcagacggctgaggttgggggatcttgaggctgcagtgagcttcgattgcgccactgtattctaacctggatgactgaacgagatgccatctcttcagggaagaaaaaaagttgtaacaacaattatgaagaagaatggtcaaacagctgtggactcgtaatggtcatccccagctcagatgctagtatctctctgcctgttgatggagggaaagcatgcggagagtttggggcgcgggattgacttcaggaaatgatacacctctcacctctggggacatgtttttgagagtaaaagtaataagtaatgaaagtgacctgacttgaaagttttttctgtgtgtgtgttttattttttttttttgagatggagttttgctcttgttacccaggctggagtgcagtggtgctctctcagctgactgcaacctacatctcctgggttcaagtgattctcctgcctctgattctcctgccttatcctccctagtagctgggactacaggtgtctgccaccaccactcctagctaattttttgtatttttaatagagacggggttccactatgttggccaggctggtctccaactcctgaccttgtgatctgcccatctcggcctcccaaagcgctgggattacaggtgtgagccaccgcgcctggctgattttttgttttgttttgtgagacggagtctctccctgttgcccagattggaatgcaatggtgcgatctcggctcactgcaacctctgcctcctgggttcaaaggattctcctgcctcagcctcctgagtagctgggattacaggcgtgcgccaccatacccagctagttttttgtttgtttagtagaggcagggtttcaccatgttggccaggctggtctctaactcctgacctcgtggtccacctgcctcggcctcccaaaatgcttggattacaggcgtgagccactgcgcctggccatttttttttattattattattttaataaaaacatatgctgggcacagtggctcatgcctgtaatcccagcagtttgggaggccgaagtggacggatcacctgaggtcaggagtttgagaccagcctgaccaacatggagaaaccccgtctctactacaaatacaaaaattagccaggtgtggtggcgggcacctgtaatccctgctactcaggaggctgagacaggagaatcacttgaacccgggaggcagaggtgcagtgagccaagatcactccattgcactccagcctgggcaacaagagcaaaactctgtctcaaagaaacgaaacaaaacaagaaaacacatttgataccaactcataaccaagtctggattacttctgtagctcattatcactgataaccaagagttgattaatcaaagtagactacctgtcagtctatgtacagaactaaagataatccttattcttggttgtcgagtacagttttaggaaatggatcatcttaaaatagggtaatacggcctggtgcagtggctcacgcctataatcccagcactttgggaggccgaagcgggtggatcacctgaggtcaggagttcgagaccagcctgaccaacatggagaaaccccatctctactaaaaatacaaaattagccaggcgtcgtgtcacatgtctgtaatcctagctactggggaggctgaggcaggagaatcgcttgaacctgggagttggaggttgtgatcaactgagatcgcgccgttgcactccagcctgggcaacaagagagaaacttcgtccaaaaaaaaaaaatacagggtaatactttcgcagtttttaaaaatctagtgaaattcggctgggcgcagtggctcacgccggttaatcccagcactttgggaggctgaggcgggcggatcacgaggtcagaagattgagaccatcctggctaacacagtgaaaccccgtctctactaaaaatacaaaaaaaattacccgggcgtggtggtgggcgcctgtagtcccatttacttgggaggctgaggcaggagaatggggtgaacccagaggcggagcttgcagtgagccgagatagcaccactgcactccagcctgggcgacagagcaagactccgtctcaaaaaaaaaaaaaatctagtgaaattcatttgtgttcaattccttattgagtctgtaaatcagttgattaaatttggttaagaagagtaattttcacttaatttttattaggtgaaatactttttatttatataatgcttccagtcatgaaatagttcaacagtgaaaaattcaggtggtctgttgacattccggtacaactaacaaactctgaatacacaaataattgtgggtacaaagaaattgttcatcagtttgagaagttgaatttgtcaaaaattagagtttttgagatggagtatcactctgttgcccagggtggagtatagtggcgcaatctctgctcactgcagcttccacctcccgggttcaagcgattcttctgcctcgtcctctctgagttgctgggactacaggtgcccaccaccacgcctggcaataattcgtattttcagtagagacagggtttccccgtgttagcccggatggtctcaatctcctaacctcgtgatccacctgcctcagcctcccaaagtgctgggattacaggcccgagtcaccgcacctggcctagtattacatcttttttttttttccttttttcgtgagacagagtcttgctttgtcacccaggctggagtgcagtggtgctatcttggctcactgcaaactccgcctcccgggttcacgccattctcctgtctcagccttcctggtagctgggactacaggtgcccgccaccatgcccggctaatttttttttgtatttttagtagaggcggggtttccccgtgttaacccggatggtctcaatctcctaacctcgtgatccgcctgcctcggcctcccaaaatgctgggattacaggcgtgagccactgttcccggcctacattttttaataaattggttttgaaactgcaatggtgcctgcctgtaatctcggctgttcagcaaggtgaggcagaaggatcacttgagcccaggagtttgacaccagcttgggcaagataaaacttcatctcacaaaataaaatactacttttgtgacttgggttccgtggtgaatataggagaatcgtcatgaaagtggcagtttactaggatgtgactttgcatttagtttaaggattatttagatttttttgttttttaaagagacggtatttatgtcttttaattttagaatatgttaatgtctgtcccagcatgttggaacataatttctttaaagggagggatcattgctttttctcaagtgattttagtctcttcaccctgtggtaagaggattgtttcatatacgaatccataggtaggaaatacatgttctccctgcctgttcccctctctccaaaatgtagatacactgggcaaagaaacatagccaaggaatcctttttcccctaatatctgtatgtctttcaagaggatattacttccttctcagagtagaagggaggaggagtagacagattgttgcttagagtgaagtttacacgaagtaagaccaaagtccggctcctgtatcattgttttcctttgtcctgctctgttggtttatttttcttgtaatgttgctttcatatgattgttctccctccctttttccttgcaatatagattcctaaaggaaaacccaactcttcctttcctaaaaactctactttgtaagtcacgttcatggcacagtgaattccgctttcagttttggttcttcactaatcatgcctgcgtatgatcgtcctgttgcttacagactctgcctgttccaccttccagggcgctgacctaagccttttccggcctgctcctcctgcctactgtggttggatgtgatgtatatgacagtgacatttttatgccaaagttacttggaacttctggcacatctcatggttgcttacaagcgagttgtgttctagtgtttgtgttaatgatactttggcagtgatttgctgttagagtgaatgttcctatcatgtttcctacgtttgaatacgttattgtcctttggagaacagttgggtgcccatcagttctttcatccctaagcaatttttttttgcctttgcatattttttttctgtcttatgaattaaagatcttcatgtattttaagtagttttaaaattttatacatttttttgagacggagttttgctcttgttgccccgcctggagtgcagtggcgttcaaagctcactgcagaaatagaactcccccacctcagccccccaagtagctgggactatagacatgtggccccatgcccagcgtatgtagttttttttttttttgagacggagtctcgattgtcgcccaggctggagtgcagcggcagaatcttggctcactgaaagctccgcctcctgggttcacgccattctcctgcctcccgagtagctgggactacaggcgcctgccaccatgcctggctaattttttttttttttttttgtatttttagtagagacagggtttcactgtgttagccaggatggtctcgatctcctgacctcatgatccacctctcttggcctcccaaagtgctggtattacaggcgtgagccaccatgcctggctccagcatacatagttttttacttttagttttatttattcttttttttttttttttgagacggagtctcactctgttacccaggctggagtgtagtggcatgttcttggctcgctgcaacctccgtctcctgggttcaagcaattctcatgcctcagcttcccaggtagctgggattacaggcatgtgccaccacgccaggctaattttttgtattattttttcagtagagatggggatttactgtgttagccaggatggtcttgatcttctgacctcgtgatccgcccgcctttgcttcccaaagtgctgggattacaggcgtgagccaccgtgcccggcgttatgttcattttttgtagagacagggcttcactgtgttgctgaggctgtaagtgggttttgaagtcacacagcaatgtcaagcgtttccgccgcagaagagatttgaaaactactgaaaccttgatgctgtgacatttgtcattttgagatcatttaggctgtttcaaagctgtactcagtgtaaatgcttcatgtgtgtaggcagctagtttggtgttatttgtccatcctaattaaataatttaacaagcattatgaatggatagtcatttgaacatttatgattcttgggttgatttttcatttattttgtttcaaactagttaactgtgtagtaattgtaagtggtttttttaaaaaagtacaagtgaatgtaacttttacctgttacatcatttttaagggaaaagcctgcatgcttctttattttggctgacttgtttaatgcatactaataggtagatgaccctccaaccaataggtggctttctgttgcatgtcatagtgcagttgaaactccttagggtaatcaccctctttaaaggcaaaagacaaatagcatgagtgaagtggtccaaatgccattctttaataacctcagtggtctgatttactttgagcatgctgtgtttcactctgaagtaaaatctgattatagtttggtgtatctggccaagatacaaaagctgaaatatttataacagcagaaccccacaataaaatacgatagaacttcttggcaacagtttattgctcagttaactattttgaagcatttctgataattagcttgtgggtaaattagattttgcaaaaagtttgcaaaatactcttgattcttgaagaggtgaggttattgagaaagagtattttgacccaagatttatgtgaaagcttgaatgtcattttagtaagatggtttccttggctgtctacgtcaagagcttatttagcgtaaaaacattgagttgtactgcgcatcagtttttttcattctgttgaccaataaatactttcaggaccataatcccttcttggcttaggcatctcaggtgtcaaggatgatagaagtcctttgcctgcgtttaataccaattgtagcaagtagaagagtctttatgcttggaatgacacctttgtttgtggctgccatagcctaatgtagtcaatacgaaataattgactttttttcttttttaacaggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatg

SEQ ID NO: 37404 - DNA, 52092 bp, Homo sapiens; identical to SEQ ID NO: 35783

SEQ ID NO: 37405 - DNA, 4644 bp, Homo sapiens; identical to SEQ ID NO: 37033

SEQ ID NO: 37406 - DNA, 5133 bp, Homo sapiens
aagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgacactccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctggtgaggggtggcgccggcgccctctgctgtgccctgatgactggggagggggccgaactagccaagcatccaaaccttgccagggctactcagcacgggcgcagtgggggaaactgaggcagtcaaagagcgtacgtggccgatatggcctcagtgccctatgctgtagttttctaggcttaatgcagcaatgaaaagacgcctggttgggagttcaggtgatgggttctagtccttgctcatccattcactggctgtgtgaccttgcggagatcctttctctttgggcattttttttctccattcggaggtttactaggctggactgtctcagggacctactctagcttggaattcctgccttctcctcagcccccttctcctcttcctcctcacttaacagcatttactgaggctattgtttgttagaccaaacgactcacagccaggctttgtataaagagcttagcaatcagacttcctttgcttcatttattcattgactccttgctttaaagaggatctattagatttcttccaaatattaaacattgccaggcaaagatgaataaaatttggttcctcccttcgagtttacagaaaggcagataggtaagcaaataaatataataaaatattcacatataagttaaagtaggaacagaccacagatactgccaaagagaagggcattatcagtgcttccaagaagagggatactggttaggaaaagcttctgaggatagatgttcaccaggtagatggcaagagaggagatagaggaaaggattttcctggctgtcctgtaatcacagacatgtccggaatctctctgagccctgtgttgtccatttgtaaaatagaaatggtagtgactcccccttttttttcgagactaagatactaagtatagggaatggcacataaggtattcaataaatgttatttctcttcttgataccactgtgggggacatggctctgcctctctgacttctgcttccttccctgcagacctatgccagatttactggtgctccactgaaggtacacaagatcagcaacccctggcagagcccttcaggtacccagtatcccttgggggtaaggaagggtgtgtacaaggggagaagcaagaaataggcaggaatgtgttgcaactatgtatgactaggcagctaagggtctggttggtatacttccctctcaatatcaggaactctgcctgcccttcggaccagtcatggagaggtcatctcagttccacacaagatcatcacccaccttcgaaaagaggtaggtgacttggatagagggggctgccagtgagagaagttcagtcaattctatacaatacacatttattgagcaccagatatatgccatgctagatgcaggtgacccagagcatcaaggagcaacagtcttgtggcagagacacacacaatgtcactgtgatgtattaaagcagtcggcaagagatgaaacttagggcactgtgaggcagggagggagaggagcacaggctgaaggagagtggaagacagcagttggcctctgatggtgggactggagagagatttctaagggccacttcctgttttcagggactaggttgggctagatatggggctcaggatggacaaggcttagagccaggttggagaagatgaaagagcattactagaggagtggggaggcctaggctatgctctttactctgccattgactatgtgatctcgggcaggccatgtaacctctcagggctgtgcactcccttatttgtaaaactagagggctgggccagcatgttttccaagggttcttctagcattgacggtcaggttccaagagggaacagtgtcagaagtaggacactcttcctcatttctaacttcccaaaggttgaggacctggggaattaattgagaggcctggaaagagaggatccagataaaagccaaagttcctggcagagccgaggccactgccctgattgcttaggtgtgaacagagcttttccagtttccaaagtattctaaattatttcctaacacaggggcattcagagaaagagattcttacccccattccacaggggagaaactgaggcttagggagatttaaggatcatgctgaagaggttatctggggacaaagcttactcaggatgtggagggggatgctgaggaacagggactggagcctgggaaggtagggcaggctgagacctgggggtatgggtggaatgtgtatgtggtaatggtgtctgagcgatggaatgaagtgaaagaaatagccaagagctgggcactgagggaacaagctggggggccctgggcgtgggttccctggatccagggagtgtgaggatggctttctctggttcctgaggcatggaccgagtcctagcctgcatctgagctccgttgtgctagctttgtggtgtctgggtcggggaagttactgttagaaagttgccgtcagcgggcgttgttccagctttccatggaaattctgggagctgctcctagtttgcggcggagccttccttccttccctgcattgggcgctggaccttcacggccaggaggctccaaggcccaggcttttcgccaacagcaacaggctactggctgggcccaggcaagggggccttggcaggaaaagttccttgctgtacctccactgcactcagaggccagtgaggggggtaccagacaggactccttcctccctggtgaagtgcccttgcagctccctagtgtccacgccatggatatttcctccacagaagtacaatgctgattatgatctgtcagctcggcaaggggcagacaccctggccttcatgtctctcctggaggagaagttgctcccggtgctggtgagtgtgcccagacctcccagcatccatggccagccggggagggttcgggaacacacagacccacacacaggctcaggaaagcatgggggtcagaagcccaccttgaatcagacaggtgcactggctcagacctacctgtttcttcctgcccacccaatccaggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggaggtagctctgagaccgggggctattgtatgagatgagccccaaggatgctggccaggaatgggagtgcttaggtggggaggtggcactgttcccacagctgcaagcctacctgtgtcgcccctacagctgtaccgagaggctcgggagtgtctgaccctgctctctcagcgcctgggctctcaaaagttcttctttggagatgcgtgagtctgactccaagagggtaatgggtggcttggaagaagatacaggttcagatggagcagctggagctggggctggggctggggctggctcaggctctggataggaggtccctgggatagaaactggccctagtgacagtgtgactgtgtgggggccagagccttctcagaggtacaaaagggtagggtgggagggcagccaggcacaggaggggcctgaagagctgtggggcactgaatgtgccctttatgcagccctgggatagagccctattcagggccaggctggcgccacctggggatctctccccataccaggtctagaactgtgtgtcctgtccttccctggtggccgcctgctgcccagagcccacctcccaaggctgactcttcctccagctccatctttaccccttctaccccagtggttctcctccatcccacccttctctctctgctccagccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggaggtaaggggcagatgggaggggcagccctggggagagtgggcagggatccaagaactagttctcctaacacaccttccttccttgaccctcagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgactgggctc

SEQ ID NO: 37407 - DNA, 445 bp, Homo sapiens
catgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaa

SEQ ID NO: 37408 - DNA, 35779 bp, Homo sapiens
ccccgcccccttttctatttctgaacaggcatgttccaggcagctcacccgactccttagattactatggaatcggtagggtcctgaccgctggggaagcaggaaagcgtatcctgggaagaaaggcttggcttggactccggagaagaatactacatcgagacctgctggggaattttattttattttattatttttttggtcttggttgtactgagggaggaagaagaggttgtgtggcccggtcgaacttgtggcagcctgaaggccccctcaggcggcgccgcgggcagccccgcagccggggcctggtgcagcctccgcggccgctgtcagggaagcgcaggcggccaatggaacccgggagcggtcgctgctgctgaggcggcagtgtcggcagtccaaccgcgactgcccgcaccccctccgcgggggtcccccagaggtaagctactcctccttcatgagtcacctttgccctgttgggtgggggggggggtccctctcccaccctgtcccgcacagtcttccccacctgagttcgactacgaaactgccctcttggtgtcagctgcaccccgggttccttctccaccctttcctctcaggcctggggtcctcctccgctttttggcttcctcttctattagctcctccctctgcctcggggattcccccctccctcactcatccctgttgcctacgtctcgaataattcttttttttaagtcatgaaccctttccatatcagacgactcccataatgcccatccttgtccttcctcgtcgtctctgcccctgccccaaaccttttccatggactccacctttatctcttttcctagtttgcacttttcctcctatgtccctgtgcaactccagcactgggttcccatttccctgagctaaagattgcatccctgtcttcctgtgctgcttctgattccattacctcactgtcacccacctacccagccagctcctggcttccaagaattgcctgttcccttctccttaagggatctcgggcccttgtcatcaatccaaaagtaccatttacattcttactttgaacctagtcctcactcttctctgggatgcattatgatccctataactttctttagcttctctttctccctcctcaatcccccaactttctagaggtttctgtctgtaggggagagatttgacagtgcccttcccattcaggatttccaactttgacacctccctcgagtttcagggatttctctgatccttgtgacatttgttctgtttttcccgtgggcttcatgtgttctctgttacactctttatctccacataccacttatttcaggatcaactaaaccttgaactaagaagaaaaatgtgttgtgagcagggggagcctcagctgcctcaggccgttcaggacagaagggtgtttctgaaggccggagcaagttttgaagaagtccctatcagattacacttggttgactactccggagcagccactaagagggatgaacaggcctgcgtggaaattgaatgagattgtgagaaaacttgtttcagattatttaattttaggcttttgttaaaggaatcacagaatagagtgccttctcacccctgtccagatccatgaggaatcagtttattcttgtggtttactagaatagttttggttggttccataagaattcaggcctggagtggggtaagggtataactggaaaaaggaacatgagacaatggaaagagcttgtacattcagaatcgggactcctgggttcagcatgtgacttcctcacttgacctctagagtgatccttttggaaaatgcccactctctgtaggcatcagtgcagtaataagttggtagcaggatgtgggttgggggaaaaaatcagatttggtttatttgtttacaaaacattttgggttcctcaggcaaaaggtatttattagtagtggtttagtcatcctgagaattttccttcaccttggtctttctgtcagatgtttctagtccacaaccaggggtgtaagtcattttgaaagacaagctccaggcctgcttccttcatctgctttgctttttcccccagtgcattaagtggctgattttctgtcctgttcctcacgtacttgatccataactccagattctataggtagaaagtatgtttgtgggaaagcactttgaggaagctggctggaaaagagaacttggagtgaactgagacttaggcaactagttgctgccatgtctctctcagcctgtgatagcgaaagggcacgtgagattccattcattttctgattctaggtctgtttgggagtagttatgtcatcttatcccacttcctttctcttccttgtcgttagtcatggtgcagtctcctcataattccccttattagaagctttcctgccaggcgcggtggctcacacctgtaatcccagcattttgggaggccgaggcaggcagatcacccgaggtcaggagttcaagaccagtccggccaacatggtgaaaccccatctctactaaaaatacaaaaaattagccgggcatggtggcgagcttctgtaatcccagctactccggaggctgaagcaggagaattacttgaacccaggaggcgaaggttgcagtgagccgagatcacgccactgcactccagcctgggtgactgagtgaaactctgtctcaggaaaaaaaaaaaaaaaaaagcagctttcctccttggaagcatccccaaccagaaatcatatttcctctcatttccctgctttcttcttagagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagaggtgagtgcacaggctgctttctttgccatctgtttcagtagcggctcccatagctggcttgggctgtctggctggaatctgcttataccagctccatggctctgcacagagttctcagcctgaatcaatattgacttaactaccatgagaccactgccctccctaccctcgtgctagtagcttgagaatgccctctcccctaatgcccacactctctgggcccttgtgtcagcagttacctggatcctggtagggctggagctggcttgactgcctggccctgagtttctataaggaaaaaggagtactcaatctctacctttaccattgaggtcaaaggggagagatgagttgagacatccttaaagaaaggtttgagttagacattaagacatgaggaggaactcctcaacagcagaacaggcagtcaaagatgatatggagtctcttttgaggagcaacctctctttaaaaattatttttgggctgggcaccgtggctcatgcccgtaatcccagcacttcgggaggctgaggtgggcggatcacttgaggtcaagagttggaaaccagcctggcatgttcgagacaacatggtgaaaccccatctctactaaaaatacaaaaattagccaggtgtggtggcgtgtgcctgtaattccagctactcgggaggctgaggcagagaatcacttgaacctgagaggcagaagttgcagtgagctgagatggcgccactgcactccagcctgggtaacagagcgagactccatctcaaaaaaaaaaaaatttttttttgaaggaatgcatgcatttggtaacaaatccaatggtactcaaagagtttatgaagaaaaacagcagtcctgtttccgttcatccctactcctgttctcgcagagttaacctccttaattatctcagtgttctgaaggttatcaccatagctttagataaaatgcttgttcctctatttctttgtttttttgtttgtttttgttgttgtttttgtttgtttgtttgagatggagtctcgttctgtcgcccaggctagagtgcagtggcacgatctcggctcactgcaacctctgcctcagggttcaagcagttctcctgcctcagcctcccgagtagctgggattacaggtgcccgccaccacgcctggctaagtttttgtattttttggtagagatggggtttcaccatgttggccaggctggtcacgaactcctgacctcaggtgatccacccaccccggcctcccagagtgctgggattacagcgatctcagctcacggcaacctgcgcctcccaggtttaagcgattgttctgcctcagcctcccgagtagctgagattacaggcacccgccaccatgcctggctagttttttatattttttagtagagacggggtttcaccatgttggccaggctggtcacaaagtgctgacctcaggtgatccacccgcctcagcctcccagagtgctgggattacaggcatgagccactgcacctggccatttgttcctctatttctttacttattgttacaaacaaggatttagctttagaggatatacctctcatttatataattatgtcatttttatttcttctactggacacctgtataactttaaataatatttaatatatttgaacctttctttcttttccattaacttttgacagtctctcttaattcaccttgtagaatgaacgtcagatattggtttccttacccgtttttccatctcttgtggatccatctcaaaggactgtgagatgtataaaaaaaggatagaggagactagttgtggtggctcatgctttgtaatctcagcactttgggaggcctaggcgggagggtagcttgaggccaggaagaagctttcctccttggaagcatccccaaccagaaatcgtatagtgagccatgattccaccactgcactccaacctgggcaacagagtaagagcctgtctcttaagaaagaaaaaggaaaaaaataaaaaggcaaggggtggggaaataaaggatcctttaaaaggaggaaaattgagccagcctgcctgcttggaagcagggcactagatcagatgatctcttaaagccattctatgaaaatataagaacataaaaatatcagaattggtgcaaaccaatccatatttatctagtccatggaaaaaattttgaaaaagagaatggtgattaactgggtgaggggattgatttggggctctttaccattctgtcctagcagagactgatccaataagtcctttaatggaggccagtagaaagttgtttgcctggaatcttttgaggtgataagaaatggggagctaggttaagcgatagcatctcctccccagagagtcctctgcagacatgtattttaactgctcagtcacacagaacatatgtgtatatcttctgtgtcttctccagctgctgctctgtgtgacctgtaacaattccttgtcactcagaccagaattccctactttgcccagttgggagctgtggaactcagtcagttgtcaacttttcctaggggccagctgttaggctgtggaacaggggaggcctcttccatttcccttccagtctgactggaaggagaatttaggttcccagtgtgaagtgtagagcctcagttgtctgaacccccttgaaggccataggagtcatttaatattaaaaatttagattgtcttccgtcacttttttcttattcctctgacttagaaggggaaggctgttgaatacaggactttttccttcaccttttcttttgctttccagtcctttcattttctttagaacagttaccctcaaaggcttttttttttttttttttttaagacagagtctcactctgtcgcccaggctggagtgcagtggtgtgatctcggctcactgcaagctccgcctcctgggttcatgctattctcctgcctcagcctcccaagtggctgggactacaggtgcccaccaccatgcccggctaattttttgtatttttagtagagacggggtttcactgtgttagccaggatggtctccatctcctgacctcgtgatctgccctcctcagcctcccaaagtgctgggattacaggcgtgagccaccatgccctgcccacaaaggcatattttcttggcattcaaaactaaatgaagcaagctgggcatggtggcgggtgtctgtaatcccagctacttgggaggctgaggcaggagaatcgcttgaacctgggaggcggaggttgcggtgagccaacattgcgccactgcactccactccagccagggcaacagagcaagactctgtctcaaaaaaataaataaaataaaaataatagtaataataaatagctaaagcaatttaaccctattccctacaacaccttcttctccatatgacttgcttcagatgcaggcagtgcctgggttcctgagaggccagggaagagacccagctccagtttggtggtttctagtggtagagctgcttatataggagaggagtctgttttttcctgcacctctcaacactgtctagctccctgaggagtaaaagctgccgggagggagagtctgttcagtagcaaaatcctctgaatactgtgatgtgattcttagctgagccctgggagtttttcttttgtctgtgagataaaagaggtgatagtatccttatttgccttcctggtgccagtaataatcccaatcgtagttaattggggcaggcatctgctaaattttctagtgaggtctgagacactattatgtgggagaatgtctgaactgtatttcccttgaaagttttgaaaagtgtacttctaggagctttcagtgacttaaaagtctgtggactagagggagaggaaaggatgtaccaaacatagagactgagaaaaagaagttgattgtttaagatgattgaggctatcacatgagtttctaagcagacctaaaaggtagtggtccccgttgaatcggtgaccctctgatgagagtgccctacgaaggtgtggcagggaatgattaaagcttccttcttattattcctgtgcaactcacagttgcgagtagggacagatccacataggcagccatgctggttctactgctcagagggcactacctaattttgggagagagcatagtgaaagagttgccaccttcttaccaataccaagctcaatctgcatcagggatattaaattcaggaatgaacttgcttggcagagttggcagaaagaaacagaaatagccttttttggtgatctctgagaacagaagagttccccatccgtctttctgcaaaactttagtggtgactgctgggaggcagggagctggactatatgatattgggcagttaaaagtaacctggggccgggcgcggcagctcacacctgtaatcccagcactttgggaggccgaggtgggcagatcacgaggtcaggaaatcgagaccatcctggctaacatggtgaaaccctgcctctactaaaaatacaaaaaattagccgggcgtggtggcgggcatctgtagtcccaactacttgtgagcctgaggcaggagaatggcatgaacccgggaagcggagcttgcagtgagccaagattgcaccactgcactccagcctgggcgacagagcgagactccgtctcaaaaagaaaaaaaaagtaaccttaacatttcagacgtacaagaacagacactggaagggtggtggtggaaaacagcctcccagagggactaaagaatctctaggcctccttattccacctacccaaagtatatgcatccagggtcaccggggttgaaggtgatgtcactaatattttgaaattacctgtattccaactctacaaaatctttcctcttgctcatgctcttgagtgtgtcttagactcactctattagcatttttgtgaagaggcctctgagtctgagtcctttgttagctatagtcagattctggagccaggttgatctgatgaaatttccccagttctgcactgattccagatttggtgaggctctgaaggattgttcttggagagcagtggctttggtcagcagtgttctttcattgaacttccttccaacagtccctccagaggaggtgttctttgttttgtgactcctgttcctccctgttctttggaaggcctagatctatgagtcctagtctgatttctttttgccttttcaattgtccctccagttgttagaatgtgtgtatgacagtggggggagtggtattggggcagaaaaggctgtcataagtatttctggaagattctcaaacaattggaactctttgcttcccttataaaataatataagttttatgttacacacacactggttagtaaccttttaggtgatgaggattcaactagcatttcttttttttttttttgagacagagtctcgctggtcttgaactgctgacctcaaagtgatccacctgcctcagccacccagtgcactgggattacaggcatgagtcactgtgcccggcctcaactagcatatattgagtactactatgtatcaaagactgtgctagattctttcatacacgtgatggtatttgttccacatagcaacaatgagaaggaagtgttttttcccaatttgcagttgaggataaatggcttgcataagttgcacatttctgaaaggctgaatgaggattttcaaccccagcctatttgccttcaagtccagagctctttccattatatgttagcagccacggcactggagaaagagggtgtgatgtcatgatgtcagacaaccagagaaacggcacagcttcagcagggttgatgatggttgttttagagctgccttcttctaagtgaagcctggcatggtatttactggcctttattttctgggaacttcgagtttaaaagggaaggtaaaaaaatacctgtaaccagaaaaatatatcaagactttaattttatttatttatttatttatttatttatttgagacagagtttcgctctgttgcccaggctggagtgcagcggtgcgatctcggctcaccacaacctctgcctcccgggttcaagcgattctcctgcctcagcctcccaagtagctgggattacaggcatgcgccaccacgcccagctaattttgtatttttagtagagacgaggtttctccatgttggtcaggctggtctcgaactcctgacctcaggtaatccgcctgcctcagcctcccaaagtgctgggattacaggcgtgagccaccgcgcccggcctttttttttttttttgagacagagtctcactctgtctccaggctggagtgcaatggcgtaatctcggctcactgcaacctccacctcccaggttcaagcaattctccggcctcagcctcctgagtagctgggattacaggcgcctgccaccacgcctggctaatttttgtatttttagtagagacggggtttcaccatgttggccaggatggtctcgatctcttgacctcgtgatctgcccacctcggcctcccaaagtgctgggattacaggcgtgagccactgcgcctagccaagactttaatattaaataaagatggctgggcaaggtggttcacacctgtaatcctagtgctttgggaggctgaggcaggagaattgcttgaggccaggcgttcaaagctagcctgggcaacacagcaagacgccatctgcacaaaaaaatttttttttaattagctgagcatgatggcacacacctaaagtcctagctactcgggaggctgaggcaggaggatgccttgagcctaggagttcaaggttacagtgagctatgatcatgccactgcactccagcctgggcaacagagcaagacttgtctctaaaaaataaaaataaaggtgagatgcacaggacctgtgtgtagaatgttatatgagtaaggaaatatagtctaaagtggaaaataaaaaggttatagcaggcatttaaagggagacaggaagagcaagtggatagaaaagtatttgaagagttagggaacaagggagtaacacctgacttgcttctcagtctacccgaagaatctgtaaatcaccaggcatggtggctcatgcctgtaattccaacactttacgaggctgaggagggaggattgcttgagctcagttcaagaccaggctgggcaacatggtgagaccttgtctctacagaaaaatttaaaaaattaaccaggcatggaggcacatgcgtgtagtcctggatacttgggaagctgaggtaggaggattgcttgagcccagaaaatcaaggctacagtgagttctgatcgcgccactgcactccagcctgggcaacagagcaagaccctgtctcaaaaataataagattaaaaatttaaaaataagccaggcatggtggtgtgcacctgtggtcccagctacttgggaggctgaggtgggaggcttgcttgagcccaggaggtcaaggttgcaatgagcccagattgttcaactgcacttcagcctgggtaacagagcaagaccttgtctcaaaaaaaaaaaaaaaaaagaatttgtaaatgtaggccaggtgcagtggctcacgcctgtaatcccagcactttgggaggccgaggtgggtggatcatgaggttgggagatggagaccatcctggctaacatggtgaaaccgtgtgtctactaaaaatacaaaacaaaattagctggacgttgtggtgggcgcctatagtcccagctacttgggaggctgaggcaggagaatggtgtgaacccgggaggcggaacttacagtgagctgagattgcgccactgcactccagcctgggtgacagagcgagactccgtctcaacaacaacaacaacaacaacaacaaaaagaatttgtaaatctatataaatacaacatatacaaaacaacatttcacatatataagctaagaacagaggctaagctgagtaactacaggaggaatgacgagtaatgtaatcagaagtggaggtagtcaggaaagcttcctaggatatgtcttcttatctgattttgaaggagtccaggaagacaaaaagaggaggtgcctgggaaggtgtcatagcaaagggaagatctgaggatggcaccactaaccaatgtgtgtatgtgtctccctttctgttcttttctccctccctcttcctgtagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggtaaaattctggggagggccagagacaaaaggtggtagagggctgcatggagacaggatgcctcctatatacacacagggttacgctgttctttctgtcctccctgtttcatttcactgataaaagcatggaatgttagaatggaaaggccttagaattcatgtattttgcctgccttagtttacaaaggaagaactcagacccagagagataaagtgagttgcctcaggtcatataggtcatggcaaggctgacgctcctgactgtgtcccaaatcatttttattaaactgcactggccaggcgcggtggctcacgcttgtaatcccagcactttgggaggctgaggcaggcagatcacgaggtcaggagtttgagaccagcctggccaacatggcaaaatcccatctctactaaaaatacaaaaattagccaggcgtggtggtgggcgcgtgtaatcccagctacttgggaggctgagacaggagaatcacttgaacctgggaggcagaggttgcagtgaccagagatcgcgccactgcactccagcttgggcgacagagtgagactccgtctctaaataaataaataaataaataaactgccattccattaacatctactatgttaatgagaactgtggcagaagccctccacaccctgacctgagacttgagatagctaccagagcctctcagagcagcatctgtgggaaaggaaaaggtactattgtctttctgtgtgctggggtaggggagatgttagaacatcggcttcattctcctggccactcctcctcataatctaatcccttttcactaccctctgaagatcctaccttttgttgacataagtgtaaggtttatttcttatcactgaggcatctggagaatgccttcattgcctgcctttccttagggggaagagtgccttgctggtatctttcccataccatttgggagaagcacaaagggaagagaaagcactcttagtatagagtaaatatagtgcctagtcaaggacctggaggctgggaagaagaggaagctacagcagcagttggaggtataacttaggatatagagcagggaagaggtggccacatgaataggttatacccactcttcactccacatctggacagatagcagggaaagctgcccagtggactaccaagtgtcagtgacctggtgtcccagccagacaatggtgctccagtcctcccctctgactcaccattggccaggctcccatcctggcttccaacccagcctagaaaagagggagaaaaaaaggaggaatttgcactttttgaaaaatgcggatagctatggtcttggcatctgcctctgtggggcatataacccacccacgtttttgatacaatgggacttctttcaaatagagggaagtcagagtgactagagaaaaggaagagggagggagactatagagcctgctctctggaaatttggaattttgttaggatagtttaataatggtaaagctaaaagtgctaacatttattcagcacttatgtgccaggcatcttgccaagtactttacatttaatcctcacaaccatgctgagagacaggtattattttgccagcaaggaaactgaggcttagaaagattagatgttttgcccaaggtccctcaactagtgaatgtcagaccaggactcaaatctccagctggtgctcataatcattcagctgaactaccttggttatttctcaatatctacttcccaaggtccccagctgtcagaagccatgtggggaagaacggcccaggctatggccatctgagcttccacatccatgcacaggcaaagccaaaactgttgtcagaactagaatgaaccgttttcatatctggttgagcttggcagcagagccctgggtcatgaagagaagttgctgcagaacaagaagagtcatccagattctagtggaacatgaagggttggatagctgtctcatcttggagtcaaacctgtagcagagggtgagcagctggaagtgaattccttggtgcctcttgtcaggcttggcttttctctttatccattttgtagtgctcatcttaggaccagaaaagctgaggcctcagggcttttcttactctgctgatccttggtccctctttccttacatctaactcccactccaggataagattatggatggcactgagaggcaggtattaggtgaatacttacatcatttagggtgggttctgtagctgccgttcttccaacctgactccttatcttgggtcactagatccaggagaggaaggagatactatgttcccaggcactcctgcgttatctgatactgacagaatgaaatacctgaattcattatggctccacagaaaatgggagagcaagaaagagacagaaacatgaatatcactaggtttctaagcattagagtcgtcagcacaggggtctctcccagcccttttccttccatccgtccttccttccttccttccttccttccttccgcccacccgtctgtctgtccgtccgccctttttcttgcaacagggtcttgctctgttgcccaggctggcgtgcagtggcacagtcatagctcactgtagcctttaactcctgggctcaagcaatcctcccatcttagcctcccaagtacctggggctacagctatgtaccaccacacctggctaatttttaaaaaatttttttgtaaagatgaggtcgtgctctattgcccaagctagtctcaaactcctggcttcaagtcatcctctcgcctcagcctcccaagtcactgggattacaggcatgagtgactagacccagcccctttggcattttgaggatgcgtctgtcaaggcttttgtcccctaaataccaaaggaattggttttccttttactcatccttcttccctttcatgtaacattcattcactcaacatgtagttattgactttgtacaatgtccaaagccgtgagctgtgctgtggaggacgggggataaaatgttatccttccctctaggaacatgtgaagtaataatgaaaaccccagtatctatggaactgtttagtttgtgactctcttgaaaaagttgttttctgccataagcaggaagtatacagcttactaaaatgaggcacataattatctaagacctaagcagagatactctaggagaatctctaggtagaccctaacactctgctcccagtctcttgcttttcttttaggttctgagtttaatactatgctcctaccaccagtagaggggctcccaaggatgaggtcgggcctcaaagaagaggctcaggggcagcatgtacagttctcttcctgcccatggtctccctgcagagttgttctctgctcagctctcacagtgttctctttcttactatgaggaatcctttacactctctcccacagtcagaaggctttgtgctgatttttcacattttccaccactgctcctcaaagcctgccgcttcaaagccattttatcagcctagtcggggaactctgcccaggcagtttgtcctcccatttgtaaccaaatggcaaatattttggtatagaatgggggagctaaaaggagagagtgatttaggtatcacaccctccccgatatgatgacactgttagtagattagctttgtcttttcaggactgcaacctttgtacagagaaatctgccgcatgtcacactggaagccccagtaggccttctagcttgatatggtgtgatgtcagcttcttgcttcatctttactccccggagctgactcagtgtgagtgactcaagcccagggagtaggagaggagcaggtcatgatatacctcccttcccccagggctgtcaatgagtcagacaggacctgtctgtgacagaatcagctggagcgttgctcagggagccaatatcttgcctgctgttccttctccaaccagctcataggtagaaatagaaccactaattcataatagactctgacatcctcactgccttaattctcccaccaccttctacccaaaatggaagagttgttgccttaggggcatgtttccaaatgtggcttctccctcaaagtgctccagtccccagattcttcaaggaaggacctgactataggacctccagctagaatagaactgaaaccatggaattgagttcaagtggatgcttgaatctactcagcagatttcagagtagaaactcaccactgccctcctgccctgggagctcttaggactttgtcttttaagtctaacctcccccaccccgacctcaacgtcccccacaacctagatttgtgcacacgtgctgctctgttccctgccctggtagaccatgttggacagaacccaggatgagccctgtgcatgagtgttgcctcagagctgctgagtgagagtttgacaccatctctttcccctgtttttgcacacggacacatatgacacagcaatggggtgatgtttagataaatcctctgggctgggactaggacagctgctatccagctagtcagctttctagatggatatagctaactccccaacttatatcaaaaattgtagtatattgattgtcatgtggatagcctgataggaagcctaaggaggtttggtagataggagattgatttatccttcactcccatcagcatccagcccagagattttgggcttattggtctaggatgctctttgtcacagaggttcaaggttgggattcagcttcccagggtgataatgaggctaattagagaagaggtatacctgccactgaaagtttagcttttcttcctccctgaggtttccaaaaagctggaggaacatggggtttccagtatgggagccatgcagcttattaagttcagtcctgtggtggtccccatggagaaggatttggttgagagcatgtgagtgggtaaaaaaaaagagcagggaagcttggcagtgcagttactgccctagggacccagctttagagctttggcctagaaggaagatccattcagttgagaatagaagtgaataaagtgaaaagcagaggctgctttgtctcttcagtccttctgaccttaaagtctgagctgcccttccagcatctcctacaagtggtcaagcatctgggcaagtagcatttctgagttgactttcttttattaaagcagaaaggtagaacttcactagagaagcagttacgatccaagttggagctaaattctttacctttgtctctctcccctcccttcccaccccctccttctccctttgccctctggccctttcccaggagctctcctccagcaccgagagtattgataattcattcagttccgtaagtggggccaggctgggacggggtggcaggctcccccagtggccgcatttcctctccgtccccaggtcttctgagcccccaggccaaggctggagttaaaatgccccttttcttactgggagatcagctcctccctcccagacctcccagatctgctggagttcccctgacctttgcggtggaaatcctgagcccaggctgagatgagctcagctgatccttctctcagagacagctggagtacagtgctgctcagcccccagctcctgagtgtctggagcaaacagctgggagagaggtagaattcactcctggattagagccaaaaactgcctggcagaaacccccaggatcctgtttctcccacccagaaccctttccccatggcttctgccgtcagattatcaaatatttattcataatcttctaaatgctaggccctgtgctggtgagctgactccaaaaacaaataggacttggcctgaaggaaagttttgcctctccacaactggttttcttttttaacttcaaccacattttttccaggtctgagttcttcccttttcccagctcactgcccaggatgttccttaatcccctctcctttcttgttccctctggactaacccctgaccctttggtcccacagggtcttggaccttgttgctgggcaaagacgtgagaggaaatgcaggacctctgggagtttggctgattttttttatattttctatttgatttgtctatcaaatcagttttctctgttctgtgctaatcccctttcagtcatgattcctatctcctctcatgtggcagagcctctctcttgaggcctggggtcacatttctaacatgctcacgtaacttaggggcccctaacccaaatgctgatttgagaatgggaaggaattctgccttttctaatctgagatgattatgaattgggtggggtagagggtccttgggacagagatcagttgccatctgagtggattcagatgaaggaagaagtgagtcttcaaatttcctcttattttctttctctattagacccccaggatatttccagggaccttagaaacccaattccattgttttccttttctttatctcttttcaacaatgtcacttaaagcattcctgaaggattcagacaccctctttcagtccctatgtggcactctgaaccatctcccaagaggcagaggctggaatgagcttttcctttgaatcctggcactgttgcacatgtagaggtaggcctgatactccccagttttcaaaagaagctcttttagagttcgagggagcaaggatagaaattctctcaatccagaaactaagcaagacacacggaaagggagagaaaggcttggtgagtcaaatgctgtttctacaaaggaggggagatgggatggggagttgggtggctgtcttgataaaatgccccttacggtagaagggcttagactgggaagagagcctttcttcgtgtctagctgagtccctctttttccccacctgcaccttaattccaagaccaactttgctctttctgaggatgactgaattgcccagcacaaggagccaaactcacagcagggaattaatatgaggaacctagtcactgagaggtaggggaagaggacccaaagaggagtcactaaaagagacaggccttcagggccatcatcaagggctaaaaggagctgttgctttctccatctacctacctccttccatctgctttttctttctccttgattaatgcaaagtctgctcatcggctcatcctctttccatcccctgcatgtgcattgacgcctggtaagagattgtgggacggacagggggataccatggaaatcaacagaagtaatttgaatgacgagcatcttccctctttgaaagtggaaatgatgtggggctcccttctctagccttgcgggacttgacggagcccctcggcagagatctagcccaaggatccagatggggagaaggacaaccctgttcttgaaaagggtgaaacaattcaggtgtaagcagctcttctctctgtggccctggctaacctatccagatgtccccctgctcactctgaagccttggtacagtccttaaggaacccaagtccaggagaagaggagtgcatcccagttacctggactcatggcctcccttaccctcaagggatagcctatagggaaggaatgtgctggctattctcaattcaagttgtgaagggtgggtggaagctcctactaagactaaaaagcagctgctttcctggagttctccagatagtggggtccccggcctgcatggccaggagtgactgagtgggtgtgccattgtattctatggtttcttcaccatcttttgtcttaccccaaacccctgtagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggtagatgggttctggcccaaacccctaccctggacgtgactcttcacccatggttgttcagagtttgcgtgtatgaccagtgaggccctcaccaacatcctagactcccttcatagttcatgatgcatatgtcaaccatgactctgtctcagtgcgattgtgattttgagagcccccctgtatccctttttgggctttgtttttctggaccaaagaaacctaatctttttagcttccttcttgctgtatcttaggagaattgctcttcaccccaccttatggtcattttggtagcttttctccagcctttctataactcttgggctttccagatacagcaaccataaggatagagaaatattttgtttctaagaccttttctgatcagaatgagccgacaaaaggagagaaggatgcccaattcacactggagagaattagctgaatttgtgtgctgactggaatgagtattcatggttcagattcttcttttttttttgagatggagtctcactctattgcggaggctggagtgcagtggcacaatcttggcttactgcaacctccgcaacccaggttcaagcgattctcctgccttagcctcctgagtagctgggattacaggcgcctgccaccacacccggctaatttttgtagttttagtagcgacggggtttcgccatcttggccaggctggtcttgaactcctgacctcatgatccacccgcctcggccccccaaagtgctaggattacaggcgtgagccaccgcgcccggcccatattcttctttcaaaggaaatactgaagtttgggacactccttgggacagtgcccagctttgtcccagtctttttgtccactgtagctccctgggccctgtcttcaggacgagcccacagaggcatctaggcctcccttacagcctgtaattgatagtctagagtggtttggcccaagcacatcatctgtacattttggagctcagttgaaatattttgaagacttaaggattctgtcacacaaattctttacataggtgatcataggacaagtatctgccctaaatatagtgttcatagtttcagaggactattggatgaaggctggagctaggagaaaggacagcaggaagaaccttgctaacagagttgagatttgggggttagtggtggaagtaagttgcaaatactgtctcactcttcccccaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggaggtgagagggcttcagggaggtaatgctgggtcacaggagctttctccaggagctttcactatattggaaacaagacagcatatcccaaggcagggtaaggcaagtatcctaatgagtggtgtaggtagtgaggggtaatatggggaaagctctgaacaactctagcctggaatagattcaggtggagttcattttccaggtgaaggattcagatttaaatgtaaagaggagcttctaggccaaggggagtgagggaaatttaatgaaaatatttattgaacacctacataaagttgtcatagaatagcagaggatgagaagtcatacattaattcattcaagaaatttttattgagggccttctatgtgccagacctgagtgctgtatgctagtgaacaagacttggcccctgcctacaagggatttatgacctaactggaaagagaacaaggccagtaagcaagtagttgtagtgtggtgagagtcaagtcatgggggaaaggataggacattataagagcaccagacttggggcgggcatcacaagagatttcctggaggaagtaatctctcagctgaggctggaagcatgggtaggaattagctggacaaagagtgctggacagagggaacactgcatgcaaaggccagaagacaagagggagcttgggccattataggaattgaaagaaattttgcctggctgtgatgtgcaggtgtgaggtaagaagtggtgaagaataagactggacacgtgggcatggaccagactataggaaggaccctgtaagctggggaaagaaacttgaactttattctggggcatgaagagccagagcagaattttgtgtagagctattaacacagctggccaggcgcagtggctcacacctgtaatcccaacactttgggaggccgaggtgggtggatcgcttgaagtcaggatttcgagaccagcctggccaacaaggtgaaactccatctccactaaaactagaaaaattatgccgggtgcggtggcgcacgcctgtaatcccagcactttgggaggacagggcgagcagatcacctgaggtcaggagttcgagaccagcctggccaacatggtgaaaccccgtctccactaaaaatacaaaaattagccgggcgtggtggcatgtgcctgtaatcccagctaatcgggaggctgaggcagtagaattattcgaacccaggaggcggaggttgcagtgaaccaagatcacgccactgcacttcagcctgggtgacaagcaaaattccgtctcaaaagaaaaaaaaaaaaaagccaggtgtggtggaacatgcctgtaatcccagctactcgggaggcaagtgattcttgaagcacaagaatcacttgaacctgggaggcggaggctgcagggagctgagatcacagcactgcactccagcctgggtgacagagtgagactctgtcttaaaacaaaacaaaacaaaaacacagccagggccaggcgcggtggctcacgcctgcaatcccagcacttcgggaggctgaggtgggcagatcacctgaggtcaggagttcaagaacagcctgactaacatggtgaaaccccgttcctactaaaaatacaaaaaattagccaggcatggtggcgcgcgcctgtaatcccagctactcagaaggctgaggcaggagaatcgcttgaacctgggaggcggaggtcgcagtgagccgagatcacaccattgcactccagcgtgggcaacaagagcgaaactccgtctaaaaaaaaaaaaaaaaaacacacagccaggtttcactttgccaaaaggcagaatctctgtctttgagcttatagtccaattgcagaaattagacatttaagaaaaaaaaatttagatatacaacaaagcagtgtgtactaggtgacaaatggagttgagaagaaatgctctggtatgaaggacagaagagacttgacatgggccttggggtctggtagaatattctgtatttagagagagatgagaagataagattgaatgacttagattgaagaaactgtcagaagctagtctgcaaagagtctgctttggaccctaggggagaacgcatccctatccttgggggactctcagtgaggctgaaattttgagctcctgtaatggtcatggcagtggtttgcaaactttagtgcattggaagtcttctggagaacttgttaaaaattcagactttcagatcccattcctagtaattataattcagattgatggtggggcctgggaatctgcattctgggtaattctactgcaggtagttcacatgttgagaaatgctgctctgggcagcctggggtcccagtaaccaacatggtgtgtaagcagagtttgaaagagagggatgagcatgctgcagtgatagcaagcaagcaggaggggaaagacgggagacctatactttagcacttctgaccagcactcccctttctccagctccccgaagtgcataccaacagctgtgacaacatctcccagttctctgtggacagcatcaccagccaggagagcaaggagcctgtgttcattgcagcaggggacatccggtatggccagatcacattgcccctcatttttcatccctctttcaggaacttcccatctctttgttaccttcctctccatctcaatcatctgttgttggcctgtgtctttccctctttcattctgtccttgtttggggccaccaaacttgaggcaatgaaggtgtaggttgagaaattacttgggctaccaaagaaggaaattaaattttaaaaagactccaaagggatgaaagcaccagaggggccgggcatagtggctcacacctgtaaccccatcactttgggaggccgaggcgggcagatcacgaggtcaggagatcgagaccatcctggctaacacggtgaaactccgtctctattaaaaatacaaaaaaattagccaggcgtggtggcggatgcctgtagtcccagctacttgggaggctgaggcaggagaatgacgtgaacccgggaggcggagcttgcagtgagccgagatcgcaccactgcactccagcctgggcgacagaacgagactccgtctcaaaaaaaaaaaaaaaaaaaaacaagaaagcaccagaggaaggagtttgagcagtgtgtctcaaggtggggtctcaaagcgactgtgtcagaatccagggggaggaaggaggacttgttgaaaatgcagattctaggctgggtgcggtggctcacgcctgtaatcccaacactttgggaggctgaggcgggtagatcataaggtcaggagatcgagaccatcctggctaacacgatgaaaccccatctctaccaaaaaaatacaaaaaaaaaattagctgggcgtggtggtgggcgcctgtagtcccagctactcgggaggctgaggcaggagaatggcgtggacccaggaggcggagcttgcagtgagccgagatctcgccactgcactccagcctgggagacacagcgagattcttatctcaaaaaaaaaaaaaaaaagaaaagaaaagaaaaatgcaaattctagagacacacccattctgaatcagccttggtagaggaatatggagggcctggtaatcttaattttaacatgattacaatcagttagcaaaaaggtgtcattggttatgttttcttccatgagtccctttcagcctgggttcctatctttgtgtgtccagaatccaggagacagtgcaggaaatgtcagtatagactgggcatggggcttgggggtagcttctccaagcaaatgatgtattttcttcctgccagccggcgcctttcggaacagctggctcataccccgacagccttcaaacgagacccagaagatccttctgcagttgctctcaaagagccctggcaggagaaagtacggtgagttgggtgtgggtctctgaacccctctcaaagctcagaggcagttgtaagtgctcactgcaccaactttattgtccatcagcctccaaaaaaatctgtcaggcttccaggctgtctgggtccttgccctatggggcgtttgcttgggattttttgtggaagccatgtctcttgtcctcaccctggcatcaacctttgacaccctttacttctgtcttcacaggcggatcagagagggctccccctacggccatctccccaattggcggctcctgtcagtcattgtcaagtgtggggatgaccttcggcaagagcttctggcctttcaggtgttgaagcaactgcaggtaagagaagagaaggagaggccaggcacagtggctgtaatcccagcactctgggaggccgaggcgggtggattacaaagtcgggagttcaagatcagcctggccaagatggtgaaaccctgtctctactaaaaatacaaaaattatggccgggtgtggtggttcatgcctgtaatcccagcactttgggaggccgaggcgggtggatcacgaggtcaggagatcgagaccatcctggctaacacggtgaaaccctgtctccactaaaaatacaaaaaattagccgggtgtggtggcgggcgcctgtagtcccagctactccggaggctgaggcaggagaatggcgtgagcccgggaggcggagcttgcagtgagcggagattgcaccactgcactccagcctgggcgacagaacgagactccgtctcaaaaaaaaaaaaataaaaataaaaatacaaaaattagctgggtgcagtgatgggcacctgtaatcccagctacttgggaggctgaggcaggagaatagcttgaacccaggaggcagaggttgcagtgagctgagattgtgccactgcagtctagcctgggcgacagagcaagactctgtctcaaaaaaaaaggagagaaagggaaactcagcccaactccagccaaccggaggtgactacacagattattctgccggggaccaccttcctgccaaggtctaaaacaaaagcagagtaaagagaagctagtgcaactttcccctgggaagaacagccataggaacagctccacagcggcctcttttggcccttttgtgacctgcacctgtcctgttccaagtctgaactttagagtgctaggtttgccttttagatcaaaacttccaaaatgtcctggcaccctggcatgggcctgtagtctcagctagtcaggaggctgaggtgggaggatgtcttgagcccaggagttctgggctgcagtccactatgccaattgggtgtccgcgctaagttcggcatcaatatggtgacctcctaggaataggggaccatcaggttgcctaagggaggggtgaactggcccaggtcggaaatggagcaggtcagaactcccgtgctcatcagtaacaggatcgagactgtgaatagccactgcactccagcctgagcaacatagcaagaccctgtctctgagaaaaatatgcatttgaagaaatcagcgtttttttttccttattttattttttttgagatggagttctgctcttgtttcccaggctggagtgcaatggcgcaatctcggctcaccacaacctccgcctcccaggttcaagcgattctcctgcctcagccttcccaagtagctgggattataggcatgcgccaccacgcccggctaattttgtatttttagtagagatagggtttctccatgtgagccaggctggtctcgaactcccgacctcaggtgatccgcccacctccacctcccaaagtgctggaattacaggcatgagccaccgctcctggctgaagaaatcagcatttctaactgaagtgagccaaaaagaaaattttgcggaggcaaagtttagtgacccaccttttcctagtgttaagtgtgtgctaaggcacatggaagaccaatttatttatacaaggcactgagattttttcaagaaatagctgtcaaatctcaaggtgaagatctaaatgtgaacagtttactaatgcactactgaagtttaaatctgtggcacaatcattgtaaacatggggttcatttctctaaattgatttctaatctgaaattactggaaaacttccttgcccgtttttgccaaactcaatttttggtttttggcatatatccattattcaaacttaatgcctctaattttaatgccaacacaattggttgtaatcaaatttttaaataataataatttggtcctcccccctttaaaaaacaacataaaaacttcccaaattggtctgtagcaggtaggttatagtgtgctgaaatattgatcttctgatacccctgggttggtcacctgcaagccacttaattgtttaatactgttctttataccatataaatattttcattttccagagaagtcttctctggacctaaatcctttccttttttcttttttttcgtcggagagagtctcgctctgtcgcccaggctggagtgcagtggtgcaatcttggctcactgcaacctccacctcctgggttcaagcgattctcctgccttagcctcctgagtaactgggattacaggcatacaccaccacgcctggctaatttctgtatttttagtaaagacgaggtttcactctctactgaggttggccaggctggtcttgaactcctgacctcaggtgatccgccctccttggtctcccagagtgctgggattacaagcataagccaccgcacctggcctcttttttcttattatttgaacttacagctcccattctccctgcttgagaggggatagtgaagtttcctgttctccctgcctgtcttgggctttctacttaggtgataccttttcccacatacctgagtgtagtttctgactttgtcaggccctagacttcctttccaaactccctggtcctcactgggttaagtgagtcttactcatttgatggcttagaattcaatgctaccaaggagagaggctggagaaagggaagagttttagccttcttctctagtttggagaaagataagagtcctgtatcctccatgtctcctcacagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacaggtaggtgacttctgctgctcatcctaacatttctccagggttctctctgtcccttcgtgtgtagttctcaattacttattactgccctccatggcaaagatgtgaaaaatgaaacaatgtattttaagcagagacagatgtgttcccatgacattaagtcaggaggcagactaataagaactagggtaaaagggcaaagaaatgaaggatttatgggaggactaagggtttgagtgagcagggtcttcaaggacaagggaaaatgatgacagaggaagctgcaggggaggtacatcccagctagaagaaataattgaatgtgattaaagcacagactgcactgcatggcagtggagtaggaggtggtaccatgaggcaggtaaattgaggccagttgaagaagggccttcattgtgaagcttaggtgttttattttgcaggcagaggaatgacatgatccagtctgtgttgattaaatgccctgtggcactgtgggtgaaggtggatgtaattgggtgtttagcaacaaagcaagagataatagggcctggcactaagggtagtggttagtgactgagagcagaaaggagaaacatgatggagatgaagtggaaactctcagccatgaactctcctcacttcttattccagcatatgatttccacagcttttaagtatctgttgttttgcccagagctgtcattttttttcaatatgacatgaccttgatgaaaactaactacacatataggtgaggcacataatgtacaaaaataattacaccatctaggccctgccttctaagagtatctcccaacagtgacccagggtctctgccctgaatgctcctatgagttccagctctagaccctcggcacagggcagctgtcctggaaaggtggaaatgcaatggccagtgctgctggggcttccagtaacatggtggcccattaagatctagctaataatggctgggtgtggtggctcatgcctataatcccagtactttgggaggctgacacgggtggatcacctgaggtcaggagtttgaaaccagcctggccaacatggtgaaaccccatctctactaaaatacaaaaagaaaattagctgggcctggtggcaggcgcctaatcccagctatttgggaggctgagcaggagaatcacttgaacccgggaggcagaggttgcagtgggccaagatggcaccattgcactccagactggacgacaagggtgaaattccaactcaaaaaaaaaaaaaaatttatatatatacatacacatacatacatacattagctgggcttggtgatgcacacctgtaatcccagctactcgggaggtaaggcaggagaattgcttgaacccaggaggtggagattgcagtgagccaagatcatgccacagtactttagtctgggcaacaaagcgagtctcaaaaaaaaaaaaaaaaaatctagccaacaaggccgaggcaggaggatcgcttgagcccaggagttcgagactagcctaggcaacatagttagatcccgtctctacaaaaaataaaaattagccaagcatggtggtatacagctgtggtcccagctactttggaggctgaggtgggaggatcacttgagcaggaggttaagggcaacagagtgagaccctgtctaaacaaaacaaaacaactagctagctagctagctaacagagcagcttattagaaatgtagcatctaggctggatgcagtggctcacgcctgtaatcccaacactttgggagcctgaggcaggtgaatcacctgaggtcagtagttcaagaccagcctgaccaacatggcaaaaccccatatctactaaaaataccaaaaattcaccaggcgtggtggcgcatgcctgtaatcccagccactcaggaggctgaggcaggacaattgctggaacccgggaggtggaggttgcagtgagatgagatcgcgcgactgcacaccagcctgggtgacactgagactccatctcaaaaaaaaaaataaaaattagtcttaggctgggtgtggtggctcacgcctgtaatcccagcactttgggaggccgaggtgggcaaatcgcctgaggtcaggagtttgagaccagcatgaccaacacggtgaaaccccatctctactaaaaataaaaaattagctgggtgtggtggcgggcgcctgtattcccagctacttgggaggctgaggcaggagaatcacttgaacccaggaggcagaagttgcagtgagccaagatcgcaccattgcacaccagcctgggtgacagagtgagacttcatctcaaaaaaaaaaaaaagaaatctagcatctattaagttctgccatggcctgacattcttatatttaaaccagatgaaaaccctgtcagacacgtgtttcctcatgagggaaataacagtcaggtagcttttagaccctgtgctcattccaccctgcgctcattccaccctgccagccctacaaatggacccaggctctgcatttgagagctgtaggagaatgtaatatttttgtgtgtgtgtgtgagacagagtcttgctctgttgtccaggctggagtgcagtggcgtgatctcggctcactgtaacctctgcctcccagagttcaagtgattctcccacctcagcctcctgattagctgggattacaggcatgcgccaccacgcccagctaatttttgtatttttagtagagacggggtttcaccatcttggccaggctggtctcaaactcctgacctcaggtgatcctcctgcctcagcctcccaaagtgctgggattacaggcgtgagccactgcatccggccgagaatgcaattatttataaggaatttgattgcaagcttcagactatctcaaagtgtcaggattttgaactcagggcccagggagcctagagctcagtcctgggattgagtaaatgggtggcagggaagctggcactagtcaggccccagggctttcctttagggaattagtatgtttggaagatgagagtccatcctctaaaaaagaagggatagaggagggcaggtagctgataagccgttcatagtacctcaaaaaagaatagatatagtcgagccatgaatggaatcaaccaatggaaagaagtggcaacaatgaatgaggccccatactggagtcaggttttaggatctctttaactgcttcaaaagtagtcctaagcagctttccagctggagctaactctggtagtgaaaagagaggctatggcaccttgggcaagtaaatcacttcctctctcagggcctctgttttcttcacctgtaaaatgtgaggttgaaccatgacaactcctagaaccattctggctcacaagattgtgcctggattgctaaatctttagtgttttccctgagtggggaagaactcaggttggactaggttctccttttgtccctcctcttttggccaaaccaaccccagagaaggtggccctcagaccatcagctcttagcctaacaaagcctctattgacactgagtaggccagttatgctgaataggccaggcctcacatgcttagcatgttaattgttccttctgctactggccattcatgtgggaatcacaaagacctgggatttatctccctttaactcttctacagctgccctgtagtactgcctcatcctgagactttttaagtaagtgatttaaaacttaccccttgaagcccccacgctattttacatttcagctccactcagcctgcttgcttctgttgttgttcccttccagtgaggcctctgatctgcagtgggctgacaggagttacaaataacccacaggtaaacaggctcagaatagagcctcccctgagtagagcgcttggcctctgtgacagctggctggagcctcagaggccctctttccttgcttctggattctctactagattgggatagtttgggtgccagaagtgcaatttctgggaaattgggagaatcttaaactatttttattaaattattaatagcaatttcagaccccatagcctttgttagcagttttctgatttcctttctttccactgatagctttaggtcctaggaaactggacaggagattggagttacgggcagcaggaaacatggcaggggacccccctccctggtgtcatgtggccagtgtattgctgcttaaggttccagcctcagtcagactgactactgcctcttcctctcctctattccccctcctcagacacaatgggaatatccttttggacgcagaaggccacatcatccacatcgactttggcttcatcctctccagctcaccccgaaatctgggctttgagacgtcagcctttaagctgaccacagagtttgtggatgtgagtcaagaaggagaggtgcctctcgggggtcattgtattctttctctgtcatgggagagggagctgatgggctccctgcaaattagggatgaacagaacaggcagtaattaggggtgaggcaggagttcctgggagcttcctgcccaataaggaagggggaaataacagggccccaagaggaggaggagttctggtaggccagtcaggacagggaccatccccggtgtaagaccccttgtgcacacaacgctctcttccctttccaggtgatgggcggcctggatggcgacatgttcaactactataagatgctgatgctgcaagggctgattgccgctcggaaacacatggacaaggtggtgcagatcgtggagatcatgcagcaaggtggggctggggtgaggtcaggtgctatagtgcctcaggcttcccctttaagtcggagccctggagcataagaaagctgatcccacgagactcggttgagggaggggggttcccagagagtttctagctctggtccagtgccttgtttctcctttaggacattcctcctgaccctggtaaggctaagtccagaaggctggggaaggggatagcagcacctgcctccttggcatctttagggagaaaacaggcccatttacagcctcctggtcccttctcacctccccacccctgtccagctctgagtttctcagtctccttccatctgtcttctccattccactatgacctctgattgccctgtcctctgccacccttcagctctgagaagtatttcccctctcatcattatctccttccactacagtcttgccatctacagtcttttgcccaggacccccttctgtcctcatccccctcctcaaggctccaggtgtataccaggtctgaactgccagtctccccctcctccccattcctgcccctaccccacaggttgtcgccgttgctcaggatcatccccatctggccccatgatgacggtggcccaggtcatctgtgagtgtcagacgtagcataggcagaggtctgcaaccagataagtgcccagctcagggcccactccctccagcctcctcccagcctgccctctgggcccctccacccttactgagggagatgtggtgttggtccccttccttcctctgcccacatgccctcacctacagaagggcttaggcgtggggtgatgaggggttcctgccggttccttctctctgcccaagcagaactgcacccacatcatcaaggacctgaggtgggaggaaaagggcacttcagatgccccagctctgtatttgctatggctgacaccactgcccctcccgtccatccatgaccctgaactccgactgcttcccccaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcactacatagaagtttgctttttccctgcctgtcttggtcactaccacctcttccctgagaagggcgggccttccatgttctctcacccgcttcaactccacat

SEQ ID NO: 37409 - DNA, 83016 bp, Homo sapiens; identical to SEQ ID NO: 35589

SEQ ID NO: 37410 - DNA, 873 bp, Homo sapiens
atggaagtttccctaaaccacccagcatctaatacaaccagcacaaagaacaacaactcggcatttttttactttgagtcctgtcaacccccttctccagctttactcctattatgcatagcctatactgtggtcttaattgtgggcctttttggaaacctctctctcatcatcatcatctttaagaagcagagaaaagctcagaatttcaccagcatactgattgccaatctctccctctctgataccttggtgtgtgtcatgtgcatccattttactatcatctacactctgatggaccactggatatttggggataccatgtgcagactcacatcctatgtgcagagtgtctcaatctctgtgtccatattctcacttgtattcactgctgtcgaaagatatcagctaattgtgaacccccgtggctggaagcccagtgtgactcatgcctactggggcatcacactgatttggctgttttcccttctgctgtctattcccttcttcctgtcctaccacctcactgatgagcccttccgcaacctctctctccccactgacctctacacccaccaggtggcctgtgtggagaactggccctccaaaaaggaccggctgctcttcaccacctccctttttctgctgcagtattttgttcctctaggcttcatcctcatctgctacttgaagattgttatctgcctccgcaggagaaatgcaaaggtagataagaagaaggaaaatgagggccggctcaatgagaacaagaggatcaacacaatgttgatttccatcgtggtgacctttggagcctgctggctgccccgaatatcttcaatgtcatctttgactggtatcatgaggtgctga

SEQ ID NO: 37411 - DNA, 111733 bp, Homo sapiens; identical to SEQ ID NO: 36188

SEQ ID NO: 37412 - DNA, 12740 bp, Homo sapiens
aattggaggagttgttgttaggccgtcccggagacccggtcgggagggaggaaggtggcaagatggtgttggaaagcactatggtgtggtgaggagctacttcggggcaggaggggcagagctgggttccgggcgcgtgtagcgccaaggcagggagggcctggggtgggggccaggggctcatgggcgagaggcggccctggccccggaggtaaggagcccgctggactccctgagtcatcccggggccctggagtggcggatagtcccgggttaccactgttacccccagggggacggtcattgactggtcattcctgcttcctttctctgttctagcgccgtcttctctagagcagcccgggtctgtctttagctacagttctgcttttcggactcatcgtaatagttttctgccctcctttctttgcaaaataacgtctattaggaaaatagattattaatcccttcctctccccattccctcgtctctaacttcattacctttccctgtatcatcttcaaaggtaccatttacagattgctttttatgtatcagtcattttgtttatctcacttatacctcacaaccacaccttaaggtaaattatctctccattttacggttcaggataccgagtctcagcgattttaagtgatttgtccaaaatcatacagctagttaagtggtggagtcaagatttaaacccacggctgtctgacacaaaggctttatccggtgaggtagctctctttgtcagtttcaggcttgggctgagtacctattacgagtcacattagaagaggaggacataaatttttgcagggtttcaagagttccttctaagtgtaatcactgaatgtaatacagaatagttgacgaacacaaatcaccgattgggtgaaacaggcacctatgagatttcttctttttattttctcgggggagcatagcattgccagataacatacaggatgcccagtgaaatttgagtttcagataaacgatgaataatttttttttgagacggtctcgctctgtctcccggactggagtgcagtggcccagtctggctcactgcagcctccgcctccctggttcaagtgattcccagtgattgaactaatttacacttgcaccaacgatagaacagtgttctcttttctcgcaaccttgccagcatctgttatttttttagtttttagtaatagccattctgactggtgttaggtggtatctcgttgtggttttgatttatttgcatttctctaatgatcagtgatattgaggtttttttaataggcttgttggctgtatgtatatcgtcttttgaaaagtgtctggctggggcgtggctcaggcctgtaatcccagcactttggaaggctgaagtgggtgtatcacctgaggtcaggagttactgaccagcctggccaacatggtgaaaccccatctctactaaaaatacaaaaattagccaggcgtggtggtggacgcctgtagtcccagctactccagaggctgaggtgggagaatcgtttgaaccccggaggtggaggttgcagtgagccgagatggcgccactgcactctagcctgggcgacagagtgagactccctctcaaaaaaaaaaaaataataataaaataaataaataaataaataaataaataaaaataaagtgtctgatgtctgttcatgtcctttgcccacttttttttttttttttctctttgagaaggagttttgctcttgttgcccaggttggagtacagtggcgccatctcagctcactgcaacctccgcctccctggttcaagtgattctcctgcctcagcctcctgagtaactgggattacaggtgcccgccaccacgcccagcttttttgtatttttggtagagacggggtttcatcatgttggccaggctagtctcaaactgctgagctcaggtgatccacccgcctcagcctcccaaagtgcagggattacaggcgttgagccactgtgcccggctcctttgcccactttttttttttttcgctcttattgcccaggctggagtgcaatgacacaatctcagctccccgcaaccttcggctcaccgcaacctccgcctcccgtgttcaagcgattctcctgcctcagcctccttagtagctgggattacaggcatgcgccaccacgcccagctaattttgtgtttttagtagagaccaggtttctccatgttggtcaggctggtctcgaactcccaccctcaggtgatccgcccgcctcagcctcccaaagtgctggcattataggcgtgagccactgtgcccggccggtcttccaggatttttatagttttgggttttaccttgtctttaatccatcttcagttaatttttgtgtatggtataagaaaggagtccagcttcaatcttctgcatatggctagcctagccagtatccccagttattgaatagggactctttttcctcactgcttgttttgtcagctttgtcaaagaatagatggtcataggtgtgcggctttatttctagactctctattctgtcccattggtctctgtgcctgtttttgtaccagtgccatgcggttttggttattgtagccctaagtaatagtttgaagttgggtaaagttgcctccagctttgttcttttagcttaggattgccttggcttttctggctctttgttggttccatatgaattttcaaatagttttttctagttctttgaagaatgtttttggtagtttgataggagtagcattgaatctgtaaattgctgtgggaagaatggccaattttaattaattaattaattaatttatgagacagagtcttgctctgtctcccaggctggagtgcagtggtgtgatctcggctcattgcaacctccgcctctcaggttcaagtgattattgtgcctcagccttctgagtagctgggattccaggcacccgccaccatacctggctttcttttttttttttttttttttttgtatttttagtaaagatggggtttggccatgtggccaggctggtcttgaactcctggcctcaagtgatctgcccacctcagcctcccaaagtgctggaattacaggtgtgagccaccatgctcggcagtatggccattttaatgatattgattcttcctattcatgagcatgagatgtttttccacttgtttatatcttctttgatttatttgagcggtattttgtaattctcattgtagagctctttcatctccctggttagttgtattcctaggtttgtttgtctatttgtttgtttttttgagatggagtctcgcttttgttgcccaggctggagtgcagtggcgccatctcggctcactgcaacctccacctcccgggttcaaatgattctcctgtctcagcctcccgagtagctgggattacaggtgcgtgccaccatgcccgggtaatttttttctgtatttttagtagagatgaggtttcatcatattggtcaggctggtctcgaacacttgacctcaggtgatccaccagcctcagcctcccaaagtgctgagattacaggcatgagccacaacacccagccaaggtattttattctttttgtggcagtatgcacatagttcttggccccatgtagtgcatcatggggaacctgctgttgatgtgactgccttgcacatgtgccattgtattacccttttcgagtgtttttttttttttttttttttttgggggagacagggtctcattctgtcacccaggctggagtgcagtagtgtgatcttggctcactgcagcctcgacctccggggctcaagtgatcctcctgcctcagcctcctgaatagctgggactacaggcacttaccaccatgcccagctattttttgtattttttgtagagatggggttttgtcatattgattaggctggtctcgaactcttgggctcaagagagcctccctccttggactccctaagtgctgggattacaggcatgaaccatcacacccagcctgtattctcttttaaaataaaggttttggcggtaatcccagctacttaggaggctgaggcaggagaaggggttaagcccaggagtttgaggttacagtgagctatgatttcaccactggcctccagcctgggtgacagagcaagatcctgtctcaaaaaaatatgtgaaatggccaggtgcggtggcttacacctgtaatcccagcactttgagaggttgaggtgggcggatcatcagaggtcaggagctcaagaccaacctggccaacatagtgaaaccccgtctctactaaaaatacaaaaattagctggcatggtggtgcacgcctgtggtcccagctacccgggaagctgaagtgggaagatctattgagcctgggaggttgaggctacagtgagctgtgactgcgcttgaacctgtgcctgcgcttgaacctgtgcctgaatactaccctagacaggttgagtattccctatctgaaatggctaggaccataagtgtttcagattttggatttttgtcagattttagaatatgtacattatacttaaccagcggagtatccctaatctggaagtctgaagtgctccagtgataatttcctttgaacatcatgtcagcactcaaaactcaaaaactttctgatttggggcatttcggatctcaagagtttctgattaagtgtacttaacctatatattcccttttctgttaatacttgttttccagtaccttcttaattacttctctttaccatttttggtttattgccaaacaaagcatactaaagaaaaaaaaattgccccaggctcacattttgcttgccaatagaaatgagatgtcttggctaggtgccgtggctcacacctgtaatcccagcactttgagaggccaaggcaggaggactacatgagtctaggagtttgtgactagcctgggcaacaaagtgagactccatctctataaaataaaaaataaataaaaaatgtggttttttttggtagagactgggtcttcctgtgttgcccaggctgttctccaactcctgggctcaagcgattctcccttctcggcctcccaaagtgctgggattacagacgtgagccaccatgcccagcctaaaaaatagataaaattctaaaaagaagaaatgagggccaagtgtggtggctcatgcctgtaatcccagcactttggtagattgaggtgggtggatcacctgaggttgggagtttgagaccaacctgaccaacatggaggaaccccgtctctactaaaaatacaaaattagccgggtatggtggttgcatgcctgttatcccagctacttaggaggctgagggaggagaattgcttgaacctggtaggcggaggttgcggtgagccgagatcgagccattgcactccagcctgggcaacaagagcgaaactctgtctcaaaaaaaaaaaaaagaaagaaatgaggtatctcatctaaggcactgcttccgtccattagcacaggtagaaccttaactattagagctctcagggacctcagaggtcatcaagaattgatccttacaggagcttatataactgcatcacttacctgccttcttctggtctttgggaaactcgagattatatttcacattagctggatacttttagatcatgaaaagttgcagggatctaagaggtgagacttcagatccacaaaacctcatttttaccgttcagttcagctgtcaaagctgttaagcatttaatgagatgattgcattgtacttttctgcactcagtgctgccaagtgtgtgttattttatagacctcttttttttgaggcagtggcacgatcttggctcaatgcagcctccacctctcaggttcaggtgattctcctgcctcagccacccgaatagctgggattacaggtgcctgccaccacgcccggctaacttttatattttttagtagagatagggtttcaccatgtttgccaggctggtctcaaactcctgagctcaagagatctgcccacctcggccccccaaagtgctgggattacagttgtgagccaccatgcctggccctattttatagatttttttttttttttttgatggagtctcactctgtcacccaggctggagtgcagtggcgtgatcttgactcactgcaacctcggcctcccgggttcaagcaattctcctgcctcaacctcctgagtagctaggactacaagtgtgcgccaccatacctggctaattattgtatttttagtagagacggggtttcacaatgttagccaacactggtctctaactcctgacttcaggtgatacacccgcctccacctcccaaagtgctgggatgcacttgggaggcataagtcactgtgcccagcctattttatagattttttttttctttttctttttttttttttttttttgagacgaagttttgctcttgttgcccaggctggagtacaatggtgtgatcaccacaacctccgtctcctgggttcaggcgattcttctgcctcagcctcccgagtagctgggattacaggcatgtgccaccacgcccagctaattttctacttttagtagagacagggtttctccatgttggtcaggctggtcttgaactcctgacctcaggtgatccacctgcctcggcctcccaaagtgctgggattacagacatgagccaccgcgcccagctatagatatttttaagttaccttcttcatttcctatatttggattactgccatttaatggcagacttagagtatttatccatgacaaagcttagtagcacttaagtgcagcttgtaagaaattgctgtggttcatcagtagatcaccacctttggtgctcatcagaatcattttgtaaggatttaaaaattttttcggctgggcaccaggtggctcacacctgttatcccagcacttggggaggtggaggcaggaggatctcttgagctcagaagttcaagaccagcttgggcaacatagctagatccctgtctctacaaaaaaaatttaaaaggtagctgcgtggtggcttgcacctatagtcccagctacttgggaggctgaggtgagaggatcacttgagcccaggaggtggaagctgcagtgagccattagtgcaccactctactccagcctgagtgacagagcaagaccctatctcaaaaaaaaaaaaaaaaaaattcctcattggttattctgagtcaataaatgtgggctaaggcttgatcatctgtatatttaaaaaagaaaaaaagctacaggtgatgctatgaagactgctgctatagggggcctctggaactggagagaaggttttggaaaacttctacatttcttctctcttgtccttcaaccctaatctgacagtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaagtatgggggacagaggaggaggggactcagtaggtgggtggttgttacatgctactcttctttagattccatgaagctgcttttgcccatcaccttcctagactgccttctgcactatttagtgtaaatgtcaatagcaacttgttttttgtattaacctgtatttaatgtagtacggaagctaaatctcctggggtgaaatttctgtttctttttattgtttgttgggcagggctagggtagggggtgaaatttcataatatattttaaagtcagtgaaaagtgattttgggctgggcacagtggctcatgtctgtaatcccaagagtttgagaccagcctgggcaacaggacaaaaccctgtctctactaaaaatacaaaaattagccaggcatggtggtggctacctgtaataccagctactcaggaggctgaggcaggagaatcgcttgaactcgggaggcggaggttgcagtgagccaagatcacaccactgcacaccagcttgggcgacagaatgagactccatttcaaaaaaaaagaaaaaagtaatttttggatcagagcccctgggcatatatcactcatccttttaccctgaaagtgttttgttttaggaactgataattcttaaatgagtagcctcccactccagtgtacatactgttagctaggagaatgggtctggaggtggagaggacaggagagatacaaattagcatcgttattttggtggattctcagggccctgtgagcctttaaaaggagttaggggaaaatatttggaagtagagggcagctttcttacaaagccagccacttaattatttctgtgcttggtttccattaaatactagatgtttgattgagaagaatagaggccaagcacagtggctcacgcctgtaatccctgcattctgggaggccaaggcagacggatcacttgaggtcaggatttcgagaccagcctgaccaacatggcaaaaccccgtctctactaaaaatacaaaaattagccgggcgtggtggtgtagatctgtaatcccagctactcaggaggctgatgcacgagaattacttgaacccgggaggcggaggttgcagtgagctgagattcgccactgcacgccagcctgggtgacagagcgagactctgtctcaaaaaataaaaaagaagaatagagattacaattagaatagaaataatggttattatccaggtctttaaagaaaagtcagacacaggccaggtgcggtggctcacgcctgtaatcccagcactttggaaggccaaggtgggcggattacgaggtcaggagatcgagaccatcctggctaacacagtgaaaccccgtctctactaaaaaaaatacaaaaaattagccaggcgtggtagtgggtgcccgtagtcccagctacttgggagtctgaggcaggagaatggcgtgaacccgggaggcggagcttgcagtgacccgagatcacgccacgcactccagcctgggtgacagagtgagactccgtctaaaaaataaataaataaaagttagacacagtttagaggtacttgtgctgacctgaattcactgaaatgcttttcctacatcccagtgactgtgaagtgctgaccacactcaccccagacactggccgtatcctgtccaagctacatactgtccaacccaagggcaagatcaccttctgcacgggcatccgcgtggcccatgtgagtcctactgggttccctggacctttcctccctgctctgaggtcctgcctccatcatactcatttctcccctggaatcctgagctaggaccagagcaagagaaagctaacttggagtagaaaggatatgggggatgaatcccagggtagttgagggttgtgaagggaaaaatccctagaattgagaattaaggctgggcgtggtagttcatgcctgtaatcccatcactttgggaggccaggggaggaggattgctgaaggctagcagttcaagaccagcctgggcacatagggagaccctgtttctctaaaaaaaaaaaaaaaaaggccgggcgcggtggctcacacctgtaatcccagcactttgggaggctaacacgggcagatcacctgacgtcacgagttcgagaccaatctggccaacgtggtgaaaccccatctctactgaaaatataaaaattagccagtactaggaaggctgaggcaggataatcgctggaacccgggaggtggaggttgcagtgaactgagatcacgccactgcactccagactgggcgacagagcgagactccatctcaaaaaaaaaaaaagagagaaagagaattaacctcccttctttatgcacagagagtcatagcaaaaagggaggaggtgggggtgttaaatcttgtgtgaacgtgatggtagatggtgtacttcaggtacaaagaaactgtaagaaaaagggaaccgagtgacagaggaaagagctgagtgattcctctggttaactctgagaacttcctctccctttacaagctggctctgaagcaccgacaaggcaagaatcacaagatgcgcatcattgcctttgtgggaagcccagtggaggacaatgagaaggatgtgagtccaagtggcagctggggaatgtggggagcccatgtttgggactgaggtcttccagccctcaggagaacctggcagaggcatcaggctcatcactttggggaaaggtgaatgtggagaattcagtgattctgttggaggaccttggggaggtcaatagatttctgtatgcttttatgcggcgggtcctttccccccctcgagtatggaacagatttcttgatttttctccccttcttcccagctggtgaaactggctaaacgcctcaagaaggagaaagtaaatgttgacattatcaattttggggaagaggtgagtagggactgattggagggcattgacttaatttggtcataaacagaatggtccttaaccctgaggagtgcgggtactgtggcagagtagtgcagaaatgggaaagaacagggagcaaggcctgaagaagggcatcatgtgttctttcctccccaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggtgagcaaatgttgaccccaggtagagtccaaaggtccctctttgttctcttctggcacacacatcacagagcttctatcaggctggatagtcctagacactaccaatcactcattttccaagacctccttttgccgcctcttccctataatgctgtctgatctctaggggcaccagtgtcagatgctttcttgttcacttctgatgaaaaccgaggcttctcccaagtccttactttttaatcccgtaccactgcttatccctccagcttcttctctgtgtgataaaccagaagctgcccctttatgttcctttcccacaccccaactgactttcccagctccctgtaggagtgagggcaggggagccctgattatgccctgcccttcaccaggcccttcgtgtatctatggaagagcagcggcagcggcaggaggaggaggcccggcgggcagctgcagcttctgctgctgaggccgggattgctacgactgggactgaaggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctcctcttttccttttcccagactcagacgatgccctgctgaagatgaccatcagccagcaagagtttggccgcactgggcttcctgacctaagcagtatgactgaggaagagcagattgcttatgccatgcagatgtccctgcagggagcaggtgagccagagcctgggtggtgcctaggcagaggttggggtgaggaagtgtaactgaacagactgacctctcttcctcagagtttggccaggcggaatcagcagacattgatgccagctcagctatggacacatctgagccagccaaggtgagacccaaccctgcccccatcaggtttaaagtccttgaatttagatcctcatccctctggggctgggagtatttctaccatagctaagtcctttgaggagcagagggaaacacatggatttgcatttcttacatgtaaaccttgctaaggtagcaatgctaatggtcagagttggagaaatgtcctcttgttctgtaattttcctttcttgctggtgggagcagcctgggcagttctctaggatgtcttcccaggagggaaaaaagcgggtctgggaaaaagaaaaaggagaactgggtgtcttgagagcaggaaacctcaatgtgatggcatctgtttttctcctcagagctcaattaacagagttctcagcaggcccctctatttggttagtaataactgcattcatgctgtataaaggattttgctgacttgtcctttccttacgtcgaccagaggtgcccagatccccacacagtcagaaggcagggggcctctggcagcggcatgctcctgtccttaacacctgcttacttcctgccgctccataccctcccttgagctcacactgcctgtttgcaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 37413 - DNA, 17550 bp, Homo sapiens; identical to SEQ ID NO: 37035

SEQ ID NO: 37414 - DNA, 418196 bp, Homo sapiens; identical to SEQ ID NO: 37368

SEQ ID NO: 37415 - DNA, 166963 bp, Homo sapiens; identical to SEQ ID NO: 36366

SEQ ID NO: 37416 - DNA, 75611 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcgtgagtactgaccgcgggctgaaacaggctgcctcagggatgggaccctaaagccgaccaaagttggggctgaagttttgtgcgcgcgcgtgtgtgcgagtgtgtgcgcgctttactgagagaaaccagctgtgcacacaaaaggaccgagttttgagcacgctggttctgagggcctgggatgataagaccgtgcattggaggacgaggactctgcgactttcccgtgttctaataaattctgcacgttcagattgtccttctaggaattaaccaaaacttgcctttaaagagaaaaatgatgcatgtctataaattttccgtctgggattagtgtggtccttactgctacttatttccttctgttaaataattggtcaaatattttcaacatgggggtggaaagggggtattgaaatagctgtcttgtttctaactaacttggaagagatgtaattggttcagacctctttagggccgctcaggatacttcaccaagaacagaggttggaattctttccgtttttcaaagacacaccctccttttgctttgagaaagctgcttaaagttgtcctttttgactattactccaaaagaatatttaagttccttgcatgttttaaaaatgtgacttcaattgtctgccttccaaaatgtttccaacttttttatgtagacccctggccagatggaaatgacatcattgtatataacttttagcaaagttaaaaggaaaaaaatatgtacgtcaatattcacatgaagaaaattccataattttgggaaaaggagaaatgcaaatgtaacgttttccttcaattatttgcagccggttgttatgacaatggaaaacactatcagataaatcaacagtgggagcggacctacctaggcaatgcgttggtttgtacttgttatggaggaagccgaggttttaactgcgagagtaaacctgaaggtaagtgacaacaagccccatagttagtatcttttaatacatgaagtggtaattgttaaactttgcattagtaagtaaaaatacatacaccatttttctaatagaattacctgtcatttcctcttaagtttaaaaactgcttatatttgcttttcacatgcttttacctttaaaacaaagaaacgaatctttcccaaattagttcctagagtcttctttttgctttactctcccaaagtttttgatgagaaaaatgaaagattttgtgtgtcctccgacaaaaaaaattgcttataaaattttaatttattagaaagcagtctcaaatcttaaactgttagtttatgagccagaaaacactttggggacttacatcgtaaaatgatttgtcagcggcagttaacacaaaaccattagccacttcaaagttctcattcctttaggaccaatgatatttttctcataaattatagcaactctgtcagagaagcactgatcaggggaaaatggaaatcataggattaacaactgtcaaggccttgtgggaggtggggatcttcgaattgtttgtttgtttttgttttgttttgtttttgagacagagtcttgctctgtcaccaggctggagtgcagtagcactatctcagctcactgcaacctctgcctccagggttcaagcaattctcctgcctcagcctcctgagtagctgggactacaggcacatgccaccacacccagctaattttcatatttttagtagagacggggtttcaccgtattggtcagggtggtctcgaattcctgacctcaggtgatccacccgcctcagcctcccaaagtgctgggattacaggcgtgagccactgtgcccggccaatcgtttgctttttatgtgaaccttgctttgactttctgagtcagagattggaatgtgaaacccttcacaaatctagctctgtcataagttagtactttatatggccttttcctaagagcctgagatttttctacaatatgaataatttacagaaaatttgacaatatgtcaaggtcaaaaaccatggccttattagagcttaggataaaaatctgtatctctcacttcattttattctttgaggtgtaccatgttacttgtggaatagagaagtgggttttcctttagaggggattagtgaactagaaaagcttgtacctaagtgaggctcacatggactttccttttcccctcagctgaagagacttgctttgacaagtacactgggaacacttaccgagtgggtgacacttatgagcgtcctaaagactccatgatctgggactgtacctgcatcggggctgggcgagggagaataagctgtaccatcgcaagtaaggaagagattgtgtaaaatgatgccaaaatatcaaatatgaatttctctgttaccatcactgtcattttctgttatccatgactggatattccgaactttgaggtttgcccctggtgaccaggtactcttaagtggtcacccaactggttcctgtgtttcttaaagacgggtatgagcacagatggaatcagtgtttgatgtgtgtgcgtttatgagtgtgtgtgcatttatgagtgtgtgtgtttctgtacatagtagaaccaagagacctcttgggttccatttcagtaagacatgcttaggggagttgcccattttaaatcacctggatatcttcaagctagacaaatcatgagacttttctgcagtgactgggaaggtgttcatgaagagtgaaccagccatgtgttgtctggtcttcatgtttgcaatgcagagacctcttgcacctcacagaaacagtctggtttcttggtgaccagtaggttatacccaggaagcagatgtcactattcctagggataatacaaaattattaacccaatagagtttgctaaggaactttgggaaccgggctgattctcaactctagtttagctaaggcactctttccagtatgattcactgggttaccaatagattctattaagatagtatttaagttttttaatccattctttaaatataagtcgtcttaaagacttctattcaaaagaacaagtcccgtgtgaataggcccaatcaactttccccatatttcatgttagggtttatccaagttcacaggcaaatcgcaagaggcaagggtccatagtgtttacaatctagttcagcatttgaatgtgccattgggcttaacaacttagaaaactaccaggatttccacactttatatgcatatgtctgtttgctttccaccaaaatgacatttctatcctagggtaaaatacaggctctccatgctcccaaaagctggagtgctgtgcctgatgtggccttttcactgaattagtctcagtcttagcctgctgtgtatgagtgaagaccaagcctcccagcctttcttttctgcttaggacccaatttcctgtgatctctctgggaaagcaggattcatgacctcttccttgccatccagatttctctgtggttttccattgtgttctaagcaagacacttaactgaattgactccaagtgaccagacctgttaacgtttcccctgtctctgatgggaaagctgttgtctgtgtctctactttagccaacctaagtacctaccatgggtggaatatgagaccaaaaaaaaaaatctgttctgccctctcctaacattttcgttgtatcttcaacagaccgctgccatgaagggggtcagtcctacaagattggtgacacctggaggagaccacatgagactggtggttacatgttagagtgtgtgtgtcttggtaatggaaaaggagaatggacctgcaagcccataggtgtgtgagtcttagggctgagcaagagctgggatgcttagttctaatgtggggttggaccagaatcacatctacataggtcatagacctgaattccagtgaaaaccaataaagaaatgggaattttgtttgaaataatgaattattatataatccatagtcttcttacaggagttagatcaaaaagtactgactacacatagaagtcttaactttgcttcaaaagcataaggtagaattgaaagatttagaatggagtcatttcttttacctaatagctgatctcagattcctccttcgtcaagatataatttatttaaaagaaaaaaaaatgacactttggacacatttctatatggaatgtcctggaccgaaacatgaaatagtgtgtgcttgtcacactctgctcatttcttttcaaattaaaagttgttgagcttctttggatctcaatcctcagttgaattttgtaagtacaagcctgaaagtttctggctataaattttactctgtttacttgtcttctaatttagaggtttttgtcttgttttgtattgttttgctttccaatatttaaaaatagctttctttgtcattgtatttaggccactcaaaattcataattggtcatttataattaagattggaattttgcatatgtagtctcccacagactagatacatacatagatccttgctactggaaatgctgctgggaagtttggggctcgctgaaaatatgtagtccatgtacttattaggagaatggaatttctgcctgccaactcagcttgagctttcttttgccttggctacttactgtgtgcttagatgctgggtgtgtcattctttctgaacagagtgccacttaaaaaaaatgtggctgaatttttgcttacacactacactttaaattacagggagcttgcacaattcaaaataacctttttttcctgtttttcttccaaatttccctacagctgagaagtgttttgatcatgctgctgggacttcctatgtggtcggagaaacgtgggagaagccctaccaaggctggatgatggtagattgtacttgcctgggagaaggcagcggacgcatcacttgcacttctagaagtatgttttacatctttatgttaaagattaagccaggtattgttttctggattcctagagagaagggtaatactatgttactcagaacacatccagtatatcagcatgctttggtaacttctggaagtcaagaaaactttcataaccaacttattccgcatcttcagagaagactacataaatagaaaaacatatcactttgataaggttcaatctcagctcactgccactgacatagagttgaacaaaaggtttaggtttccttctatgtttgaaatttaaatagggcacattcacaggctaaattgataaaattaaaaagaatttatcccataaattaaaatgatttatctactctggagttagggatagtgtctctgacctaacgcatttgattagtgctgtaaagaagctggcctctggtgtctttactgctccttctaagattgtcttggggtcttaattgttgcctttgggtttgaaggctccttttttgatattgtaaactaataacagctagagagtttgttgaagtaaaacagccattaactactggtgttgtaaataagtttaaaatcaaatccaaataatttgaacctgttttatttatctagctgaacccatttaactacctttaacatagccatcatccaaattcaaattctttgctaacaaaaataggtctctcatgaaaagtggtaaccattttgaccaaagctttcccagaaacttgctggtttattagatattttgcatttaaaatgttactgtgatcatcagacttccaagatctttgtggcaatattttagcttaagacaaattagatgtctgattcaaaccttatctgttatttagaactctttaaatagcaagttgggaaaagtttctcaaagagaagtcatttattccagaaaattttataaggacttactttgttcaaggtattataggggtgcagatatgaaatgaacattagcccagccttcaaagagtacttagggggtcagggagatgagaaagtcttatacatatttatcatctgcaaaacacagtattaaagatttcaacagaaatactgaaagtagtgctatggaggttcaggggatgataatacttttcgctggggatttgggaaaaagctctaatcagtaattataccttcatgcaaacttctattcttgtggtagatggatgtgggtgtgtatttgtttgaacctacatcaactattaattttttttctctaacccaggagttgcaacaatatccaattcacaaagacatcagatcctctatactcacatcgtggcacagagcaaatttggattataatttaaataatctatttaccagataaatgcacgcatagactaatggtcatttagttacaaattatcattttatgttgatcccactcttccagtggagggctaacactgaataatttggggctattttgctagtgatttttaaatactgtagatgtttgggtataggggaagggaaaataatattttagtcaaagaaattgtgcatcctctacattttttacataacaaatgaagaaagagatactaccaccttcttatagcttctttgtagccattggtgaagaccctttgatacctgcttgcctccccattgttataagcttttttttgtttgcttgttttttttgttttgttttgttttgttttgtttttgagacagtctcaccctgtcgcccaggctggagtgcaatggtgtgatctcagctcattgcaacctccacctcccgggttcaagcgattctcttgcctcagcttcccgagtagcttggattacaggcgcccgccaccacagccggctaattttttttggtatttttagtagagacgggggtttcaccatgttgcccaggctggtcttgaactcctgactgcaggtgatccaccctcctaaagtactaggattacaggcgtgagccaccgcgcttagcctgtttttagttttctaaagcaaggtccctattgaaaggcaggccataaacagtgatgactaagaaaaatcctggaagagcctgagaaggaaaaagatgaaatataatgccagagaatgaagttagtcaaaggaacagtgtgaaaacaataaataaatagataaatgaaaatgttatttgacagagagatgaaactagactaaaccattcagctgcctttccactgtaacaaatgtaatttcatctttcagaagtgtaataccttgcagcaccagagctgaatatgaacatattaccaaaaatagattaccaggcatagatagcattccttttttaagtttgaattgaccacttgcgactctcgacctgatgtatgtatgtgcttcctttgtgacacagatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggtgaggcacaggacgagcaggggcgggaaatggggaagcaggtcaagaaatatttccgcaaatccatctttcctttgacatgccatttgaggataatttgcagtgtttcagctaataacctaagataatttacacattattggttgttaaaactttttttaatgtcaagttttaaatttttcagaaaaaaagaaaaatgacatacaaataaaccttagggggaaaaaagccagatttatctccaaaagataaaactgagttttaaagaatgctagcatcataaaacttaccatggatagatcacgcacacacgcacacacacacgtattttgaatatccaaagttcatttgaaaggaaatgagagttataattaattatatgactacctggttcttctgctaggaaaggacaaaaaaagtgcatttggattttttgtttgtttgtttttgaatgaaatatacttccctgtcccgacattgaactctttttgtagtggaaaccatcctttatatgtggtttctatgctctggcaaactttgttacattctataaagtaacacacaattatttccttcatgtattggcattcgaaattttagaaattcagagaggacttagagatggccatgaaagacatgatatctaagcattctttttaaaaaacaagttttaatcatttttggcatgagaaaaagatttttacgtcataaatgtttcataaaaatctgaagagagaaatatggccaacaaggacgtgcactcctctcattatttttaatatgttttgattaactttttactatatgatgtgccaacatcattacgtagtgtctcagccatccttcaattaaaaatattaattgttctaatttttcttcttttgatgagtttttgtcttgctttgagcacttatgaaggtgaacaagattagatttgataatatctttgagttattttattatcattaataaaattgctactggccaaaaaaaattataaacatcggccacgcgcggtggctcacgcctgtaatcccagcactttgggaggccgaggcaggcggatcacgaggtcaggagatcaagaccatcctggctaacacggtgaaaccccatctctactaaaaatacaaaaaattaaccaggcgttgtggcgggcgcctgtagtcccagctactcgggaggctgaggcaggagaatggcatgaacccgggaggtggagtttgcagtgacccgagatcgcaccactgcactccagcctgggtgatacagcgagaccccatctcaaaaaaataaaataaaataaaaaataaaaaaaattataaatgtcagtctaccaaaatagattaaaagtgtaggtgggaattaaatggggataaacactcaataaatgttagctatatatgaatattgccaatactgaaaagattccattgttcaaaaaagtttgagaagcaatgggttaaacaaaatggaacctgctctgcagaatctgtgtgttcctttacatcatactctccatggtagagtgtaggggatgggcgccatgtctccctagtacgtttgaccttgggattctttgtctgtgaacatctttgggttctagtgttcagcagcacttagggaggcactgaattcagtgtacctttggtctagcctcagccctgattctgttctgcggtgggccctggccttcaagagaacagatatctaaaagttgaaagaaaagatcggccgggcgcggtggctcacgcctgtaatcccagcactttgggaggccaaggcgggtggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccgggaggcagagcttgcagtgagccgagattgcgccactgcactccagcctgggtgacagagtgagactccgtctcaaaaaaaaaaaaaaaaaaaaaaagaaaaaagaaaagatcaacacatcctgttgtgttattctgaaaggaaagctgtcttaagaggatcaattggttttagaaaaaacacaatagaatcacaaataatccagaggagaaataaaatgtggaaggtggaggtgacctccagaaaatccaggacagctgctgaaggcaccctctgatgagctcggttactcagaagagtgaggatgtgttgaaggtatctgctgtatggagtggcaggatgatgtctgtgattgagaaatataatcccggccaggcgaggtggctcatgcctgtaatcccagcactttgggaggccgaagcgggtggatcccctgaggtcaggagtttgagacaggagtttgaggtcaggagtttgccaacatggcaaaaccccgtctctactaaaaaatacaaaaaaaatcagctgggcatggtggtgcgtgcctgtaattgcagctacttgggaggttgaggcaggagaatagcttgaacccaggaggcagaggttgcagtgagccgagaccgcgccactgcactccagcctgggcaacagagtgagaccccatctcaaaaacaacccaaaaaaccaaaaaacaaacaaacaaaaagaaatataatcccagtagccccagctgagctggaggatggagaccacttggtagacacttgtggattatttcctaggctaaatgcaaaagctactgctgaataagggacatttttttccagtcccaggccagtagcgacatagatttcagagtgatctctgtgagatcctgaagatcctgactgcagaaagtagtgaattgtcttctctcacccagttttgtgacattcccttttcatgccattaggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacaggtatgcattatctttttgaagaataggactgatgactttattatttagtttttgaaggacaatacattttcaatgtgaaacaataaaacaaacaagaagcctgtaatcttaccaccctgtgataacaattagggttggcatttgaaatagtttcttccaatctttttaatttatgtattttctttctggtcatggatatcatgggtaaaaattttattgtatttatctgtctaaagtgttgttacaagagagctactttctgaataatcatcaatgttttatattctaaatctcaaatttcagcagctttgtgatgtaaacatcttccaataacctaatatatgtattctgcactacaaacatggtagtcactatggcaataacaattgctacacaattctcccccagaatagtctcatatattaattttatggcatagatatagtcataaatattatcccaacatccttaagcagcatccttaattgacctgtataaatatagctttacaaatagagaaactgaggcatggcagcagaagtggtcatgaaggacatcagcagaagaactcaggtgtcgttctatccacagtagacatggattcctgagtaatgcattttgactgaaattaacgagatgatcatctatactcatagcttcttcctttgagggcacaagctcagtatctcattgaagccataaataagcagctgctggtgggagataaagcatctctgtttactgacactcttttgattatgattgtagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactggtgagtgtcccaagggggagccacagaagtgagaaaaactcactttcatgccctagttttatttgccagcattctagccatttattttgaacccgcccaagaagcatcgcttttgttcagtttggactcaagagatcgcagcgctcacgtaacagctgaggattcttccatcttccccagtactgttgggaaatgacaccaagggagtagccttccagttcatttgatttaacacattgggattatgatgtgattaaagatacttgtattttggaatcagtagatgatcccacagggctgaggaatacaaaggatgaatgttttagtgccttagcttattttccagttaaaacaatgttttattcaaagctatcatttaatcttttgtggggggggtgctggggaaatgacagtgaaagtgggatttaaacctgttttgaaggtgtgaaggtaaatatgctaagaagcttagaactatattatcagacattttttattctgagatagactgtctgtgaatgagctgcagaaacctggctctctcagaccagtaattctgtgtacattggaaagctcagcggtaatcttttccttctttgttgtgtattgttcctggcagttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctggtaagatgaagcccttgtgggttgtcttgtttgacaacaatttagggagtagagactaaagactagtgtccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataattacttatttgtaagtctggaaatatgaatttgcacaggtttgtctttgtaaagagcacacaactgagtagcttacaacatttaatatatgtatgacggctttagtcacagagctacaatattgacacatggttgtggtttgatgggcataagctctatcacttattaataagtgccaaagtgactaaaactcaatgttttctaacaggtagggaatctcactctttttttaaaggtccccagtttgtatagatggcgaacaaatggaaacgaataccttttacttgttttcagatttcaagaaccccatagattccctttaattttccagttgtagaaacaagagcctgggcggtaggcactgtcaagtgtgactatgagacaaagaaattgcttatacttttatttctttcaacaaaagaagatgctgagtttagaagaaaaaacccacttttgcttgtaattctatatccaaacccatagtttttatttgatccagaataaactggaactgggaaaagttatgaagctgtagttaaatccaggcttctagaacagcaagaaccctttgtgtggatgtgtagatattatcttagtttaacatcccctaacccttcctgtaactattttctatgacacgtttggactacgttttctgcctccagggctcaaaaattctaccccttcacctgacagcacttagatgtctttgatgcacacaaagcttcttcccaagtgagaattcttaggatgaccaaactgaactgatccttttgcacacatacatgtttagacctggtgatcatttatcaagtgcatttcttatccatttccaaacagcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgaggtatgctggctgattaacaaaaatatttgagatggcaaaaggtacagaaagggacacttttttttatgaaaacttgcactatgccaaaagcaggggaagaaatatggaatgccacgtcattcattagtctactgtgcatggtaagataagcctgaaaggcttagcaggcagcctgctaagacaagcggcatagcaatgctaatgttctgaaacactcctagcatgtaagtacttaggctgagccaaaaagatggcttcaaaagtaagaatgaaacatttgatccattcagctttaggctatgccactggattcatgtctagaaaagataggataatttctgtaaagaaatgaagaccttgctattctaaaatcagatccttacagatccagatttcaggaaacaaatacataggggactaactttccttgttcagattagtttttctcctttgcacccagctatataatatgaggaagtattgactttttaaaagtgttttagttttccatttctttgatatgaaaagtaatatttcgggagaaccctgagctattaataatctatgtggctagtgcgtagatattggtctgaatttgttctccttttgtggtgtccagtgggtaacaccatccgggagtaataattacatgtggtgttgcagaactgaaagagaccttaataacacatagagacctcactctatatagatcaaggagctgagacccaaaaaggaaaaagtaattttctcaggatctctcaaagagtgagcaacagagttggcctaatttattttagcgttgtgaatactgttgacattttatttcccaaatctaagtatctcctccccttccccctattccagagaccagaccaccacatcatgctgggtgttagataaatatgtttaatcttcttcttatttatcctaacaagcagatatttaaaggaaattatcaactaagcaagaaattttcagaaagtaagacatgtatttgttcaaatactggcttctcacaggaaagtgtattttaccacattctttacttgagcatactgtaacctctgcaaaagttacacattttgggaagaaaaaaatttttttggcaaaaattgtattactgaccaaactttgaaaaaaatgttattctatgcttgtagaaaagttattttagtggaaggtgttgataattaagtggaagtagttgtatgctttgagaagcataccttttttctttcatcaatggaactttaaaaagtttctcactcacccacctgtttcctaaacagatcagtgcattgttgatgacatcacttacaatgtgaacgacacattccacaagcgtcatgaagaggggcacatgctgaactgtacatgcttcggtcagggtcggggcaggtggaagtgtgatcccgtcggtgagtagccctatttccctagatgagtttgcacagggggaatggttagcaagtttcagataagaaaagctatgtgaaatcacatgactgaagttggctccagactttgatcagttgcttgcaaagaactttgcaaagtcttctctctaatactggaccaaaatatctcgatattggtagtcgtctggtttttgctgaatttggtgacaaatttaggcttattttaattgaatggaatttattcttgggtttagaatcataaagataatccatgctattaaaagtattctttccttttttttttgtttgtttttgtttttgtttttgtttttttgagagagagtttcgctcttgttgcccaggctggagtgtatggcacaatctcggctcactgcaacctctgcttcctgggttcaagcaattctgctgcctcagcctcctgagtagctgggattacaggcatgcgccaccaggcccagctaattttgtatctttagtagagatggggtttctccatgtgggtcaggctggtctcaaactcacttccttaccagctgtgtaacagcatgagcaaagggtgtaaatatcacccaccaaaacactctaggtttttttttggccgcccttcaaaatagaactaagcaaatagtgaaggctgagccttaaaagagctgtgttaccagcactacaaagtttaaggtgatccattactatttctttaccaaaagagacaggttgctcactgagaaaacaaactgataacatccgtttgtttgacgtgagattaccagaactgagagagaagcctgagaggttttcttagaagctgctcagcaggtatactcgtaaagtctagttcattcatttaaatgtcaaacagtttctttaaattttgaagaagtaaggaaaatgaaattattgcagatttttttcttgctatttaaatgttaagccagttatattaatatgggtaaaaataataactaatatttaaaattaatgtgtagattatcaatatacactgaaatctaaatctttacatttttatttagaaatattaccttttagaaaactaaatattcctcctaataggtactttggttttttttttactacaaactgtcctgtaaggtaaagaatgtgaacaaaatatttttttaactgcatatatttgtaagaacaattgcaaatttctatttaagctaaatgtatgctctagcaccctgaaattaaattcgtagttataagtcttcaaggctgtttatcttttccttccatgtattttagaccaatgccaggattcagagactgggacgttttatcaaattggagattcatgggagaagtatgtgcatggtgtcagataccagtgctactgctatggccgtggcattggggagtggcattgccaacctttacagacctatccaagtaagtagctctattactgcaagttgagaactgccaattgggttataacaacagggcagtgattattaatgctctcatgcctaagttgggggtctcccctctttcccacccttttctcttgttattatctaataatcaattgaatttttgattaaaataatttttctctcttcctctatcaagtaaaaggtagagaaggctatgaaaatgtgcctgtttataattttacttcttaactctgtaaaatattctgttaggttaagacactctggctaatttcatcttatatccatacatggaaataaaaaccaccaagtgagttatgctgggagtaaaggtttggggctttatattatgattcttaacagagaagctgcatagagagatggcatgaaatgcagcataaggtacgtgttcattcaacatgtcatctaagctccctttgcatcaaacttttcatttgtttgatcagttgccaccaggaacacagtatgttgggccaagggttgagtaacttggtcaactctctgcccacacagttcaaacactctcaaatgtttattgctgggtttttccaggtcacaaagacatcatgcctagctgtaggtgtaattagttcatttggggggaaaattgcatttaaatattcactgagtgattataataaaacatgttaataaaacatgaaaggctaattaaaaggcatcagttatttgagcaactgctgaggtgcaaagtctccaaagtcttcactaacgtttgactgaaaatatggcctacattcagaaacaaaagagtttcagggtgtcagaatctgcatgcgacagaaattaagattaactctgtgataaaagattcactgtgacagagaacaagctatgggaacaacttggccaaaggtagtgttagccaagcctcattcctccatttcctcatctgtaatatgggaagattgtagctgattacctttaatgttccatcctaaatactaaacacccagatgcaccttttctaggaacttggaagattctgcttttcccaaccctcagacactgtcagtgctggggaaggtgacttcacttttgaaggcttatagcacagattgaccaacctcctaaattgtatttcttggaggatttaggtgtaggaatcacttaattttttgtaacttaatatatatttaaatctgattgtggaagtactataagtatatgaatggtttgtttgtttatatgatgcaaatgatacttaaatggtagaaacttctaaaaaaatgctctgtggtttctatatttatgattgttattggtgttgcaatttgctgaaaatgatttccttctgaatgattgagagagatcttcgtctctctcaacataaggctgtccacatagctgcttgctggaagcatttaggtggacatgttggagataaaatctggaaaggaaggaatccttgagtattggagtattacatgttgaccttactcctactctttaaaaaggagaacagcaagatcccactgagcatagaggtgatttcggagggaagagattggaatttgacctcagatatgctctttggtgcttatctgtatgtctggtttgctccgtggcctagcacgtagggctttaagagtgtggtgagaataagggaacagcagattaccaacagattgtctctgagtcctgccttgtttgttcctcctacagagaacttggtagagttgttcaaactagcaaaagataagaggcatttggtttgtcaataagcaactagaaaagcacagatctcagcaaaataaatagagaaaaaaaggactgagtcaaaaaatcataaatgtttaacttctccaaggacactactattggaaattattcatttagactttatttgaaactaattttaaaagtgtagacattgtactatctcctttttttggtatcatctcaactattttattgttagtttattcatattgaataagagagggagtaaagatttcacaatggcgatagctagtatatgccaattaagttaatttaaaaagttataccaactaccagtagcgaaaaaggactgtcaaaagtttaaatctaaataatgtaaaagatgtcataatttttaacttttctgtctttaaaggatacatagtataagctagagtaattatacgtagtataagctagaatataggaatttaattgatctaagaaataactgacacaaagtctctttacttcctgaacaaaaacatgctaaattccatgctgttcagtccatttcctttaaaggtgggctatgccacagggctagattttaaaacgtggaatttcacaccagtgctcgaaatcttatgaaagcaaaagggacctctgtagttgtactccactttggcttgagtaaaaaccactgctgtaccctttttctttcctttccctgcccatttttatcctcctccttgtgtccttgtggacatagaaatatgattaggcttagaggtgaacagtaaaggtcatttatgttatcttttcaaaacttaatagacatttatccatcataagcttgtcccccctcaaaatcatgattgacaagactaaataaagtgtatatcaggtgtctctttatggaggaaattgtagtaggatttatttaaaggatcaatatttaaatagccctatgccaattatcataaataattaaggacatgatattcctagctttcctgatttacatggaagtacgttaaatagtcacatctccaaaatttttcttgaatagttgtctttaaaaatgtgtttacatttgtaaggatcttcataaacagaaggggtaattcaaagataggcatggaattgacttatgccaattgattaaaacaaacatcctgtgtgttctgtgaaatacatacaactttaaaatgaaaaactcataattttatgcatgaattttggtgttcatgtggcttggaaatatgtgcattaaatggaattaagattcaaagtatttgctaatcttcaaccaactttgaattgttactggtgtggaagtgagcatattgttttagaatttctgaatctacatggatatccaagttatatattttttctgctacagaaagctttgttttccaagagaatttaatggcttagataataaagtttgaaaatcaatgtattttttttcctagaagctttcagaaaacttaaatctgttaataatctggtgaagtgctttattacacatacaaaattttgctctgtttgacagagtgtcagttagaaattcttgaaaaggttactataagacacaatttttatttctagtaatttaaacattgactgacatcataaagatagtgttttaagaaaagatagttttctgttctgcaagcataaattttctagctatttcattattatcttaaatggagttaacactacttagaaattgatgctacttcccttattttccttttattttaaacaaaagaaccaaaaccatactttaaattttgttgataacagtgatatacatcaaggtgtagaaatactgaatttagtatacacttcataaagtcatttctgttgacaactgattttggaaaaaaaataaatttaatcacttaataatttgatggatcaatggtgtgatttgggagtaaacttcttgaataaaaataaaacttgatgttttttccaaactgatagactgcttagactgatgagaaataaaactaggtctttaattattacctttgctatttgtctaagattctacccccatttagaaatgtgtttgttttacatcatctcatatggcctttggaatgttgtttccttcttaggtagtagattcattcttgatgaaaaccttccaaaattagaatttgctttaaaagaggctcaatacaataagtaaatgaagtctgtgttctgtattacattatttttgtaggatcgtttcacaattttctcacaattcttactttgatagtagagaaaataaaagcaagccaagagacttttttttaaaaatatattttatttgctataaacaactatgatttgcatttctcatgtgaagaataataattatcggctaaaaatggatttgctgcattgattttcaacgtaaatatttaaaagattaatgccagataattttattatactcacatttaacgacaagcaaagctgtttataatgatgactgtccatgtacacagttttaagttgaagtgagtgaatattcaagataattaaatgctacattttcattttcaggctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaggggattttggttttggttttgggttttgtttttttgcggtgggggggctggtatttggaagaatttagctctttatgttacagaaatcttttttgcaaggacttagaaatgataatgcttaagattgttcttgcccaatgtgggaagagaatctaaggtttttatatgtcttgcaacctcatcaaaggaaaattactggcatcattttcataatttgaaaaaaaaagccaaattaatatatttcttttttgattcactttttaagtgatcatttttaaaactttacttttgacccactgaatttatttagatagaaggaaaagagatgatgggagggaagtttagataaaggatggaagttggttttatttaaacaatagccctgtgatttcctaatgagaagtgactagaaattgaagaaaccaaataaggaggatattggtcaatttagctttagtttctcttactctctcaagcctgccctgtttaactccaaagttcatggctcataatttgagaaacactgttttaaacacaggagaaaaaaatgtccattttaaatcatagctattgaattctacaattacaaagaaacaaacaaacaaaatttgaccaacccaggcggttaaatttaaactcttcaggaaaaatttaagctgttaaaattattctttttctaaatttctaaagtggagggacagaatttttcagatttaaaagggcctcctaggtgcccagaaaattagtggaaagaaccacgtctagacgcatctttgatgtgtcagagttccaaggataaaaagaaacttttaaagtcttctatactcagccaggttatcaatcaaatatgagggcaaaataatattttcagacagattttaggcagtttatcttccatatatccttttctttaagggtatttgtagatacactccagaaaaacaagagtgaaatatgaaggaagttgtggggtccagcaaacagtgcttccaaatcagacccctgatagaggtggaaaactttgcaatgcaacaactgcgtagctggcttagaggacagccaatacagatggaacagaaagatgaggatgggattgagggatcagggattgaggtctccaagaataaaaagggacttcatggaaaaagtaggcttgtggataattaatcacaggggcaaataatgcagttaaaataacaacatgacaatcaggtggaggaatgtataataaacccaaatgtggctgggtagagtggctcacacctgtaatcccagcactttgggaggccaagccgggcagattacctgaggtcaggagttcgagaccagcttggccaacatggcgaaaccccgtctctactaaaaatacaaaaattagccaggcttgggggcgcacgcctgtagtcccagctcctcaggagctgaggtaggagaatcacttgaacccaggaggcaaaggttgcagggagttgagccaagatcgcgccattgcaccctagcctgggcaacagagcgagattctgtttcaaaaaacccccaagtgtattataaggcaataattcctatacgaagcaaactaaaatgcagcaatattaaggtataaaaacaaagaggaataattccattgaaccttgattctggaaactttgatccacccagcagtcatgatgttagactcattgaaaagaatgtatttctaatgcatgatgcgatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagtaaaaaaaaaaaaaaaaaaaaaagatacttaatataatactttaaattacaaatataaacacaagaagaacaaatataatgatacaaatgtcagacactgggaatgtccaagattctggaaggaaagggtggtattattgagctaaatcctcaactttgtctgggcacagtggctaaaaattagccgggcatggtagcatgcacctgtagtcccagctacttgggaggctgaggcggaaggatcgcttgagcttgagaggcggaagttgcagtgagccaagatggcactactgcactccagcctgggagacagagaaagaccctgtgtcaacataaataaatatataaataaatcatcaagtctcatattaaagactctgtaaatatgacttattgttgacaaatgaaacaaatagaggtgtaagcatgttgtctacatggaggcaagaccagaataatagaaaatggaaacagattcccttaaagaggggaatcgtgtctttctcattggctcaatgtagtctccgtagagtctagaatgcttcagcacctggcacactgcttaacaaatggtgaatgaaaaaaaaaaaaagaaaagtcattctttttcttctttcaccctatgtccataatctggccatttgcagaacttgatgtccagtgatcgaaatcaacagcatcagtgcatccaatatcttctagtctctcatcttcttattacatcattaattttatttactttaaaattaaggatatccaaagtattatgtgagaccattgcaatgggagacttaaaagtggtataaaatgtactttgggccaggcgcagtggctcacgcctgtaatcccagcactttgggaggccaaggtgggcggatcacgaggtcaagagatcgagagcatcctggccaacatggtgaaaccccgtctctattaaaaatacaaaaaaattagctgggcatggtggcgcatacctgtaatcccagctactcgggaagctgaggcaggagaatcgcttgaaaccagaaggcggaggttgcagtgagccaggatcacgccactgcactccagcctgggcaacaagagcgaaactccatctcaaaaaaaaaaaaaaaaaagtacattgaattggaaagtcttcaaaaagcagcagtgatgaattttttgagatttttaacaattacaaaaattcagggttttttctaatggatgccacctgagactttattttctgttattttcttgtaataactaaccaaacaagctcatgttgaaaaatgattactaaatttgagctaattgcaatgactggtttcaaaattttccacagtgtatttgagttaaaatttcactgtgaagagtactacgatcactctcgcttattccaaaaatataaatggacacttgagtatttgaattattgaggaaatggttgactgggtaatttttaaaaatcactgggcacaaaaaatatattttgacttatattagtttagagtatttacacttgaaagagtctcatcttttctgaagggtgtttctttcatacacattttattgcactgagttttgtgacccatggcatattaatgaagctgaacaggatgtgaaatataaactggaagcaaaagattaaataaaccaaaattgcattttttctgtagtcttgtccaaaattgggtaaccacttctgatggggtagctcatatccaagaatgagtcacaaaaccagactcgttgaacctggtatatgatgagtcacaaagcaacattctgcctttgttttttcaggacaagaaacttgaattgtatcccactgagttaaaagataaaatatatggcattggcatttctgtacttcagagaggaatatatctgtttgtggtaggaataaaaaataagtgagagaggcaaagcttaggttcatcatattatgttactgatataacacaattaacttggtaaaagtgaaggtgtgggtgggcgtggtggctcacgcttgtaatcccagcactttgggagtccgaggcgggtggatcacctgaggtcgggagttcgagaccagcctgaccaacatggagaaaccccatctctactaaaaatataaaattagccaggcatggtggcacacgcctctaatcccagctactcgggaggctgaggcaggagaagcgcttaaacctgggaggtggagtttgcagtgagctgagattgagccactgcactctagcctgggcaacaagagcaaaactctgtctcaaaaaaaaaaaaaaaaagtgaaggtgcccagtgtctgcaactatgtcaccccgggcatatcacatatcactctgtttttccgtctgtaaaacgggagcaacaatgccattgccttatcatcagaaggatatggagactaaatgggagaatgtaggtaaacagcacagagtatgggtatcagtaagtaaactgcagcagtttgttgatgttaacaatagttagcattatatctaactatatctaacgatataaccattgggaatccagttttccatgattttcctctagaatggagctgcctaagtcctgcttaagtcatttttctttgaagattactgaacatcatcttcaaatgttcatccttgtaaacacgtgtgtgtgtgtgtgtgtgtgttaatttaaattttcagaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagtatgtacacaaccaccctcatgcctcctacccccgaggttcctagagctaggctctcctgaggcaatgctttccttctcaattcatattcttccaggaggggcaccaacgttttttaaaatgatgttggcgacgaggacggtaaattttctagatgactgaaggctgactttcccctttctgtgactctctaggcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctgggtaagctcaatatgtcgctcaagacaggttcagggcagctgctggaaaactctccttgtgggggtgggtggcctctaggcaggtggtatctgtggtttggaactggttgacagctcagactgaacaaaccaccctctggcatgaggaagggaaggactgactctttctaagaagtggccgggtttttcccaagccactgtcacatgttcctggtccctgatgccagctgcatcatgcgcctacctgtgcacaagttcctacagcaaaagctgtgttcttggtggaagtaattaccaggactgcagctgacaatgtgagcacagtacggtcactcatacttttcaaattgttatggtgaggggcctttaaaaaacttcattggcgcactgaagtgtgtgccatcgtaagcactgagttcagtgaatttgaattcttataaagtgaacacaccacaagaccagcacccagatcaaggaaaagaatatctctctaccctcaccccatcatcttccgccaataatcactaccctgactcttactgcagagagctatttttaaaaatttggcattcgattacaaaaattatacgtctttagaaaaaaagttggaaaaatgaaaggaagaaggaggaggaggagaaaggagaaagacaagaagtggtgttttcccatagtacattaataatcacagattaggtgggtgcggtggctaactcctataatctcagcacttcgggaagctgaggctggtggatcacttgaggccaggagttcgagatcagcctggccaacatggtgaacctccatctctaataaaaatgcaaaaaaaatagccgggtgtggtggtgtgcacctgtaatcccagctactcgggaggccgaggcagaagaattgcttgaaccggaaaggtagaggatgcagtgagctgaaattgtgccactgcactccagcctgggcaacacagcaagactctgtgtaaaaataataataataatcactgattagctattagcacattaccttctagtcgcttttccctatgaatatataattcttaaaatatccttcttataagctgtagagtcatttgagggactagtttgctctgattagttaccttttcttttcatttcaaagatcttccaagcacagccacttctgtgaacatccctgacctgcttcctggccgaaaatacattgtaaatgtctatcagatatctgaggatggggagcagagtttgatcctgtctacttcacaaacaacaggtacatgtgtgctacatagtgttaaaagaatctttttctgtaaaacacaggcctgtagtagcacttcctgactgtttgccccactttctttctttcttagcgcctgatgcccctcctgacacgactgtggaccaagttgatgacacctcaattgttgttcgctggagcagaccccaggctcccatcacaggtcagctaagcgtccccctctttggctgctatgttaatcttaatgacatcagcagggagggcgcagattctgactgcggacctgcatatcactttaaatctccaatataatttatgggagaggggtttgtgtgtgtgtgtgtgtgtgtgtgtggcgggggtgggggagttattttctatggcacatttccccttgaaaccatttcaccaactcccttatacacacacaccacaacatacacacaacctgtaaagccagctcattggcttattaaagcaagtgttcccagggttgaagaggtgtaatttcctgaaaacgttgctctaagatttatccttaaggagaaagctgagctgtcgtcttagctcattaggtgattcaactgcctcatcactgaagttccaaaaagacacacacagtgctagacaactctgcttaggctggttcattaattgcttccctcgtctggagctcaaagaggaaaaatcagcttaacatgaatattttcacctaatggcatctctaattgacatttattaaggatgtcaggtcttcaaggatgacatttattattaaaaaggttcgcatgactgttcttattttatcttcgtgctgaatagtcattattagaagaagtggcaatattcaaagagtcaaaaagtatcactggctcttcactaatcaagcaagatgctaagggatattagaaaagggaggatttatggtgtttctaagcctctgtctcaaagaaaacagtgcatcttacttttgctcatgaatctgcagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcaggtaacttttttaagaagacacttcctatgttatcttatcaggattgttcctgaaggagggttgttttgtctctgtcaacagtcctctcattcaagaaatcttatatattagtttttccctaaacttctgatatttagctgaaatgtcataagtaacttatcaaagctggctactggcctttctgattaaaaactgacaccataacgtccatctacaaattttcccctagaagcttaagggtcatttcatttttgattcttaagtattataaaatgattcagtaaaacaaaaactgttacattattttctgcagttatttcaaaggctttttctaaaaaattttttagtatcttttcttataaccctctccccccaccaccatatgacacttcatatgctggtaactcacttattacctattttagataaaaggttcaaatgtcataatttaagcactatgactggaccatgaaaatgtgatctgattaagagacaaaacttagcaaaactctcgaatgagaggctcaatgaactgcctaacatatccaagaaactggcttcttaaaagtaatcttcagcagagaatgtgaatgaccagttgactcttgtctgtcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccagtatgtcttctcctatctctatctcccctccaaattctccaccctcacttgcagcctgtgagaaagtgcagtaaaccattcactcagaggtgtatggcttagagagagggaaatacccagccggcaagggaatgcatagtgaacacaaagcacattaaacttgaaaacaaaactcagacaagctccatggatgctaagtggtaacccatttctaaaatacatgtaccagctgaagggtactaagaggggagaactgaagagaatctaatttgagtgcatttttcgtgtaactaaatatatctagatcaaagttaaaatgcaggatcataacacttagagtagaattcatttaacaatagcaattgtcaagtgtctagtattactagccaccagcttatctgctcagtttttacaagcattattctcatatttactctttgttttgaccttaggaaggaaggtcttattattattattttatttatttatttttttgagatggagtctcgctctgtcgccagggctggagtacagtggcaccatctcagctcactggaacctctaccacctgggttcaagcaattctcctgcctcagcctcccgagtagctgggactacaggcgtgtgccaccatgccctgctaatttttgtgtttttagtagaaatgggtttcgctgtgttggccaagctggtctgaaactcctgacctcaagtgatccacccactttggcctcccaaagtgctgggattacaggcgtgagccatcgtgcccagccggaaggtcttactagtatccgtattgaatacttaaagaaactgaggctttaaaaaagttctgcaacttgtagggtcacagagataggaagggatagagctggctctataacctatgtccgaagcccatgctctcaattattatactcgactgcctcttaaagatttcctctatttgaaaggtaatttaaatttcggtgggaaaactgctggttattattctcaagaataaactccacaacttatgtgattctgatagtgcaaactcaccagtatcctaccatgaatctgaggatacgttatcattactgtaattactgtctaatctgaaccatgtgaaaataacttttatttctctagcaaagggctattcacagaatattgcttttgacccatagagagcttcttcttgctgtcattttaggaggcatatccctttttccttaatctgtttggctcagagctaactgtgaacttcagaagtgtttgttttgcctttttaaaaataccattgctttaatgtaactataatttctgagactgatgcgaaagtcttgctggaaaattagacttcccaaaggatcacagtcaagcaaaatggttccacaatttctcatgactggcagagttttggcaaagttttgtgtagcactcaatctcttactggctcagtttttccagggttttgactttcacatagttacaaccttgaggagagaaaacttagacattcaatcaagtttcaggacttgagttatgatcattactgatctaaatatttcttggcatgtttcatcttttttcctagaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacacgtaagctgaaaattaagtgccttttcttaactatatttacattctctattcttcatgctttaaaacaaaacaaaacaaaacaaaaaaaacattaaaaaattagtacataatttaaatcagtgatactaaaaatgtgctccatagactggctgctggcccgttaattgtttgctgctagtctgcaacaagaaaaacggttgtgccagaacgtaaatcacaaagcacactgcttagtacagctgagaatttttctgaagccagattttcttgatgaaggaagcagtgtgttaatttgcacacattgccaagctcgctctttcctctagggccagcactttgagtaacatgggtttaaagcagtctgttattagaaaaattaaattcgattacattaaatgaatttaccaaacactagttaacgcaagaaaaaattagcacctatgtctacattctattactttgggcattgaatagtaactataaatgcagaataaaaatatctatggattgaatgggaaccaactaattgaacatgaagccaaggaaatgatttctttatgagtgttggctgcagaagattaaagtacttttgcagacggaatcgctcttttcttaaattactcttgaaattcctcagaggagaaaaatactaacaataatttttggtcatgtctatccttttgctcaacattttaaaggaagtggtcttaaatctcccacatatctacatcacaataacaacctctattcacaaaccgattcctattaaatacatttccatttacattacagagaattatgagactccttatttctagctgaacatcatttgttattttcaactcgacattttgaattatagaagcacctaacataagtactttttcagcatatattctaaccatggactagtttgcaattttctaagagctttcaacaaatgttactcttcgactaatttaaaagtatggatgttaaaaagcattcaaaaagtccatacaagcctagtttgtaaataactatggaattgatttcccaaagaaaatacaaacttttccccataagaattcatactttaagaaaaacttacttccatttaaatttactgtatgaagtttggctcatgaaggctttttcctaaataatagttaatcgtaagcaagtaaaattcacttttaatttgcaaataagcttacttgaaaatttggctaaaattttacacggttctaagatagtctaagatctactctcatgaaattaatgtctttatatttcttgtaaatattcatttcttataaatgtccttcagtgaattagaatggagatttcagtgaatgcgccctttcagtagatgtcgtcttttactaaaatgtagaattctatagttgtcttgttcattccttaacatgagacatattttatgtagtttcttttgttgaacacagtgcttataaaagaaaaagcatttttaatgatgctaacaataattaagggaaggtggtgggccaagatatttcaagtacttctgaagactgatatattggatatattattttatgctttgcataatacattcatataaaatataatgattttaactgaagtactgatagccaaaactaattttattagataaaggttaacatagtgtctggaacattgtatgctttcaaaaactatttggtgaatagataattgagaaaggaataataataaaaacagctaaatgaagcttatatttaaataaactaatgtaagcagggtattctacaactccatttgaactttaagcactccctaaggctgtaaacatccacaaggcttgcatgtttttgaaattactaaatttctgtagttttttactatcttactaagctgaattctgggagtaacttttctgagttttataacttgtgctaaattcttaagagcaaatgtgagaaaagttaggggaaaaagctgtttctggggaaaattcagcttagtcttatattgatagggcaaattttatttctttaacagctgggctgttcttccctaacaagacctgccagaacccatagctcacacttagaatcacatcctttgtttgacatcgtttgtgggtttgtggtttggtgattttcccataatggccttcccaggcagagagcatcatcttaaacttgggaagactctaggtggctggctcaagcaatagaaaatacctagtcttaaagcccaggacagttgaggcgaatataatttgtaaaaaaagttgtggttttcacagatgttcagtgaaagaaactgactgttctctgaattgttttttgtgggccattaaaaatggtcacacagggctggccatggcattttggcacagtcaccagcagtcaagtggtgtataatttcagaggtactaaaaggcatcgggtcacccatcccagtcatgtccccccaccccccaccaaacaccatcaaaataataacatacatagatgaaacagcccactaaaccagtagtacctcaattcagccattagagctatcattatgaagtggcccacacatatatttggctttttctcacacaatatttttaaaataaaaataaaaaatggctccttagaatccagactgaaaaaaaaatgcgagaattgcgatgttgattctaaattcccacatggcaaagaaaaaaaaattgactggagttgagttgagactggagtctgaacactttttaatccctgtttgtataactctggagactaattctttgtcttgccagccattcataatttagtataaatgcattcagaggttttttcccaatgggaacaaaatttgattgagatgtaaagagaggaagaattgtggagatgtcaaacatgtgaccagagctatgaacacacttgatacccttgaacttaaacttacccaactcaaaatatctggccttctgcgatcttacctttctacatttataataagatttgcaaggttgttggaaatctctatcttaactttatatatacatgcctctttctttctttttctttcctttcctttccctttctttctttctctttccttccttccttcctttctctctctctcttttcttcctttcctttcctttccttcctttctttcttcctttctttctttctttctttctttctttctttctttctttctttctttcttttctttctttctctctcactctctctctctttctttctttcttatttttggtgctaaaacccaaaacaaatcttttatttaaaaataagattttttttttttttggccaggtgtgatggctcatgcctgtaattccagcactttgggaggccgaggtgggtagatcacctaaggtcaggagttcgagactggcctggccaacatagtgaaaccccatctttactaaaaatacaaaaattagctggatgtggtggtgggcaactgtagtcccagctacttgggagtctgaggcaggagaatcacttgaacccaggaggctgaggttacagtgagatgagattgcgccactgcactccagcctgggtgacagagcaagagtccatctcaaaaaaaaaattgtttaagtaaaattttattttctttcttttttttttttttttttttttttgagatggagccttgctctctcaccctggctggagtgcagtggtgtgatcttggctcactgaaacctccatctcccaggttcaggtgattctcctgcctcagcttcccaagcagctaggattacaggcatccaccatcacacctggctaatttttatatttttagcagagacaaggtttcaccatgttggccaggttggtcttgaactcctggcctcaagtgattcacctacatcagcctcccaaagtgctgggattacaggcatgagccactgcgcctggccaaagtaatattttcaataagaaaaataacagtgatgtcaggatgctagaaaatgcaaaataaatttgttataattcctgattctggtgataaaatactaaatttttgcagtattattctgaaagaataatcacgtatttaaagtacaaatctttagacttcaaagtgcatccatggtggcagattttgtttaacttttatatagcatcttttattgcaaccaaaaatagctgaccattattgtggaataattcagcgtaaagctttttttttttctttttttgagacggagtctcattctgtcacccaggctggagtgcaatggcatgatctcggctcactgcaacttctatctccagggttcaagcgattcttgtgtctcagcctcccaagaagctgggactacaggcatgagccaccatgacagttaatttttcatatttttaatagagacagggtttcaccatgtttgccagcctggtctcgaactcctgacctcaagtgatccacccacctcggcttcccaaagtgctgggattacagtcatgagccaccgatccccgcccagcataaagctgtttttagatcaccttctataatttaccattgttcttaaattaatggttaagaaacaatatgataatcagtttgtggtggccagttttacattttataagggattttacactgacgatatagggaaatttattgtcatcaaagtcaaatcccaacaatcataaaaagacatgaattagattatataatttcaatgaaaggaccaccttagcaaacatctaaccccttgttactcaggtatcattcacgggccagcagaattggtattatctgtgtttgtcagaaatgcaaactccctagttttttgttggacctccagaaacagaatctgcattttagccagaccccagatgatgtgtgtggcacattaaagattgagaagcctgatcctctcccaattctcacccaatgaaaaaatatgttacatcctctatccactgcttggttaaactgaggttctccataaaaatacttgttatctatatgctatgcaatcatctgtgagtttgagttttgaatatgtgcattgattctctctcacagtgcagcctgggagctctattccaccttacaacaccgaggtgactgagaccaccattgtgatcacatggacgcctgctccaagaattggttttaaggtaaactgcagatgttcctaatctctgtgatacagccctgagctgtccttgtggttcccatgtagtggaaacagggtgctcaggagtcaggagacctgggttttgtcacctgcttctgtccatacatctttgactacattgtcagggcctaacagtccttccctgcctacctcactgaattgttggaagggtagatggaggctgcgaaagtgttttgcaaaggataaaacattagcacgaagctgctgcttattgttatcttattttctctatcctttcctgcagggaattacatttcaaaaaaacatgggaaaactttatttgatgtgttgttctaaatgagtgtgaacaagttcacaaaagccagtttagggagaccagttaaactcagagtcacttaaaaatcgcattttcatccaatcagtttcatctccaactgttcaaagcactgagggtgaatctcttaatagaagttaagattaaggtttccctgtggatatctggattcatcttctttaaagtaatgatattagggaagcggtgaatacaaatgaatatgtttaaaagaattccattctttggcatttagtgtgaagagagaaatatttgttatcgctggaaatcatgactcaatccccttgatcgtttaaaaaaatacaccaaagataaagtttgtaaatggccatatttatgattatgctactcaaatatagaagaactttctgaagagtgccagtataccttttaattcccttaataatgtcatgctgactttcagaagccttatgatgtgtgaaggatctctctagagttgaacactattggataacagtgttacctaagtttttgaaatagaatcttaaaaggattttaaattatgggcatagttattctaattcttctcttgtaatgtatcatcctgcagttgaagctatgtacatatctcttcaaaaggtgtgtttttgcaatacagttgctacaggggctggtgcctttaaatggcaactaaaaggttaattgaatgtgaataactcgttaaagggagagctcagacattccttctagcacacacacagaaaaatagaaatgaactaccatgtgacccacagtccctgtatacgtctggtttgtaacaagagattctttatcaagcaaaacagtatgtaatgacatttctctggaaccttccattacaagccaccttaatgcagtttggaagatacctcccccacctgggggaatttccagctaaagtatataaaagagtccccaaatcatttcccaataaaagtacactgtgcagtttctgaagagtttacactatttaaagcataatcatagcctcacagcagtaacagtcctctggaaatatttgtccttggtgtttactttgcattccttcctctagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacacgtaagaagaattttttcccttttctattagtttttaaaactgttctacttttcgaaaaaagctagtgtcaatatcactttttacttatgagaatggcacaggggagatatcttatccttacttatattattaatgctattcctgaatttggagtagcaggttcaattcatgctttatattttatggcatcagaaatgttctttccatgtcaagaatatttatgaactggcaagatgaaaataatttcaatagtattgcaaaatcattaatcataaagaagtctttgtcagagaattactgctgtccatcatattttcataatgtaacctatatttttatgggagggagggagggagggaagaagcatggaagagagggaggtagggaaggaggaaagattacacaggtcaagagctttgtgtcagctttgacttttaaaatgttctttctgcatagcattgtctccaccaacaaacttgcatctggaggcaaaccctgacactggagtgctcacagtctcctgggagaggagcaccaccccaggtaagtttgggatggatcagagggcaagtatacaccataccttcccaagacaaagattttagaaactgtgtttctttcagagaaagaagggattcaaattacaaatgcttagctctccataaaaactatagcagtacatgatgtacatcatggagcagcctgcaggatgctttaatgcacgttgacttcaatcacaggaagcagaacaaccttacactagtctagggggacaagacagatcctcacacagctgtagggctgaagaaaagcactgtggaaggtggcttttgctgagtgcattaaaaattgccaaacaaatggttgaagtcatattacgtaatttcccttttgtgagttgttacagagcctaagtttattattccctgaagttttatgaatgttttgtcatgggttgcaccacaaatatttaagggtgatgaaaggcagaaataccttcattttacagaataagaaaactgagacttagaaaaaattggcctactcatagtcacacattttaaatgttacaaaactgggattgtaacttaagtttgtagactccttctcacacccaatgtcacatatttggaatgtaatttttttttaattatattctatgcaaactgaaaattctgattaaggggtttcctgaccatttttagagctttaaatgaagcatttgtctaaattccttgttcacatatatttgaaaattatttataaaatgctaaaatgtataaagatagttgttaacaatattcaaacagcatgacgtactatagcaataacaggaaattttagatacccattacttttgccaaaaccacatggaagtctcaacaaacctatggagaaaaatcttaaacaaaaataaaagttccaattaatgttgattgcattcttacctcatatacttgttaatttaagggatatgtttaggttattatttagctatttctaattttactgtaaaattcttgtgaaatttttgtttaaaaaaaagtattatatagttcttatctttgccggggcacagagctaaggctatcatctctaaatctgattaatgtatgcaaacacacagaatgaaactagctcagaatatctcttttaatctccctctgaagtagagtgattttggtaaagttttcattatctgcggaaacattgtttaagccaaagctatacaatttccagctgagttgctctgaatttgaaactttaagttgacaatcttcgtgcttgttagcagcaggatcattaatatctcgtctcaatggcccagcccacacatatggatgaccactagcaagtgtaatgatctcaatatttatttctcattcagttgggtttccttgtatttgccacattagtgtttaccctgttcctaatggcaaaatattctgtcatctccttgccttttataaagtttaatatactttctcattttaatctgtccccacagatctctagtcatcactgtttttatttgaatgtctctcatccctctcaactcttttactgcccaatttctgtgattcctgaagacttcaacaatcaatactctctttttttgtttgttttgttttttttttttgagacagagtctcactctgtcacccaggcttggagtgcagtggcgccatctcaactcactgcaacctccgtctcctgggctcaagcgattctcgtgcctcagcctccccaagtagctgggactacagacatgcgccaccaagcccagctattttttagatttttagtagagacagggttttaccgtgttggccaggctggtctcgaactcccaacctcaggtgatctgcctgcctcaacctcccaatcaatactctttctagaataagtatcagcacttttgtttctcaccttttctcctttcttggttctcttcctataaatcccatagtttcagaccttttaaattaggagagctctctggggaatgtgcttaaggtggagagcgattctatactaggcaggtagaaaggaatattcctcagctgtcttcaaatgattcattaaggaaaagcagggtacagtgataggaccatgagatttggaaacaaagaaagctttggggaatcactcccctggttcaagatttcctttaaagtgaggatcttggcggaggttgaagtgagccaagatcacaccgctgcactccagcctgggtgatagagggagactgtctcaaaaaataaaaataaaaaaataaagtgaggatcttagtactgcctgaaaggattgttgcaagcattgaataacagtgacagtggagtcctcagtaaatgccaagtcctgcattccgccctgtgaatccatcattggagtctagttaaatatgctctggctcacagatcctctgtgcaataacttcccttttcttttttctccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccaggtaatagaaaaataagctgctatcctgagagtgacacttccaataagagtggggattagcatcttaatccccagatgcttaagggtgtcaactatatttgggatttaattccgatctcccagctgcactttccaaaaccaagaagtcaaagcagcgatttggacaaatgcttgctgttaacactgctttactgtctgtgcttcactgggatgctgtgtgttgcagcgagtatgtaatggagtggcagccatggctttaactctgtattgtctgctcacatggaagtatgactaaaacactgtcacgtgtctgtactcagtactgataggctcaaagtaatatggtaaatgcatcccatcagtacatttctgcccgattttacaatccatatcaatttccaacagctgcctataaaatagttttgtccctgtatgtgagcactgaaacagcatttggttgacacatctagtttttcatcttgcagtttcaaatccttctttttgaaaattggattttaaaaaaaagaagtaaaagtcacaccttcagggtgttctttcttgtggcttgaaagacaacattgcaaaggcctgtctaaggataggcttgtttgtccattgggttataacataatgaaagcattggacagatcgtgtccccctttggactcttcagtagaatgcttttactaacgctaattacatgttttgattatgaatgaactaaaatagtggcaatggccttaaccttaggcctgtctttcctcagcctgaatgtgcttttgaatggcacatttcacaccatacattcataatgcattagcgttatggccatgatgttgtcatgagttttgtatgggagaaaaaaaatcaatttatcacccatttattattttttaaccttcttcatgcaagcttattttctactaaaacagttttggaattattaaaagcattgctgatacttacttcagatattatgtctaggctctaagaatggttttgacatcctaaacagccatatgatttttaggaatctgaacagttcaaattgtaccctttaaggatgttttcaaaatgtaaaaaatatatatatatatatattccctaaaagaatattcctgtttattcttctagggaagcaaactgttcatgatgcttaggaagtcttttcagagaatttaaaacagattgcatattaccatcattgctttaacattccaccaattttactactagtaacctgatatacactgctttattttttcctctttttttccctctattttccttttgcctccccctccctttgctttgtaactcaatagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacgggtgaattttgaaaacttctgcgtttgagacatagatggtgttgcatgctgccaccagttactccggttaaatatggatgtttcatgggggaagtcagcaattggccaaagattcagatagggtggattggggggataaggaatcaaatgcatctgctaaactgattggagaaaaacacatgcaagtattcttcagtacactctcatttaaaccacaagtagatataaagctagagaaatacagatgtctgctctgttaaatataaaatagcaaatgttcattcaatttgaagacctagaatttttcgtcttaaataccaaacacgaataccaaattgcgtaagtaccaattaattataagaaatatatcaccaaaatgtaccatcatgatcttccttctaccctttgataaactctaccatgctccttctttgtagctaaaaacccatcaaaatttagggtagagtggatgggcattgttttgaggtaggagaaaagtaaacttgggagcattctaggttttgttgctgtcactaggtaaagaaacacctctttaaccacagtctggggacaagcatgcaacattttaaaggttctctgctgtgcatgggaaaagaaacatgctgagaaccaatttgcatgaacatgttcacttgtaagtagaattcactgaatggaactgtagctctagatatctcacatggggggaagtttaggaccctcttgtctttttgtctgtgtgcatgtatttctttgtaaagtactgctatgtttctctttgctgtgtggcaacttaagcctcttcggcctgggataaaataatctgcagtggtattaataatgtacataaagtcaacatatttgaaagtagattaaaattttttttaaatatatcaatgatggcaaaaaggttaaagggggcctaacagtactgtgtgtagtgttttatttttaacagtagtacactataacttaaaatagacttagattagactgtttgcatgattatgattctgtttcctttatgcatgaaatattgattttacctttccagctacttcgttagctttaattttaaaattacattaactgagtcttccttcttgttcgaaaccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaagtaagcagttgaatgtatctgttccataaatattaacctagagcatagcaaatgaattctaaattctcaagtaggaggagctaagagcaagagagctgcaaccaagctacaaactaaactctgaattcaatgcacagctccattaattttgaaagatgtaatgtttgttgctatcttaatatacttttgatatctacagctttaaaaaaatcatagtggaaaaacacctgcaggaaagttccatgacttcaaacaaattctgcttctaaataagcacgtaaaaataagtgaatatcaagagaaattatatgactaaatctaaatctttagagaaaaaaatgagaactgaaaatagtgtcaccatatgtgctttattctcatttttataaaaaaagtgtcagcagttgattgatttaggatttgaatacttagaaaagtgactgattgtttggtctagattagaatgttgttgtgaagagagtcagaagtttaatttgtacttcaaaaagaatctgttagaaggatttctcagaagactgagagcttagaaaaaaaactgacattaaataaataacaacaatttatggaaattgtctctttctagtcccaaccattatagaatagacatcttttgttaaagaataaaacagtaggctgcaagatggtgctgtgtttcacataaacagtgctttttattattttcactgtaatagtcaaatatataacaacagcaaaagattctacataagggaaaaatagcttacatttaggtacattaccaagtattagtctgaaaacatctacctttcaaacataatttagataatgaaacacaaagaagagcagctcagcgtgaccataatcttggtttcttactttgtggctgagggcaagaatatctttatattggcatatccaccaccccagggctgttgcttctgttctagagcaccctggaatcactaattacagcatcacccagtatacaagcccctgcatcacaatgtctgtcccttagccgtagacctgtcacatgctaatcatgtgttctaagaccttattataatcctaatgctacagatgacctcagggtagcccctctccctcctagcaaagtcattattatcctcttttaaagatgaagcaaaccagtgcagtggctctcgcctgtataatcccagcactttgggaggctgaggtgggccaattgcttgagcccaggagttcgagaccagcctgggcaacacagtgagaccaagtctctacaaaaaatacaaaaattagccgggcatggtggtgcacacctgtggtctcagctatgtaggaagttgaggtaggaggatcacctgagcctggggaggttgaggctgcagcaagccatgatcgtgccactgcactccagcctgggtgacagagtgagaccctgtctcaaaaaaataaacaaacaaataaacatgaagccgtcgaggtccccagcagttaagtaaattgccactggccagctagtatggtggaaatggaatccaggcatctggtcctccattctggcacttttccaaacttttgtagggggctttatagaaacgctgaagggcaaatggtgtgcaggggaatgagggtttagtgagtaggagttccaaatttagaaacctcactctctgtatcttttagatatacaaatatttaccatatattacagttgcctctagtgttcagtacagtaacatgctgcacaggctcatagcctaggagcaataggctagaccacatagcttatagcttaggtgtgtcaaaggctctaccatctaggttttttgttttgttttgttttgttttgtttttgagacggagtctccctctgttgcccaggatggagtgcagtggcacgatctgggctcactgcaacctccaccaccaaggctcaagtgattctcctgcctcagcctcccgagtagctgggattacaggcgtgagccaccacgcccagctaatttttttgtatttttagtagacgaggggtttcaccatgttggccaggctggtttcaaactcctgacctcaagtgatccaccctcctcggcctcccaaagtgctgggattacaagcccatctaggtttgtgtaggtacactctatgatgcttacacaataaaatcaccaaatcacacacttatcaaaatgtatctccaccattaagctatgcctgactgtgtatcaaaatggaagaagaagctgggcacagtggctcacgcctgtaatcccagcactttgagaggccaaggcgggtggatcacaaggtcaggatttccagtccaagcctggttaacacggtgaagccccgtctctattaaaaatacaaaaattagccaggcatggtggcaggcacctgtaatcccagctactcaggagtctgaggcaggagaatcacttgaacccaggaggcagaggtttcagtgagccaagatcacaccactgcactccggcctgggcaacagagtaaaacctcgtcaaaaagaaaaaataataaaaataaaaaaaaatggaacaagatactcagggatgtatatttaattttttaaaaaatattctgctctcattttaatatggcagaaccgattgctttctaagtgtggcttttttccagtaaaggttaattattaagaccactagtcctggcctgggtcaatcccagtatgatcctgggcaagtaaattaaagaagataacttctctgtgcctcagtttttttttgttttgttttttgttttttcatttacaaaatggagataattgtagtaaatcaaatttttagaggtgataggtttgttcatttcttgaatgcggtgatggtctcccaagtcacacatatgtaaaaacccatcactttaaagatatgcagtacgttgtatgacaagaaattgcttttaaaaggagcaaactaccttccagggttgttgtgaggcataaatggcaatccacagcaccacagcaaggattatcatgtgccctccagagacatactctcaggtggatgcgagaaatatccagctgttgcagcaacttcatcccactcgaaatccagctgagtcacactcacaggtggaatggagggcttcgagaggccatggggcaaggtgacccttccttatcatctaattacagaccttctcaaggtctgttcactgaacacttcgctgtagtgttcacttaggtgtaagtaggctataggactggacatttggatatttcatcagttcaaatagtcctgggcgtgctttagtttctcatgcttttgagcagagttttaaaataagccccatttgcccctacagatctcctgcctggtacagaatatgtagtgagtgtctccagtgtctacgaacaacatgagagcacacctcttagaggaagacagaaaacaggtgagtggtgttggcagtatgactatccagtagcttttgcctatcaattctgtataacaaatgaaatgctacttctaaaaatacatctccattttttgttgtcatggtgtgtgtacctttgtcatcacagtatgattttatcgctggtctcaaaaactaaaagataccttactcaacaatcacctagactttcagtcactaacaaattaagaaatttgttgtctgtccttttaaaaaacattttctaagaagatctttgttatttagatttagcagacattccttttcattaggcagctctgtctaatggctgacccaacactcattgtcatctatttgtcttcctttactaagccagcaagtttacattttctttttacttaataaaatatgcatttactagaaggaagttgaattgaatctcataaatattacatacttaaatatgaatgcttttaattttttctttcaaaaggtacactttagtgtattcattaatttatttatagtccacttgcttccaaaaaggacttatgatatcttagtttggtttcttattgaaaagaactagtaaatgctgtaactgaaacagaaatttgctggaagtcccagagactaagtgatttgaatttgcaacaaactctgaatttttgtgcatttttgaaaaatgcatttttcaaaactgtcaattcacgaggaattatcagcattgtaatttgtctgggataatgtctttagtttcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatcttgaacacttatctccaaatgtgacacagaaacttactgtaataacccctaaaatctgcttgaattacttagcacaagaaaaaaatgaatgcttgagctggctattttgaattgagtcaatttaagattttaaaattcatatgtagcttagaatcagtacatcttactctttggtttatggcaaatcatggtattgatgagacaggaacgaaatgttggatgtacgttaatttcccctacaccttcctcacttcctaaactggtggtgtcttttcttttttttttctcttcctcccccgggtgggaaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacaggtaacttttcttgtctgcaaagaaactcagaagactttcctacccagttggtagattctgtaaagtagcttgctgttgtctgtcatcagctctcaaaaaaaaaaaaaaaaaaaaaaaaaatagatcattgtcatggtacatggagagggaagtgagaaaatgtggagaaacatcttccttagaatatggtaaagaagcccgggcgtggtggcagtaaagaagataatttttttcctctcaagaaatttctcacctgatttgggtatttatgcatttctaataacacaagttttgttgaaaatgtagaaaattggccggacggggtggctcacgtcagtaatctcagcactttgggaggccgaaatgggcagatcacttgaggtcagaagttcaagaccagcctggccaacatagtgaaaccccatctctactaaatatacaaaaattagcaaggtgtggtggcatgcacctgtaatcccagctactggggaggctgaggcaggagaatctttgaacctgggaggcgaaggttgcagtgagctgagatcaggccattgcactccaacctgggtgacagagcaagaccctgtctcaaaaaaaaaaaaaaaaaaagggccaggcgcaatggctcacgcttgtaatcccagcactttgggaggccaaggcgggtggatcacgaggtcaagagatcgagaccatcctggccaacatgatgaaacctcgtctctactaaaaatacaaaaattagctgggcgtggtggcatgcacctgtagtcccagctactcaggaggctgaggcaggagaattgcttgaacccaggaggcggaggttgcagtaagccaagattgtgtcactgcactccagcctggtgacagagggagactctgtctcaaaaaaaaaaaaaaaaaaggtggaaaactgaacactgtttcaaagtacctttaaaaatataattttagggtaatagtgtcattgttcttagcagatagaggctgaagtacttacgggaacagtagcatcatgttatctgtattttagtctcaagtcgtcaagccagagacaaatacctaagggaagggtatataggtgttcattgtattacttttttttttttttttttcttcctgaaatggagtcttgctctgtcgcccaggctggagtgcaatggtgggatcttggctcactgcaacctctgcctcccaggctcgagcaattctcttgcctcagcctcccaagtagctgggactacaggtgcccgccaccacgcccggctaatttttgtatttttagtagagatgggattttaccatgttggccaggctggttttgaactcctgacctcaaatgatccacccgcctcggcctcccaaagtgctgggattacaggcgtgagccaccacgcccggccttgtatcacttttttttttttttttttttttaacttttctgtagttttgaaatttttccaaataaaatgttgagggaaaaaaactcttccccaaatttgaaataatcattttatcacaatttgaatgggctctgtaaccccttatcttgaattcgtcataatataaaattctgctaattacacgtagtatttacatgattgtatggaagaatcattaagacaattatctggaaaatgaacaaacagtaaatctgaatattgtttgaaaattacggatgtgaaaagtttcccttttttttctagtttctgatgttccgagggacctggaagttgttgctgcgacccccaccagcctactgatcagctgggatgctcctgctgtcacagtgagatattacaggatcacttacggagagacaggtacagcagtaaaatgctattttacactctgattaaatcagattctgttgtggataacctgaaagcccaacagtgaacaaagaattaaagaaactttggcaagtccattcaacggagcccttgttttttccaagaaaatacgtaagatatagatgatataatttgttctaaaacccaaataaaaagttgtttatatactacaactagagggggaacggcagagctgaggaaataaaaggattgtaaattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaagctgaaatgttaaaacagcgctaactgtaattttctctcaatgtttatacacttaccaaggtttgctacatgcataaatacccctttctgttcaagatagcgctctttaaaagggaataagcaagaagatgtgatttacatgctgctataaatgtggtaattcaattaatcagtaatacccaagtagctctaaacccctcacactctgaactaaccctttttcatacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacaggtacaaacttctactctggggtgacaccagcttttacttattcagatactgttttgcaatgttctcccaaggtatttttctaattgtagaatagattttcctttttaatgagcaacaacctgcagctagcacctgcagcgaacagagttttgagccagataaagaaggaagcaccccaagggcaggaagttcagtcagttttgtcgatatattccgcatgtctgcaatacgacaggcatagagagtgttcagtaagtatttgtgggaaaagaatggatgagttgataaagtaggaagagacacctgcttgtggaatgtagcttctttgtgaatgaagcaaccatctcaaaaataggaaatggtattgagatgcctgccccatccctctaaaagctctctctgtattctttcgagaagaaatacctttctcatgtaagcgatcattcgaatatgtaccagacctagagaggaggacttgtccaatcttgtctccaaggactggggcttcactggtttctccctgcttttatttgtagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccaggtaagaatcatctgcatctcggccaggtgcggtggctcactcctataatcccagaactttgggaggctgatgcgggcagatcacttgaggttaggagttcgagaccagcctggccaatatggcgaaaccccgtctgtactaaaaaatacaaaaaaattagctgggcatggtggcttgtgcctgtaatcccagctactcaggaggctgaggcaggagaatggcttgaagtctggaggcagaggttgcagtgagccaagatagccccactgcactccagcctgggtgacagagtgagagactccatctcagggaaaaaaaaaaaaaaagagtaatctgcatctcatatacaacaggatagatggggtaggaccacctaatattcttttttatataaatggctaccttgttgtgagtactatgtatttttttgtcctatgtcatcattgtccccattcatgagttcagggctcaagatcattatcaacccttttcacagtagaagtcttaagtgcatttctgtttttacatggatagttctatttagtgatatggacatcttaaattactagattcacccttctggttttgtttatcattcacactaagaagagataaatggcctaactgactttttcagctctttttagctatgttgtctttgtttttaaatagaatacttgtgaaattaggatcttaaggcaatttattagagtcaagttaattttcattttttctgagagcagtatcactaattgttgggggcatcatattaagttttagatcttatccttgagtgtgacttcactcccatatggtaatttgtattagcaatgaacaggtttgtccaagaggaaatcaaagtctgactctccatatttttgttacaattctgcaaataaaaattctaggccaccatatgtttactaccaaactctagacgccacttgaggactttatagtggatgacgtggatgttgcatttgcttttcactccctttgcagatcaaacagaaatgactattgaaggcttgcagcccacagtggagtatgtggttagtgtctatgctcagaatccaagcggagagagtcagcctctggttcagactgcagtaaccagtacgtaaccactgcttggtttccattttcaaagtcaaattttgttcttgggtgtctgaatgcccacgacatgtcttttgcaattacacatagggaaagtgaacttgttggttagtttatgtcttgagctgagccctttacgaacatcttttttccttctcagtgccaagcgaggaatttacagagaaagaagttgtgaaaccaccatagttagttgctgtgctttgaatttcttttgctcaaatggcctcagcgaaatcttatttgcctatagcaaatctacaaaaaattttcctagaccgtcttttctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggctcacgcctgtaatcccagcattttgggaggctgaggcaggcggatcacgaggtcaggagttcgagaccagcctgaccaacatggtgaaaccccatctctactaaaaatacaaaaattagccagtcgcggtggcacgtgcctgtaatcccagctactcaggaggctgaggcagaagaatcacttggacccaggaggcagaagttgcagtgagccaagatcatgcctctgcaccccagcctaggtgatagagtgagactccatctcaaaaaaaaacaaaacaaaacaattataacaatttgaatctgacattgcaaatcagctttaccacttccaaggtatagaaaatccaggtctatgagactaacatcacattgtaaaaatcaaatcgtggtagaatatctttaaattaatataaatacatccccattgtggggacattttgcagggtatctgcttatctcacatacacctatgttttaataagtgatgcaacattgcatattttctaaaccaagaaaaattaagcaagtgtttaagtgatttttccttttgatagtgggttaattggacttcatcaaagaaaatggtatctgcaaaactgctttgcatgttataaaaatgcttatttcacaacttgcttttcacataacctcttaccattaatttgcctaacagacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacaggtatatggttaattgcaccaccaggtgcccatgggagcagcggctttatgccctactgaatgaattatgcttcactgggctattgattcccgtgtaagggtgaaaaagaattattaggaaagatcctctttaaagaggaatggtaagaaacaataaaacttaggtgatatttaaggaaacaagtctgattaaaagaaattttggagtatcctggcttatacacaagaccataaagcaagacatttgaagaggatactaaagttgtggattatttcctaagctctgactccctgtgattaccctcactatgtataaagaaaagaagtttggcattacagagcttacttataaaaaggaacccaaactcgggcatttcatagcagcatgattctgagcacacgtgggtaagacctttcttctctggttagatatcatatgctggtgtataattagcttaaatgattgtgatttagacacctaggaaataatcaatagggcaattgctttccataatactttatcttcttgtgctttatttctgaagcagagtagaatgctaaagatgtatcctagtgacagcataaaccctagaggtgacagtctgtattattgcttttcgcttctcttttctgcttctgttgggagccagttttcttcttacgccgcattacagagagaacgtcaaatttagcagccatatctgccatagggtccaaataaagagacaataaaaacattattctctcttttttggatggaatactgcgtgaaatggttatccatacaaagatactttatgtagaatagaaaaaggaggccgggtgcagtggctcacacatgtaatcctagtgctttgggaggctaagccgggagcactgattgaggccaggagttcatgatcagcctgggcaatgaagtgagaccccgtctctacaaaaaaatatgaaaaaattagcgaggtgtggtgacacatgcctgtagtcccagctactcaagaggctgaggtagaggatcacttgagcctacgagttcaaggctgcagtgagctatgataactccactgcactgccgcctggatgacacagagagaccgtttctaaattaattaattaacaattttaagaaagaaaaagggccattgcttatttttccatacaaaagtaaaataaatcataatggccaataagccaatgtaacttttttttttaagggaaagcaaaacttgtaaaacctaaaatctcttagagttttggcatttacccaaatgttttcagtgattctgagaattggtggatataaaacacatttctcagcaaacactttcttcattttgcatcccttactgtacgtactttcttgtactgaatctttgcttgaccagggaacccacctagcccaacaagaacaatccattctacttcttggaactcactttattttccttttcccccatttcctataagataacctctaaccaatgacaatctcgacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtaagacatgaccgttgttcattggaataaagatggagatcatctctaacacagtttctaaggtggtgaaaatataatatcataataaatctaactgttcttttcctctgcatcaaataatcttattgtaattttatatcaacggaattcctttatgttgacctaagttttccagatgactattgggacagaattttataaatagctttggattttgtgcagctcttttagatgtattgtgcttattttaaaaggttgtggggggcaatttacatatccattggttgaatgcataaatcgacttagttatgcattttctgagctctgttaccttggtaaagaatattttacagtttgtaccagtctaccttgagcctaccctcattaaaacattttaaaatccttccagacatacatgcagaaaactgctaggaacctaggggactgatgtacctcttaacataaggccaatttcaggggaaactacagaaagagggttcagagacaaaatggaacattctctttgcctctctatgataaggaaaaaattatgatttacacctgtcagatcataaaaaagaaaaatacgctaatacccacttttctcattttttttaccagcttagtttaagtatataatctatggcttacttaagcttaaccgctaagagcattttaaaattgataaatacatttatcacctgcactgtaggaatgaaattaatctaggaattttcaaggttgtgggttttgctggtttgtttattttttattttctaaccattgcatttacctaatgctgtagtgaaactccttgggtttcagttgaggacgttgctaaagctcaccatgcccttatttctctaggtggccaccaaatatgaagtgagtgtctatgctcttaaggacactttgacaagcagaccagctcagggagttgtcaccactctggagagtaagtaacaaaatgtcttcatatggacaaaccttctgtatagacaaaaattaaagaatggtaaatcagtggggttcagtggctcatgtctaaaatccaagcactttgggaagctgaggcgggagcgtcacttgaggccaggagtttgagacctacccgggcaaatagcaaggccctgtctcttaaaaaaaataaaataaataaaataaataattttttagatttatatgttaacagtggaatgagtcctaatttgaaaatcaatttgattgcctttttgacgcatgactgtcatcttttatactccttcagaaaggggtctactgacccataaaatggaatcacttcataagcttataatgttgatattatggactatgactgacatctagtttatgctctacttgttagaatttgttttcatagagctaagcttggggagaccccactggcttctgctatatcttaacaatgcatattaggccattcttgcattactataaagaaataccggagactgggtaatttctaaagaaaagaggcttaattggcccacaggccagcaggctttacaggaagcatggtgctggtatcttcttggcttctagggaggccttgggaagcttactcatggtggaaggccaagggggagcaggcacatcacatggctgtggcaaaagcaagaccgagagagagagagagttggggggggaggaccttatacatttaaatgacccagtctcttgagaactcactgtcataaagagggcaccaagccacaagggatctgcccccatgatccaaacacctctcaccaggccccacctccagcattggagattacaactcaacagagatttggacagggacaaatatccaaattatatcacagcacagtaaccattggaccaaatcaggcttagattctagtcttctgttatatcaataccttgatgtatgccttttcaaaagtcaggtaaagtgtcaaagttttatcatttataaaagagggatggcattgtacctgttgagagaaaatacaaaatacttgccgtaatattagacacacacacacacacacacacacacacactctctctctctctcacacacacatacacacacacacacacaaaattgttagctggccatgttattgtaactcctaccacacatatttttacattataatacattaataattttaatatttattgaagtatttgtagatactataaagccagccctgggaaccactggtagtatctataaagcttttcagctcttcaaaataaaatgtctgagaggtagatattttcctattttctaattacagttgacctttctctctgaatgccaaaggagataatctacacattactagttatatatttcttgaaatggatgaatttgatatataccaaggaaacgttttaaaataccaaaactttacatggatgagccaagcaggcactaatctctagctatgctcctgtgcagatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtcagggaactcattgcactaaccacatttgttaacaaatacccacaatgtaaacgggcttattaactgttctacgactgacactgataaaatttattttcagtgttatcatcataacccagttttagaacgttattttcatgctatgatcagaaatagttttgtcctttgaatgcctgattttgtgtaatatttgtcatggaaattgcgtaagtgtcaatcaacaagtttgatcttccatcattgtgccctttcttatttaaaaaattgtaacataaggtttaaaactaaaagaaataaaaaacagtgatgtatagatcttagcattaaaaagcatagttaatataaaagtaaacaataccacttaataaaggccaaaattgtaaccgaagaatattcaatatctgaggtcttttttagctttttaaaattgtgattccaaggctcaactattgaccatctgattacggtaaagagaaaacctcaataagtggctgacccccattctgcaagagggcctcttccaacatagcatttttgcattccagaatttactttaccagtgtccttgtctgtatcagtgattcactttcgagatatgtttcttgttaacagttaacatccatagcatgctctactttactgttcaaatgtggaccactttggtagtctatataaatatgggatgatagaagaacccagaaaaattgcaggctagcttgagaattctcctagtaaaaagcaagaactgttaaaaatcatctcttctcaaatcccaggtttacaaccaggcactgactacaagatctacctgtacaccttgaatgacaatgctcggagctcccctgtggtcatcgacgcctccactggtaactataccttctactgaggaaatgccattgacttgtatgcaatcagtttcatgaactcaaaaaacaaatgtgaggcgtatatttttgtattatagattccagagaatcttgtttccggtttacagtattctcagattcttttaagtgtgtttagaacggctcgggagaaaagtgtgggagtaattttcttggttatttgccttcttagagacttaattttgttttctttcagccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggtattgctgcttccatgctgtcattttccttcttactacctaggacacatgaagtccttagcaaactcccacagcgtctttgatactgtgtcatgagaatgcgaaactctgttcctgataacctcaaaaagcattctctgtgtaggagtggtagagcctaatacatcccaaaaggcatgagtgaaggaaaatgcaatttcaagactgtactaatggcatgactagactcatgttttcctttcgctgcaagtttgccagatacctgtcaattcagtcctggagaaagatatttttcaaagcatactagctgattgtgattctgtcattacactcagctctctatagatatggcaatcttgcaggacttgccagtgcaccacctgccattgaccttgttgaccactatcacaggataggtcttgaggcagagcagtcccaaccacccacattggaagaatgcctggaatggggaataagagttgtctaccttggtgggaaagactataagcctctagtattatttttgcccaagagatgaaatatttaaactatctgtattagtctgttttcatactgctataaagaggtttaattgactcacagttccgcatggctggggaggcctcagaaaatgtacaatcatggtggaaggaaaagcaggcatgtcttacatggcagcaggagagagaagcacacaggaggaacttccagatacttacaaaactatcagatcttgtgagaactcactatcatgagaacagcctgggggaaccaccccatgatccaatcacctcctctcctcaatacatggggattacaattccagatgagatttggatgcagacacagagccaaaccatatcagtctgtatagagtatcacctggactttaaaattcccacagaacatacagacattagaaggagacactggctttttagaattggggggaacaggaaaatagaagcagacatgagaggaattgaactagacacttcccacagaggctgcacaaacactggccaatctctcctacccttcacttgcctttagtttcacttttcattgatctgccactgaggactgcttggttattaggcctaagtagattcatgtatataatctgcaggactctctttcaaatttatattccagtggtggtatatgatgctgatagattttcttaaattcaaaaaggcaaataagaccacgttaaaagaataccctggaaaggccaggcgcggtggctcacgcctgtaatcccagcactttgggaggccgaggcaggcagatcacaaggtcaggagatcgagaccatcctggctaacacggtgaaaccccatctctactaaaaatacaaaaacaaaattagccaggcgtggtgatgggtgcctgtagtcccagctactcgggtggctgaggcaggagaatggctgaacctgggaagcggagcttgcagtgagccgagatagcaccactgcactccagcctgggtgacagagccagactccatctcaaaaaaaaaaaaaaaaaaaaaaaaaagaataccctggaaaagttagccaaaaaatgtctattcaggcgtcagatatgatagtaagataattagtttgcgatgcggactttatatgcaggatatttgggtgtttatggaggaaaagtgaagtcgattttaccttcaagaggccaacagccagctggagaggaagtgcctgctcccagtagcgtctgctggtgagaccgacttccacttgactagctgagcccattgacataatgtgatggttctattctcccttcaggcctggaaccgggaaccgaatatacaatttatgtcattgccctgaagaataatcagaagagcgagcccctgattggaaggaaaaagacaggtaagagtatcttgcaggtaacaaggagaaagataggacaaaactaataacaaatgagcaatcttgcaatatgaaaaggttctccatgttttgatgcatttcttgtgattttttttatctaacagcatagtgtatatattgtattctttaataggagaaataatttaacatgcactgcagagtttggttttattttttttctttactacagccactcaatataaagccttgttattcaccttttaaaaattcaaacaagatgttaaaatgtaaaagaagagctatcattgctcttcttttataccttctgttgaattttaaaatgtttccttttttaaaggagggagagaaacctctcacatttatctttatttggtttctacaacttagagctaaataatgtcttacttttgcatccagtttcagttaatttcaagaaaatgtgtattcctgatataggaaaatttcaaaaatgaacatgtgtgttttatctatttttaccatttcaaaccatgaaaaactgttgagccaaacctctgtaattctcatacttatgacactgatatgattagtctggattctacttcctacaacttgcttctcaaatttaaaaaagaaagagagaaagagaaagactgcacatttcagttccattaggtctaatttgagcagaggcagcttctacggggctcagcggtttaaagctgtgtgtatgataaattcatactaacacttttttctttctaaactataaagaaacctttgagaaaaatcctaaagatttctttctggaaaaagtgttttgtgatctcagaactgctcattttctggtggcttttatcaaattgatgaacagtcattgttgcctgaatcgattattatcattgctgctacttcctggagcttaatgcgctttgcttttttggctctaacctctctcggctagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacaggtaattaattgttctcttcacttctcatggggcagcacagaaaggaataagttaggtaactgaagtgaccagccctcgaataaaaagtggcttcatggccgggtgtgatggctcacgcctgtaatcccagcactttgggaggccgaggcaggtggatcatttgaggttaggagttcaagaccagcctggccaacatggtgaaacctcgtctcttgaaaaaaaaaaaaaaaaaaaagtggctccacttttagaacctcttagaagatggcacatttaagccctgcttttttttttttttaaatcccaatatggctctactttggaggacataccagagagtcactagcttttatttcatagagaaaatgaaactatttctcttattctcacacatttgaggttcctttttgagtaagatagatgattctagaaaagaaagatattctacctgaatttccatttgtgtgcagaagtctaaaacactacctttacgatttgtccttgaagaaccccactatctacaacatatctaaagaaaaaaaaaaacaggcgaagctgtgcatagcagctgataagtgattgattctctaaaacgtatattatttaatttgtgttgacagtatccatttttttttttccccgagatggagtcttgctctatggccctggctggagtgcagtggcgtgatctcggctcactgcaacctctgcctcccaggttcaagcaattctcctgcctcagcctcccaaatagctgggattacaggcatgtgccaccgcacccagctaatttttgtatttttagtagagacggggtttcacgatgttggccaggatggtctcgatctcctgacctcgtgatccgcccgccttggcctcccaaagtgctgggactacaagcatgagccacccactacacccggcccactgacagtatcaatttttattgtgttgttacttttagaaagtggcagaatttaaaaactgacaacactgtaggaaatttatgagcttagaaacatgagtttgaggatttgcccaactgttttaaggactccacactggggtcagatgtcacctggaggagcatgaccgtgtctcccatatagcgcagtgtccaggttttatgtgaagcaaacatggccagggcttccagagggcttatgcagacctgcgactgaagcaagatcaatggcaggccgtctctagtattgtcgagggctcctgttaactacggagcacgtaggtagattgttggcaggaaaatctggcaggaacgatggcccctatccttgttccatttctctcctcagctggttaggaccactataccctccctcttttttttttttttgttttttgttttttgtcttcctttgctttgtttaaacagtgagggttattggtaagaggagagcccgtgtcattcctcactataatgctttctctctgctttggatgtaccgataattgcagttcagggttcctggaacttctaccagtgccactctgacaggcctcaccagaggtgccacctacaacgtcatagtggaggcactgaaagaccagcagaggcataaggttcgggaagaggttgttaccgtgggcaactctggtatgtaaacacgtactatttagacacaggctcccctctgctgtacaccagagatgggcttttctgttgactgtacctttgttgccattgtctttttatctttgggatttaatgcaacacatcaacatgaaataaatgagcaactttatattaaattaatctctcccccacctcctgccatatcctgttgtcttcacaaaatgcatacgtaattgacagactctcaaatggtgatatgattatagatctggaagggatttcaaatattatttagtacaacactctgagtccttacttctgagtatctgagttgatatagggcacaggtttcctgatgtcttttcccagaccctctccatctcaccatgctgctgtcctcttgagtgattaaatactgaaacgattacctataaagaaaataccccttctgcagacatggggacagttggcttttgctcctgatataaaatgctaccaacattgtgcatttctgtctgcagagaatgttattccaatgttatttccatttttttccaatgttatttccatttttttttctgactatacaggttaaaagcttctatagaggttaaaagatcattaactcttctttgtagcacctgggaaatccttttaaatcaatagcgtgccacctggctgctcaatttgcagcagctgaaaattcaccaaggcacatgagataggggataatcaaaaccgtgaatccccaatcttccaacaggagagttctctactccacaccaacagagagtgctaagtcctgtctatgccaagtgacagattttattcctaaggccagttgtttaattttagccccttccctcatctgatagaagactgtgctactttacatgtataaattcctgtgaattaagcagttgagcatttggctggagagaggttgggaggagattattttgtgtttgttgtattacatatccacagtaatgcttatctttgccttttgtggttttactagtagaatgccacgtgaacagaattttcaagagcaaaaaggtctttgtgcttttctaagtcattttttttttttttttttaaagattccatctctttaactttagttaggatggaatttgaactcctggctcttttgagtatagaaacccctagtaacaatttaagttccttccatttttcttttaaactccttattcccagcagcagtattctacattctaaccaggttctcccagctttgagacgtctcagacttaccagttctccaaaacgctattttctttaagggtgacaccttttaaaaattaggcacctcaaatatctactgcttttgagcttttgagttttgcactgtaaaaagaaaaatacacagtgggattttaagtcaaattagtttatctaatttttagggaataatttgaagcatgctttgtttgcatagatttttttaaaataagcttttccaaatcataaagagataagatcttaggtaacatgaagagactcccttacttattcctaaatcatctatattccaagggcattttcttatttggaacagttgacctcactgataaagctgtctcaccactataataacaatgtccaaaatctaggctttctgcactattatgcaaaaattacaataataaaagtgaaaattacattataatggtatattaaaatgctaagacttttgcattataagcaaaagacagcctttaataattattctttatttagtgaacattttctaagtcttggaaaagggtcaatgttttgaattcatggccttatataatcttcacaagattccccaggaggtatagatatttttattattacgctagtattgcagatgagggaagcaaggcagagtggtattaaatagctggcccaaggtcactcaggtaccaatggagaggcatcattagtctttgcatcccactaaagttctccactagcttcaattgcctcaagatctgttccatgttctatgaagtagtttcaacagaaatggcaattatcttagaagcaagggaaaaataaaagatgggcttcctgtcgggtgcctgtgacaggtgtcacatctaaccatggttttttagagcagttaatgccttgatagaacagatgaatgcctcttaatcctcctggaattcttgttttagattaagtcattgtatacagtcattcgattttcttcttatggtccaaatcgattaataagatgtctctttttgctttttcttccttttcttcatagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagtgagtagttgctttgtccatccacttccgtgtttgtctcctcaagttccatgcatgcactcatgtgccaaggaagcatgtttggaagacacaggttcttccaaacatgaagcaaacaagagaatactgtttgactcgaagtaatattttgcatcatagaaaaatgatgggaaattttacttgttggacattgcttcatttcaagggttgtatgccaatacaactattaattacacataagattatggtgctaatttgatttttgaaattttctgtgaaaacaaatggataaagacttttggaaccaggtctatttaagagtattagagacacagaaaaacctcaaatctcttttaatcttcagtgttgaatgagatcagaggtgaacatttagactcaaaaacagcctccttcaacataaaccaaacatgcacatatcatagtacccatgcacacacttttgcgtcacacacatagcccaggtagcttgaacgttgctagaaatatgaaagaaaaaacagataatctgcttttagatcattaaaaatcaacttgaattgataaatgtttgattttcaaattctaatacgttttaattttcaaattttttaagttaaaatgtgcctaggaaatatctattatgctttgagattaggattagaatttataaacctttcatttattctttgtgtttaggagatgtgatgattattgacaattggttcatttttataggtgttgaccgttatgcctataaataagcctcctatagacatacagaaatcatatcctgtggaattagaatataagacttggtaaaagagattttcaaagtattttacttaacttgtatacttgaaatcatttaatccagactgaagttgtaaaagccagccagtgttttcaatatagacttccatgtttgaccatctgaaaatgaaaaacactaaaaacatcacatgctgtttaggagctggaaattttaatatttgacttcaagtagatggtttttaactcctgaaatcgaactacgtttaagtttgtatgtttattacctgtttgagcacttaggtgcaattgtgggagcggggatgtcaagttcatttatgtgactctttggctcaacttacataatctttgttttgatatcacagttgtctaattattttactttgtagcttaaggcaggctgaattgttgataaaatggaaaaagtagtatattgttatataagcttctgaggtgtgttttgttgtataagccctggaggttaaaaagtcatcccttatgtatagtagttaaaggcataaaactgtgacttttagatattccacagaaccagacttatttgatgtggataataaccaatgatttagcattttgtttgcttttgttttattttatccgggttcattttttactcttcccatgtacatgaaacaggtggtggcgtgtagagatcagctgatccttgttttatggttaattgaactactttgtatccagggtttctgcaaatccaaaagtgatttttcatctaggatctattcctaacagtctactccaatcccactttagttttccacaattttaaatcttaatagtgagaattcaaatgaaagtcatttcatttgactattctgatgacatgattgtggcagaataaattgggtcttaaaatgccctagaaaatggtaaatgataaaaaataatattttaaaattcaaccaaagaaatggcccattggccaggtgtggtggctcacacctgtaatcccagcacttttggaggctgaggcgggtggatcacctgagctcacgagtttgagaccagcctacccaacatggtaaaaccccatctctacaaaaaatacaaaaaaaaaaaaaaaaaaaaaaatagcactgtggggagtgcctgtaatcccagctactcaggaggctgaggcaggataactgcatgaacccaggagatggaggttacagtgagccgagattgcaccacttcactccagtctgggcgacagagaaagactttgtctcaaaaaaaaaaaaaaaaataaaaagtaaataaataaataaaataaatggcccattataggggtttttatctttaacttgctatttttccagatcatggttctgaagaccctgtgacacgtcccagttcacctactgtcttgtgagtcagaatatacaaataactttttggtcctgactttccccacccctacaggatggtgccatgacaatggtgtgaactacaagattggagagaagtgggaccgtcagggagaaaatggccagatgatgagctgcacatgtcttgggaacggaaaaggagaattcaagtgtgaccctcgtatgtcatcacagatcatttttagtgccttattaagcattctcactttcattatcaggctgtaactctcattcacagaaatgattggagactttaggtctccttgaggagtgaacagtgggtttcttaatcttttgatttgggaaagtggagacaagcttcaaaaatgagtcatgatttaatgttattacaggacactttagcacttgtccaacctgagtattttgaccattatctgcagtaaaatgctacaaagaagctttattggtctgtagattcaacttttaaaatatgatttccatcttcccgttggaccctttccagtgtattaggtctaatttttggaagtgccaccctaagatctgtatagcagtactgctcttagggatgattcacataaatatgtggtgtttgcgctgtgatgatacaaatttaggacagaaatagaacccacccctagatcaagtctgcagtattgttctcagcttatgcgtgcatctgtcttgtgtctatatgcagatgaggcaacgtgttatgatgatgggaagacataccacgtaggagaacagtggcagaaggaatatctcggtgccatttgctcctgcacatgctttggaggccagcgggtaagactggatgtgccaggctccctacaagttagataagataaagggtgggctcctgcaaggatgtgtcgtacacacaggaggggcagagacccttcggaagtattaaaataccacatttcctgttggcatacaactgctgacatagagctctagagcagctctatgtctaccttacatgccattcattctttctattactcttagtagaaagaatgaatgaatggcatgtagagtaccaaaaacacaagtcttgagtcattcttaatagcaacacctgtcatttatatgatgttagaatcattttcctaagctccctagcatgtcagagatactatttacactgaaaaatagtgaagcagagatactattcaaattaattagtggtaaatagaatgtgtttcatttcagccggttctccccatcctgggcagcctgagaccctcccctcccctactattctcaggctgcttctatttttcagcaaagtgttaagtgcagtgtagctctaggcctccaactccattctgatggacaggtgtcccatggcaacgttgttaaatattttgaataatatctcagatgtaagaaaatgccacttcttttaacctctctcttgattcagaacagatgcttgttataggtctagcactgtgctaagtagtataggaaaaacagaggaaatgagaaatggcttggctcttaatgatatagttgaagatgttaaattagcatacatttcaaagtcaagctaattaagttctaagtgggtctgacaaatacagttctgggtaggctggaattagcaagaaagagaagcatgaactggctgaggtttacgatgactaaggtttagttgggaggggagaaagcagagagacacaccccctgggatagaaaggagctggcccaggtgggctttggtgagccaaccctctgcctgctgtcttctggtaagaaaatagatgggaagaagtggcttatggagggccttggcaacccattatttaagccagtacttctcaaccatttctaaaatatgcccagtataacaaaaaataataagcctttctctaatatgatttcaaatttcaaaatgaaattatgtgtaactcaaaagcaatggaatgtgacagccctttgttttcaacgaagacatgccctcccagcaactccccaaatcctggtgggtgaggggcatgcttcacactcaagggtgagactcattggttaatgccaaatgcattaaccaattacaggtatccaagatgcaaagaaacatgatggaaaatagtctttgggaaaattaatctggcagcaggggtgttcaggggcctgtcttggctccaccaggggcagcccatggaaactactatgatcttgtttcacccccagtgattacatggggagggaggtgctcccaattctgatggaggagaattggagattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgattttggtctcacttcagcatcttctcattatttatgcacatgaaacctttcatgtgcgacacttattctattctcaagtgctaaatgaaacatttaagacaggagtggaaactgttcactttctcatatgaaagcaagattcagtgattctgtaaggaggtagtcactggtattgtgttaggtattaaggggcatatgtgcttaaacagagaaatatgtctaaaatatttaaattctaatataaaaaagaaagtgactgtattatttagggctgcattttagttgtaagaaaaaagtccaactcaagcaaaaatggcccacacaatggaacagtcccaggacccaccggcttcaggggctgctccagcaatggcgcccggactccctcttgctccgcgtgccttcccatgcactggcttcgtgcttcagcggggtctctgctgatggtgccattgatgactgacctccatgagcttgctttaccccctgccagcttaagaacagtagtgaaagagaacatgtgtgtcctcccatttccagtaaaaacttcaggcaggagcctcactggctcagcttggtcccgtttccatctcccatgccatctccggccaggtgacaggctaccatgtcactgcctagggaagtttaggaagagagtggcaaagtggtgcattagaaagaacatggccaggtcaccccacctcctgggcggcaggcccaactccaccagtggtccactgtgtgacttccctgctccctctaagcaagtcactcctctcctctgggtctctgtttccttacctataaaatgagaacgtttcttcatgtgatctcaagtcccttttaaaatcgctaggattctttgaaaaccttttctatcatctagtgcagagaacttgttgaggaagttgggattggaatgagcctcagcagatgggcaaggtttgaataggaagagaagagacatttcaggagaaagaaacaacatagagagacagatgtaggtataagatatggtaataagccaaaatgtattaagagttataaatgcatgaaatcatcatcaaagcttgcttagtgattaactgcttatattttgccagtgcatatgatgtgacatttttctttaactcaaacactaaattacgatgtcctcaggttatcataaaccccatttgacttcatgcctctactctctcagggctggcgctgtgacaactgccgcagacctgggggtgaacccagtcccgaaggcactactggccagtcctacaaccagtattctcagagataccatcagagaacaaacactgtaagtgcattagcagcacaagtgtgttccctcatactagacagtctctttctacaggtatctttcttcagaatgaaccaagtgttttaattaattaaaaaaaaaaacaactcataaatgacttaagtgaaacactgtattccataatatagtttaagttataatttatgtaactcttgaacatctcctattgcccagtatgctgctaggttcttgaaactaggaagaaatattatcctatctataagcagctgtcatgagtccccacctccccgcatttttttttctgtacactttacagtatttgccactaatttttttttccttcttcctttttaacagaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatatt
